United States Patent 10,851,135 (DE NOVO DESIGN OF PROTEIN SWITCHES) - sequence listing, part 2

SEQ ID NO: 11986 - protein, 187 aa, Artificial Sequence
  Synthetic
SLEEEAKELVKRVRDELRKIERTIEKIVEDSRRRLEENRKRNKELIERVEKELRELKKRVTDERIKKVVRDVLEKARKLLEESEEMVRRVERISERTLRTVREVVKEVEKIVEKLLEDVKRKSSDERARDILREAKKMLEKVLRDLRRVLEELRKENEKVLRELEEISKETEDRLREVLRELRERTR

SEQ ID NO: 11987 - protein, 187 aa, Artificial Sequence; identical to SEQ ID NO: 11986
  Synthetic

SEQ ID NO: 11988 - protein, 175 aa, Artificial Sequence
  Synthetic
SVEDEVREVAKKIRRILEKLKRELDRHSKKIEDILEEIRDKNEKAKEEIEEVLRRRLDEEIKREVKRLEERLDEVSDKTRRAVEELIRNNERVVREVERVVRELIEILKEVLRKGGKEDVERVKRELEKVLRELAEEVRESLERVSEVAERLKRENDEVNDRLKKMLEDLLRKAT

SEQ ID NO: 11989 - protein, 175 aa, Artificial Sequence; identical to SEQ ID NO: 11988
  Synthetic

SEQ ID NO: 11990 - protein, 175 aa, Artificial Sequence
  Synthetic
DEVEEVIRRVEESNKRVNEENDRVVRESKEIVRKVEEDNRRAIKESEEMLDRVAKDRDRDKLRDVLRRLKELHRRTIETTKEMADRIRKLHEETIRRTREVLERNRRLAEDVLRRVPNVEEDLRRVVDKSRKNVEEVERKNRDVLRRIDKRAKELEDRNREVLKKIEKTIRDLEK

SEQ ID NO: 11991 - protein, 175 aa, Artificial Sequence; identical to SEQ ID NO: 11990
  Synthetic

SEQ ID NO: 11992 - protein, 175 aa, Artificial Sequence
  Synthetic
SEVDEVIRRVEKSNKDVNDENKRVIDRSKELNREVNERNKEAIKRSRDLADEVRRDRDRKKAEEMVRRIEELHRETIKRTKEVNEEIERLHRETIKRTREVLDENRRLAERVVREVPNVEERLREVVKRSEDNVRKVEEDNRRVLEESTRNVKEVKERNEKVLEEIRKTLEDLER

SEQ ID NO: 11993 - protein, 175 aa, Artificial Sequence; identical to SEQ ID NO: 11992
  Synthetic

SEQ ID NO: 11994 - protein, 175 aa, Artificial Sequence
  Synthetic
SEVDKVRKELEDMAREIEKRAEDVIREIKRSNEEVNRTNEKVIRDSERMLEKAERDRDREKLRRIVRTLEKLHEDTIEFTKKVLERNKELIKKIAEELRRVLKELTERIKDVLRRVPNVEERLDRVREKLERIVREIEDRLRKVLEDSRRNVEEVRRRNEEAVKKIRRILEELER

SEQ ID NO: 11995 - protein, 175 aa, Artificial Sequence; identical to SEQ ID NO: 11994
  Synthetic

SEQ ID NO: 11996 - protein, 175 aa, Artificial Sequence
  Synthetic
DEVDDVIRDVDRTNEEVERENRRVIEEVRKSNEEVNKKNADAEKRSREMAERAAEDRDRRKIEEILERLKDLHKRTIETTREVLKRNEDLMRRTIEDTRRVLRENEEKLRDVLRRVPNVKEKLDRVLERSKKTVEELEKRNREALDRSRRNVEEVEKRNREVVKEIAERVRRLKK

SEQ ID NO: 11997 - protein, 175 aa, Artificial Sequence; identical to SEQ ID NO: 11996
  Synthetic

SEQ ID NO: 11998 - protein, 175 aa, Artificial Sequence
  Synthetic
SEVDKVVEDVKRMLKEVEDRNEKVIRDVEKMLREVEEKNKRVIEDSERVAKEAADDRDREKVRRLLERIRELHERTIKETRDVARELAKLLEDTIRFTRKVLRELEELLRDVLRRVPNVKEKLDKVLEEIREIVKRLEDRNREALRRIKEIVDRLEKRNRKVVEDVERIVREIER

SEQ ID NO: 11999 - protein, 175 aa, Artificial Sequence; identical to SEQ ID NO: 11998
  Synthetic

SEQ ID NO: 12000 - protein, 175 aa, Artificial Sequence
  Synthetic
SEVDEVIKRIEETNRRVEEMNKDAIRRVKESNKRVEERNKEVIERSKKLIDDVRRDRDRKKLREVLERIKDLHRRTIEDTRRVLKDNDELVRRTIEKTRRALERNKELIDRVLKRVPNVEERLRKVLKDSERTVKELEKRNRRVLEESDKEVKRLEKENRDVVDEIRERAKEIER

SEQ ID NO: 12001 - protein, 175 aa, Artificial Sequence; identical to SEQ ID NO: 12000
  Synthetic

SEQ ID NO: 12002 - protein, 175 aa, Artificial Sequence
  Synthetic
SEVDKVITELEKMLRRVKEENKRVIDESRRALEEVEKRNREVIERSDEMARRAAEDNDRRKIREILKTLKRLHEEAVEDTRRVLERLRRLHEKTVRDTKTVLDRLRELIEDVLRRVPNVEERLREVLERIARRVRELEERNKKVVKEIEERVRELERRNREVVKKIEEKVKRLET

SEQ ID NO: 12003 - protein, 175 aa, Artificial Sequence; identical to SEQ ID NO: 12002
  Synthetic

SEQ ID NO: 12004 - protein, 175 aa, Artificial Sequence
  Synthetic
DEVRKVIKELRDELRRVEELNKEVIDRSRKLVEDIARESKEVIERSRKLLDDVRKDRDREKLERVLDEIRRLHEDVLRKIREVVRTIEELHRDAVRKSKEVLKRLEELIRDVLRRVPNVREDLERALKEIEETIRRLEKRNRDVLKEIEDEARRLEEENRKVLKEARKIVEDIKT

SEQ ID NO: 12005 - protein, 175 aa, Artificial Sequence; identical to SEQ ID NO: 12004
  Synthetic

SEQ ID NO: 12006 - protein, 175 aa, Artificial Sequence
  Synthetic
SEVDDVTRKLERILEELTETSERVVRTSRRVAEELEKRSKEAVERSRKLAEEVARDRDREKLRRVLKEIEKLHRDTVKDLRDALKKIEDDHRRVVEKLKKALEELERLIRRVLREVPNVREKLERVLEEIRRRIEELSEKNRKVVKDIREIVRKLTERDEKVVREIKKIVDDIET

SEQ ID NO: 12007 - protein, 175 aa, Artificial Sequence; identical to SEQ ID NO: 12006
  Synthetic

SEQ ID NO: 12008 - protein, 175 aa, Artificial Sequence
  Synthetic
SEVDEVTREVEELIREVEKLSEDVIRTSKELAKRAEKLSREVIKRSEELIDEVRRDRDRRKLDEVVKRIEDLHRRVLEELERIVREIEKLHRETVKRLREVLERVRRLLEEVLERVPNVKKKLEDVLREIAKKVREIEERDRKVVEEIREILKRLEDENREVLKKIRRIAEEIRR

SEQ ID NO: 12009 - protein, 175 aa, Artificial Sequence; identical to SEQ ID NO: 12008
  Synthetic

SEQ ID NO: 12010 - protein, 175 aa, Artificial Sequence
  Synthetic
DEVRKVIKELEDRLREVEKKSKDAIDTSREMLKRVDDENKDVKRRAEEILKRVDEDRDRKKLRDVLRELERLVRETIKSSKEVLDRLRKLHEDTVRDLRRILKELKELIDDVLRRVPNVEEELRKLLEDIREKVERIVKRDEDVVREIEEEARRLADENRKVLEEIERIIRELER

SEQ ID NO: 12011 - protein, 175 aa, Artificial Sequence; identical to SEQ ID NO: 12010
  Synthetic

SEQ ID NO: 12012 - protein, 178 aa, Artificial Sequence
  Synthetic
REVDEVTRRIKELNDELERRVRRAKERIEELNKRVNREDEEIVDRVRKLNDELAKDNKRELVDEVLKETEKLIRRSEESVRRVLEETEKLIETLRREVEKVLRETERLIKEVVERRKDDEDVKRKLKEVVDESRRTVDEIRRELERVVEKSRKNIEEVKKHTREVLKRSEETARELKK

SEQ ID NO: 12013 - protein, 178 aa, Artificial Sequence; identical to SEQ ID NO: 12012
  Synthetic

SEQ ID NO: 12014 - protein, 178 aa, Artificial Sequence
  Synthetic
SEVDRVLEEIRKLNEDLNRRVDDATRKIRDLNRKLNEDVKKVTEDIKKLNEDLRKDNKKELVREVLKRTRDLIRELEKIVTDVLRTTEEVIKRLEREVEKVLRDTRELARDLLRKRKDDEEVKRKLEKLVRESERNVREVKKKLDEVRKESKTNADKVREELKRVVEESERTVRELEK

SEQ ID NO: 12015 - protein, 178 aa, Artificial Sequence; identical to SEQ ID NO: 12014
  Synthetic

SEQ ID NO: 12016 - protein, 178 aa, Artificial Sequence
  Synthetic
SEVDEVEKDIERLLEELRERVKRVTDEIRKLNKELNETDTDIVRKIRELLERLERDNKRELVREVLKRVKELADDSKRRVDKVLKDTERLIRELEKIVDEVEERVRRLVAEVLKRRKDDEEVKRRLEEVLRKVKRELDRIRDELRRVVEESETNVRDVRRHTEEVVKEVEDEVRRLEK

SEQ ID NO: 12017 - protein, 178 aa, Artificial Sequence; identical to SEQ ID NO: 12016
  Synthetic

SEQ ID NO: 12018 - protein, 178 aa, Artificial Sequence
  Synthetic
SEVEELERRIRELLRRVKRIDEEIVRRIRELNKELNRRDERIVETVRELVERVARDNKRELLDEVLKDVRRLAEESKRIVDEVLKDTERLARESKEILERVLKEVKELIEELLRRRKDLEEVKKRLEDVLRRVREEIERLKKHTDDVLRESEKNAEDVKKHTDDVVREIEERIRELKK

SEQ ID NO: 12019 - protein, 178 aa, Artificial Sequence; identical to SEQ ID NO: 12018
  Synthetic

SEQ ID NO: 12020 - protein, 178 aa, Artificial Sequence
  Synthetic
SEVEEVIKEIEKLNEDVNRIDKEIVKRIRDLNREVNERDKEIVKEIKRLVEEVRKDNKRELVDEALERVKKLAEDSKRIADDVLRRTEKLLRESKKILEDVNRTVRRLLEDLMRKRKDLEEVKDRLRKVLESSSDNVRRVTEHTDKVLEESRKNIEDVKKHTDEVVKEIEKEVRELKK

SEQ ID NO: 12021 - protein, 178 aa, Artificial Sequence; identical to SEQ ID NO: 12020
  Synthetic

SEQ ID NO: 12022 - protein, 178 aa, Artificial Sequence
  Synthetic
DEVKEVIRRAEKLNEKINDILRRVEEEIRRTLDEVRRRDEKIVKEIRDLMRELSEDNKRELVKKVLEEVERLARKSVEIIREVNKRNEDLIREVKRIADEVLKRTRDLVKDVRDKRKDDEEVKRELEEVVKESEKNIREVTDRLRKVLEESTKIVEELEEHTKRVVDEIRKRADELRR

SEQ ID NO: 12023 - protein, 178 aa, Artificial Sequence; identical to SEQ ID NO: 12022
  Synthetic

SEQ ID NO: 12024 - protein, 184 aa, Artificial Sequence
  Synthetic
SLEEEIDRVLDEIRRIIEEIKKHTTEVLEESKRNIEEVKKHTDEVNEKSRRDIEKIKREVRDKERVVELLDRVVKTSEDLARESKRILDEVLDTSRRLVEDSRRILDDVLRRVRELAEELKRVKDKEKVRKVIEEIKKIAEDVARRDKEMVDRSREINKKVNEEDKKIVEDSKRIIEDVKRKTD

SEQ ID NO: 12025 - protein, 184 aa, Artificial Sequence; identical to SEQ ID NO: 12024
  Synthetic

SEQ ID NO: 12026 - protein, 184 aa, Artificial Sequence
  Synthetic
SLEKEIKDALDRIKKDIEDSARRTKEVNDKSKEIIDRLKKHTDDVNDESRRRIKEIKDEVRDKKRVTELLEEVKERSKRLAEESKKILDEVVKKSRELAKRSKEILDEVLKRVAELAEELKRVSDKRLVKEVIDRLDEIVEDVKRRDEEIIRTSEKLLRDVARLDEEIAKRSRDLLRDVERKVK

SEQ ID NO: 12027 - protein, 184 aa, Artificial Sequence; identical to SEQ ID NO: 12026
  Synthetic

SEQ ID NO: 12028 - protein, 184 aa, Artificial Sequence
  Synthetic
SLEERLKKVLKEVDERIREIKKHTDKVNEESRDKIRKLKEELDRVNRESEEEARKIKSEVRDKERVVRTLKKAVEDSKKLIDDVKRILDEVVKRSEELVERSKRILDEVKRDVRRLIEELRRIEKDKDVRDVEEEIRKLLDEVRKLDEEMVERSKKLARTVERLVKEVIRESKEIIRKVKEETD

SEQ ID NO: 12029 - protein, 184 aa, Artificial Sequence; identical to SEQ ID NO: 12028
  Synthetic

SEQ ID NO: 12030 - protein, 184 aa, Artificial Sequence
  Synthetic
SLEEEIERVLRKVEKEIRKIKERLDEMLKEIRERIERSKRRTDKVNEDSRRRIEEIKRRVKDKKEVLERLDEVVRKSEELARRSKEILDRVLETVERLIRRVKEILDRVLDEVRKLAEELKRVDSKEDVKKVKKDIDKLLKEVREEVKEAEDRIRRIAEEVDKEDKRMIETSRRIIRKVDEDVR

SEQ ID NO: 12031 - protein, 184 aa, Artificial Sequence; identical to SEQ ID NO: 12030
  Synthetic

SEQ ID NO: 12032 - protein, 184 aa, Artificial Sequence
  Synthetic
RIEDKLRKVLEEVERIIREIRKRLEDANDDSRREIEESKEDTDRVLEEIRRRIEEIKREVRELEEVVRELDEVEKTVTKLAEDSKKRLDKVVEDSKDLVRRVEEILKEVLERVKKLIEEVKRISMDEDVERVLRKIKELLRRVEEEVERVIRESKKLLDEVRKEDEEIKKTLRDIVREVARKVK

SEQ ID NO: 12033 - protein, 184 aa, Artificial Sequence; identical to SEQ ID NO: 12032
  Synthetic

SEQ ID NO: 12034 - protein, 179 aa, Artificial Sequence
  Synthetic
SLEETVEKALKDSKDNIKRLKERVDRVLEESRRTIEELRDRARRVREEVKKRLDELRRRGLDEDELKKVEDRVDKVVRDVEKILEELIRRSEEVVREIRKLLKDVEEFSKEVVSRLRRVDKDAVKKLIDDVRKINKELNDTVEKLARDVEEINKEVARRVEKLVRELEKIDEDVTRREK

SEQ ID NO: 12035 - protein, 179 aa, Artificial Sequence; identical to SEQ ID NO: 12034
  Synthetic

SEQ ID NO: 12036 - protein, 179 aa, Artificial Sequence
  Synthetic
SLEEKVREVLKRSEDNIRKLEDESRKVLEDSERNLRKLKKEVDDAADRVRRKIKELRERGLDERELRKVERRVEDVVRRARELLDRVRKVSKEVHDRNKKLLDDLRRTSKEVADRLRRVDARIVDKLIREVEKINRDVNEKVRTSIEDLKRINEELNERVERLIREVERILKEVEDRAR

SEQ ID NO: 12037 - protein, 179 aa, Artificial Sequence; identical to SEQ ID NO: 12036
  Synthetic

SEQ ID NO: 12038 - protein, 179 aa, Artificial Sequence
  Synthetic
SLDERVERALEKSEENLRRLKKRSEEVLEEVKEAIKELKRRSREALEDVRRVLDELRKDGLDERVLEKLREDVERVHKRNEEILEEVERRVRRVHEDNKRLLDEVRDDSDKVVKRLRRVDAKVVEELIKRVEEINTRLNEKVKKSIDDVRRIIEEVRRRVEKTIRDVERIKEEVERRRR

SEQ ID NO: 12039 - protein, 179 aa, Artificial Sequence; identical to SEQ ID NO: 12038
  Synthetic

SEQ ID NO: 12040 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 12041 - protein, 179 aa, Artificial Sequence; identical to SEQ ID NO: 12040
  Synthetic

SEQ ID NO: 12042 - protein, 179 aa, Artificial Sequence
  Synthetic
SLEDEVRDMDRKVDEALKRLRDESKKVHDDNKREIDKLRKESEDVHRENKETLDRLRERGLDERLLEEVRRRSEDLHRRNEKILREVIKVSKEIHDRNKELLDRLKERVRDVKSKLRRVDKDAVRELKRDVERIIKEVDELVKRSIEESRRITEEVARRVKETIDRSRKITKELRDRAD

SEQ ID NO: 12043 - protein, 179 aa, Artificial Sequence; identical to SEQ ID NO: 12042
  Synthetic

SEQ ID NO: 12044 - protein, 185 aa, Artificial Sequence
  Synthetic
SEIEELEERLERSTRDVEKKVRDTIRESERSTEEVARRVDESIKRLERVVEEVEERVRRIKDREEIKRLLDELRREAEEVHKTNKRLVEENNRVSEEVHRDNERLVDENDRVLEKALDDVRKRITDEEIRKRVEDVAKKVKEDTDKLRDDSRKVHERNEEESRRLEEKSERVLRRVEEILKEIER

SEQ ID NO: 12045 - protein, 185 aa, Artificial Sequence; identical to SEQ ID NO: 12044
  Synthetic

SEQ ID NO: 12046 - protein, 185 aa, Artificial Sequence
  Synthetic
SEVDRLITELRRSTKRVEEEVRRLIEDSKRSTREVAERVKESIRRVEKVVEEVKRRVDRIKDEEKIRELLRRLEEILKRAHDENEKLLEENDRVSDEVLERIEKLLKENEEVVRRVLKEVEDRITDEDIRRKIEEVVKEVKEETDRLREEAEKVVRENRKASEKLRRESEEVVERVKKKVDDTET

SEQ ID NO: 12047 - protein, 185 aa, Artificial Sequence; identical to SEQ ID NO: 12046
  Synthetic

SEQ ID NO: 12048 - protein, 185 aa, Artificial Sequence
  Synthetic
REVEEIIKELRKSTTDVAETVERLIKRSRESTKEVADRVKRLIDEVRRVVEDVERKVRRIKDREKIEKLLRELRKILREVLEEVEKLLRENEKVSRTVLKEIRRLLRENEKVVKEALDEVRKRVEDERIEKEIEDVVREMEERTKRLEKRAEEVNEENKRRSDELRKRIKKAVDEVEKRLDEIRN

SEQ ID NO: 12049 - protein, 185 aa, Artificial Sequence; identical to SEQ ID NO: 12048
  Synthetic

SEQ ID NO: 12050 - protein, 185 aa, Artificial Sequence
  Synthetic
SEVEDLIKKLEESTEEVDRRVKKLIEDSRRSTEDVDRKVKELIKDVRRVIREVEERVARIKDREKIEKLIRDLEEILRRALTEVERLLRENNRISEKVLEDVERLLRENERVVEEVLRRVEKLIKDDRIRETVERVFRKVERKTRELREEIREVDERNRRDSKRLRDEVERVARELEKKLKEIDE

SEQ ID NO: 12051 - protein, 185 aa, Artificial Sequence; identical to SEQ ID NO: 12050
  Synthetic

SEQ ID NO: 12052 - protein, 185 aa, Artificial Sequence
  Synthetic
EEVERLIRELEESTDRVAREVERLIRESRKSTEDVRRKVDKLLREVREAIKEVEERVRRTDDEREIEKLLKDLRKILEDVRREVKRLVEENNKVSEDVLREVERLLRENRRVVEEVLKRVAERVEDEEIKRKIDKVVEEVRRRTEELRERIERVNEENKEASERLERKLREMAKELDKKLKDIRR

SEQ ID NO: 12053 - protein, 185 aa, Artificial Sequence; identical to SEQ ID NO: 12052
  Synthetic

SEQ ID NO: 12054 - protein, 185 aa, Artificial Sequence
  Synthetic
KDVDELITRLEESTKRVAEEVKRLIEESRRSTERVAREVRRSIEEVKRVIREVEEKVRRIRERERIEELIRRLRKELKKVHDRNKKLLDENNKVSEDVLREIRKLLRENDEVVKEVLDRVRKRITDKDIERKIREVVEKVERDTRRLEEEAKKVNEENEKASRDLEKESKDAADTLEKKLRDIER

SEQ ID NO: 12055 - protein, 185 aa, Artificial Sequence; identical to SEQ ID NO: 12054
  Synthetic

SEQ ID NO: 12056 - protein, 185 aa, Artificial Sequence
  Synthetic
DEVEDLIRRLEESTKDVAKKVDDTIDESRKSTKDVAEAVKRSIDEVRRVVREVEERVRRIEDRKTIEELLDRLRKILEDAHRTNKRLVEENNKVSREVHETNKRLVTENEKVVRTVLREVEKKITDDRIRDEIRKVVERAKERTKELEDKSKEVNDRNRETSERLKKESEDVVREVKKELDRIRK

SEQ ID NO: 12057 - protein, 185 aa, Artificial Sequence; identical to SEQ ID NO: 12056
  Synthetic

SEQ ID NO: 12058 - protein, 185 aa, Artificial Sequence
  Synthetic
SEIDKVETEVKKLDKELEELVKRSSEKTEKLDRELEKLLRDVVREVEKLLKEIEDLVRRRKESEEVVRTAKELAERLIERLEDVLRRMKKLSEDLEDHNRRVAERIRRLSKELIDILREVLKRLDKKELAERIKKVARESEETVRRLEERLERDSERSRETLRRLAEAVRRVIEKVKEILERLRT

SEQ ID NO: 12059 - protein, 185 aa, Artificial Sequence; identical to SEQ ID NO: 12058
  Synthetic

SEQ ID NO: 12060 - protein, 179 aa, Artificial Sequence
  Synthetic
DKMEEVRRTVEKLLEDLNRLSEEVIRTSEKLLEELRRLSEEVERDTERLLKELEKMKRDGESEEKVERVLEEIERLHRETVERIRKVLKDIERLHRRVVTEAKKVVDELRKLAEEVRREGKASDEDIKRVLDEVKKILDDNREKNKRALDRVREEVKRLEDRNREVVRKVRKIVEDLRR

SEQ ID NO: 12061 - protein, 179 aa, Artificial Sequence; identical to SEQ ID NO: 12060
  Synthetic

SEQ ID NO: 12062 - protein, 183 aa, Artificial Sequence
  Synthetic
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 12063 - protein, 183 aa, Artificial Sequence; identical to SEQ ID NO: 12062
  Synthetic

SEQ ID NO: 12064 - protein, 183 aa, Artificial Sequence
  Synthetic
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 12065 - protein, 183 aa, Artificial Sequence; identical to SEQ ID NO: 12064
  Synthetic

SEQ ID NO: 12066 - protein, 183 aa, Artificial Sequence
  Synthetic
DVKERLDKVLEEVKRDIERNKRRNDKLLKESKRIVEENKKKNEKSLEEVKRKADDLRTKVKDEEVKKIIKKVLDEIRESVERTKELADRILEENERLVRETKKILDEVLKEIRKLIEDVKKDRKKEVVEKVEREIERLREEVNRVSKKAEEDVERTNRELNRVSDEAHKTNERLLEKVERDVK

SEQ ID NO: 12067 - protein, 183 aa, Artificial Sequence; identical to SEQ ID NO: 12066
  Synthetic

SEQ ID NO: 12068 - protein, 169 aa, Artificial Sequence
  Synthetic
SSEDKARELVRTLEEALRELEREMRKVVEDSKKTLKELEERNRRLEEELEKVLERVRDEDAKRLVRKVLKESKEVLERSRELSKRADDELKRVLEEIKKRVEEVLKKVRDKPGDDRVIEELKELLERLRERVERVIKKVKDLNEELRRRNDKVAKDLKRLLKELEDRTR

SEQ ID NO: 12069 - protein, 169 aa, Artificial Sequence; identical to SEQ ID NO: 12068
  Synthetic

SEQ ID NO: 12070 - protein, 183 aa, Artificial Sequence
  Synthetic
SIEDEIRKVLTRLRRVLEEIKRSSKEVADELKRVLEEIKRSSEENNKEVEEVLKEIEKLPTDEELVRRVRKVAKEVKDHNERSTREVKKLVERLERILERSSREVEKTVRELEKELEKVLRDGGDREVREVIERLERMLEELERHNRDVERDLRRVLEEAKRHNEESLRRSKELLKKVRDEIE

SEQ ID NO: 12071 - protein, 183 aa, Artificial Sequence; identical to SEQ ID NO: 12070
  Synthetic

SEQ ID NO: 12072 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERVREVIEKLKETLERLKREDKEVADRAEKLLREAEEHNKRSLDESRRVLEELDEEIR

SEQ ID NO: 12073 - protein, 183 aa, Artificial Sequence; identical to SEQ ID NO: 12072
  Synthetic

SEQ ID NO: 12074 - protein, 183 aa, Artificial Sequence
  Synthetic
SIEDRVRRVLEELEEVLERIKDSSRRVVEEAEDVLRKLEEENRKLERDLERVLKEIEEEPVDETLVKEVRDLVERLKEISDESVKRSARLVEELKRRLEESSERVDRMAKELKRRLEEVLRRGGERELEEVEKRLREVLRRLEKHNEDVIRDLRRLLEEAADEDRRVIKTLRDVLRELKKRIK

SEQ ID NO: 12075 - protein, 183 aa, Artificial Sequence; identical to SEQ ID NO: 12074
  Synthetic

SEQ ID NO: 12076 - protein, 183 aa, Artificial Sequence
  Synthetic
KIEEKIRRLEEDLDRVLDEIRRNSERVTKEAEEVLERLKRENEKLKKRLEEVLEEIRRRPVDERLVEEVERAVRELKKKSDESVDRSARLVEELKKRLEESSRTVETLVRKLKEDLERVLREGGERRVDKVIEDLKRVLDEARRHNEDVVRKLKEALDKLREDDDRVRRDLEKKLRDLERRIE

SEQ ID NO: 12077 - protein, 183 aa, Artificial Sequence; identical to SEQ ID NO: 12076
  Synthetic

SEQ ID NO: 12078 - protein, 183 aa, Artificial Sequence
  Synthetic
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 12079 - protein, 183 aa, Artificial Sequence; identical to SEQ ID NO: 12078
  Synthetic

SEQ ID NO: 12080 - protein, 183 aa, Artificial Sequence
  Synthetic
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGEKELEEVERRLRKVLEDLRRNNKEVVDRLKEVLERLKEHNRRSLDESRKVLRELKERIR

SEQ ID NO: 12081 - protein, 183 aa, Artificial Sequence; identical to SEQ ID NO: 12080
  Synthetic

SEQ ID NO: 12082 - protein, 183 aa, Artificial Sequence
  Synthetic
SIEDRIRELEKRLEKVLREIEEHSKKVVREAEKVLREIEENSRRNNKRLEEVLDEIRKRPVDETLVREVEEAVRRLKKHNKDSSDTARKLVEELKKELKESSDRVRKVVEELKDRLRKVLEKGGEEDVRKVIRDLEDALRRLKEDNEDVVRRLKEVLKELRKHNKRSLDESEKVLRELRERIR

SEQ ID NO: 12083 - protein, 183 aa, Artificial Sequence; identical to SEQ ID NO: 12082
  Synthetic

SEQ ID NO: 12084 - protein, 183 aa, Artificial Sequence
  Synthetic
SIEDEVRKLAKDLDDVLREIEENSKRVLEKLDEMLERIREHSERVVERAKRVLDEIRKQPIDESLVRRVETVVRELKKRLRESTERVRTEVEKLKRLLEESSKEVKRVVEELKEELKDVLRRGGERELRTVIRKLKEVLDRLREHNKRVVEELEEALKELEKDNRKVVEDLERMLEELKREVN

SEQ ID NO: 12085 - protein, 183 aa, Artificial Sequence; identical to SEQ ID NO: 12084
  Synthetic

SEQ ID NO: 12086 - protein, 183 aa, Artificial Sequence
  Synthetic
SIEEEIEKVKKRLEDVLREIKKHSEEVKKKAEDVLRKIEKHSRDNNRKAEEVLKDIARLPVDERDLKRVAEVVDRLKKHNKKSTDDARKLVKELLERLDRSSETAERVVRRLKEKLDKVLKDGGEEEVRKVIEELEELLERLRRNNEEVVRDLERVLEELKRDNEKSVEDSERLLTELKREIE

SEQ ID NO: 12087 - protein, 183 aa, Artificial Sequence; identical to SEQ ID NO: 12086
  Synthetic

SEQ ID NO: 12088 - protein, 184 aa, Artificial Sequence
  Synthetic
SVKEELDDLERKVDEDVRRIRRELDEVLKESRENVKRSKDHLDEVLRRVEEAVKRLIRERGETSELAELVREVLKRVKELLRRVVEITKDVLRRSEELIRELKKELDDVRRRIKELVDRVAEDPDKEKVDRAKKEIEDLLREVRKRVEDVAREIKRLNEDVNRINDKVTREIEKLLEDVDRKVK

SEQ ID NO: 12089 - protein, 184 aa, Artificial Sequence; identical to SEQ ID NO: 12088
  Synthetic

SEQ ID NO: 12090 - protein, 184 aa, Artificial Sequence
  Synthetic
SVEDKLRELEKRVRDVHRKNEEDLDRLLRKSHEMHKRNEDELRKVLEEVRDAVRKLLKEKGETSELAEELRRVLEEVERVIREALKISEEVNRRNEELLKRLKEESRRVLEEVKRMLEKVRDKPDDEEVERVIKRIDDLLKEVHKILREVIRRIEKSLEEVHKRVRDLVREIKELLKEVDRKAK

SEQ ID NO: 12091 - protein, 184 aa, Artificial Sequence; identical to SEQ ID NO: 12090
  Synthetic

SEQ ID NO: 12092 - protein, 182 aa, Artificial Sequence
  Synthetic
SLEDKVRELERKSRENIKRNEEELRRAKRESEENIKRNEEELKRNKERSDRMIEKIRRETDDERVKKILKDLARRSEELLRRSKEILEELRELSERIVKESTDILRELLELVKEVAKRLRRVDKDVVERLREALEDANRRVNERNRELIKRLKEANKKVNEENEDLLRESEEILRRVEEEVR

SEQ ID NO: 12093 - protein, 182 aa, Artificial Sequence; identical to SEQ ID NO: 12092
  Synthetic

SEQ ID NO: 12094 - protein, 182 aa, Artificial Sequence
  Synthetic
SIEELVKDAKRRSKENADRNREKLRKVEDDSRRNIEENERRLEENEKRSREVIKELADRTDEERVRELLRRLLELSKRIADESRKILEDLLRRVKEVIRESERIIREVEEVVKEVLTRLSRVSEDVVEKLIRELEEINREVNKRNDDLIRELREINKKVNEENKRLMKESDDILKEVRERVR

SEQ ID NO: 12095 - protein, 182 aa, Artificial Sequence; identical to SEQ ID NO: 12094
  Synthetic

SEQ ID NO: 12096 - protein, 182 aa, Artificial Sequence
  Synthetic
SIEDLVRELKKKVDEVAEDLRRKVREALERSRENIDRLKKHSEENLRRSEEVVDKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 12097 - protein, 182 aa, Artificial Sequence; identical to SEQ ID NO: 12096
  Synthetic

SEQ ID NO: 12098 - protein, 182 aa, Artificial Sequence
  Synthetic
SLDEKVEELRREVDEAIKDIKEKVKRANEESERNIRELEERVKRNLEKSKKAIEELARRVDDERVEKILREVLKRSKEIVDTIRKILEDVKRFSDKVVEEIDEILRELKRRVEEVLRRLRRVDEKVVEKLRKEVKEVLKEVEDRVRKLIREVERINEEVNRRVKELLEESEKILDDVDKRVK

SEQ ID NO: 12099 - protein, 182 aa, Artificial Sequence; identical to SEQ ID NO: 12098
  Synthetic

SEQ ID NO: 12100 - protein, 188 aa, Artificial Sequence
  Synthetic
EVEERVKELEKEVEEVLKESEDHVRKSEEDLRRALEESRKHIEDLERKLKKVLEELERKVKEEDMKREVRRALEEIDRVIKKVKRDSERLVKRVEKSIEDTRKVVEDANREVKRIVDEVKEVVRRNDKSKDLLKKLEEEIRKIITENRKLNRDLHRENERIIRDVRRENKRLADELEEIIKEVRERLK

SEQ ID NO: 12101 - protein, 188 aa, Artificial Sequence; identical to SEQ ID NO: 12100
  Synthetic

SEQ ID NO: 12102 - protein, 188 aa, Artificial Sequence
  Synthetic
SVEEKVEELEKEVRKALEDSKRHVDESEKRARDLARRSRELVRRWEEEVEKIVRELETRVKEDEMREKVKRIIKRIRDVVKKLRDLSEEVIKELERSVEESRKAVKDLNDRLREVIKEVKKVVRDKRDMEDLLRKLADEIRRILEDNRDLNRRLNEKNKEVLDRLEELNKTLADELRDIIRKLEKELE

SEQ ID NO: 12103 - protein, 188 aa, Artificial Sequence; identical to SEQ ID NO: 12102
  Synthetic

SEQ ID NO: 12104 - protein, 182 aa, Artificial Sequence
  Synthetic
KELEDVVRKIEEDLRRLEESNEKVHRENEEIIRRVDETNKKVMKEIKEMEKKVRDLVRERKEKEEVVREIEKLAREVLEKLDKVNKENEELARESVKELRRVLKENEDRVRELAKELRRVAREKNRGGEVERVIERLEKVVRDSAANVERSIRELERVVEESSKHVEDVKRELKKVVDEIRT

SEQ ID NO: 12105 - protein, 182 aa, Artificial Sequence; identical to SEQ ID NO: 12104
  Synthetic

SEQ ID NO: 12106 - protein, 182 aa, Artificial Sequence
  Synthetic
SDLDRVREEAERVVETVRRSNKEVKKKLDRELKRLRDSNKDVVDKIKRVLEKLRELIKRRKEKEEVVDTVRKLVEEVRRKLDEVLKRNRELIRRLLEELDKVNKRNKELAEEVVRKLEKVARERNVGGEIEEVRDKLRKVVEESSKHAEEVKRDLERVVEESTRNVDRVREDLKRVLDEIET

SEQ ID NO: 12107 - protein, 182 aa, Artificial Sequence; identical to SEQ ID NO: 12106
  Synthetic

SEQ ID NO: 12108 - protein, 182 aa, Artificial Sequence
  Synthetic
SLRERIEELKEELRRVLEELERRHRETEKKLEEVLKELKRRHEELVRRLRKALKEIKDKLKDKDVVRKVEKLAKELEEENKRVVETVAELIERLKDLNRRVVEEVRKLIKEIEDKLEEVKELDEEAIKDVERKVKKLLKELRDLSEKVRKESDDLLRRLRRESERVERETRKLEKELRDEVR

SEQ ID NO: 12109 - protein, 182 aa, Artificial Sequence; identical to SEQ ID NO: 12108
  Synthetic

SEQ ID NO: 12110 - protein, 179 aa, Artificial Sequence
  Synthetic
SKADEVRKKVDDINKRLRETTDRVAEETKKLIEELKKSAEEVKREVDKINKDLRKLAEDGRSEEEVKRLSERTEKLLEENNKRSEEVVRRIRELHERDLTTVRRLSEETKRLLKEVADEGKISEKDVERLTRKSEKVVREIEKKNEELKRELTEVLKDDERRNKELVEDSRRVLEEIRT

SEQ ID NO: 12111 - protein, 179 aa, Artificial Sequence; identical to SEQ ID NO: 12110
  Synthetic

SEQ ID NO: 12112 - protein, 179 aa, Artificial Sequence
  Synthetic
DKARDVARKVEELLERLRELSERVSRTSEDLNRKLKKISEDVSRTSKKLLDELRRAKEKGEDRKRVEEVVRRIDELNKRAVEIVRKLSRDTEKLNEDAVRDVRRVVEEIKKLLEDVARDGKIREEDVRRLKERVKKVMEELERRHERDKEKSRRVVEKLERDHREDLKRVKKVLEEITK

SEQ ID NO: 12113 - protein, 179 aa, Artificial Sequence; identical to SEQ ID NO: 12112
  Synthetic

SEQ ID NO: 12114 - protein, 179 aa, Artificial Sequence
  Synthetic
SKADKVEEEVKELLKRAKALSDRVSEESRRLLKELRDSARRVEEEVKRLEEELRKLKEDGKSEEEVRKVVEEIRELLTRNNKTSEEVVRRIRKLNDDAVKEVTEVVKEIEKLLREVAREGKISEEKVRRVLREVREMLKDLEKKHRDDIKRVTEVLKEDEEKNRDLMRKVDKFLEDIRK

SEQ ID NO: 12115 - protein, 179 aa, Artificial Sequence; identical to SEQ ID NO: 12114
  Synthetic

SEQ ID NO: 12116 - protein, 179 aa, Artificial Sequence
  Synthetic
SKAEEVEELVKKLLAEVKKSLDDVRRTVEKLLREVRKSLREVEETVKRLLKRLKDLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 12117 - protein, 179 aa, Artificial Sequence; identical to SEQ ID NO: 12116
  Synthetic

SEQ ID NO: 12118 - protein, 183 aa, Artificial Sequence
  Synthetic
DELEELIRRIEKLIRDSRKITDDVRKEIEKTIRESREINKEVHERNRKLLEEITEVVKRDGGEAEEVVKIVRDVLRRIKESNEEVLRLTEEVHKTNERLLREVLRVTREVLKEIKKRVERVKDRGAREEDLRRVDDRVRRVVEESEERLRRVYEESRKVVEESRKHLKEDLDRVKRTVEEIER

SEQ ID NO: 12119 - protein, 183 aa, Artificial Sequence; identical to SEQ ID NO: 12118
  Synthetic

SEQ ID NO: 12120 - protein, 183 aa, Artificial Sequence
  Synthetic
SELERVEEEIKKLIRTSREINKEVAKRIEETIKESRDINKEVVDRIRELIERLREVVKRDGGETRRVVEIADEVLKTIRDLLRRVKEITDKLHEDNERLLRRVEEVSKKVLDDIKRLIEDLRRRGVDEKELKRVEDEVRKVVEESKDHLRKVYEKSKKVVEESKEHLDRVLREVEKEIEEIRR

SEQ ID NO: 12121 - protein, 183 aa, Artificial Sequence; identical to SEQ ID NO: 12120
  Synthetic

SEQ ID NO: 12122 - protein, 183 aa, Artificial Sequence
  Synthetic
SELERVEEEIKRLIDESERINRKVVKEIEDTIRTSEEINREAHRRNRELIKRVEDVVRTKGGEDEEVVRIVRKVLEEVKKSNTDVKRVTKTVHDDNRRLLEEVKRVSEEVLKTIKRLVEDLRRKGVDEKELRRVEEEVRKVVRDSERHLDEVYKRSKEAVDRSKKHLDKDVEEIDRVVKEIER

SEQ ID NO: 12123 - protein, 183 aa, Artificial Sequence; identical to SEQ ID NO: 12122
  Synthetic

SEQ ID NO: 12124 - protein, 183 aa, Artificial Sequence
  Synthetic
RELEEVKKEIDRLIREVEEVNKDVVRKIKETIRRSREINKRVVDEIRRLIKELDDVVKTKGGESEEVVRIADEILERIKKLIEEVKEVTRRIHETNKRLLEEVKELTDEVLKTIRELVEDARRRGVDERELRKVLEKVERVVKKSRDHLDRVYEDSERVVRESEKHLDEVLERVREEIERIRK

SEQ ID NO: 12125 - protein, 183 aa, Artificial Sequence; identical to SEQ ID NO: 12124
  Synthetic

SEQ ID NO: 12126 - protein, 183 aa, Artificial Sequence
  Synthetic
RELEEAEKTIEKLIKESRDINEKVARDIDKTIREIREEMKRVEEEIRDLIRRIREVVKRDGGESERVVREVRRILEEIKKLLEELEKRVEEIHERNKRLLDTVLRVSEKVVEDIRRLVEEVRRRGADERKLREVTKRVDKVLEESRRHLEEVYRKSKEVVDEIRKRLREVLKRVREDVERIER

SEQ ID NO: 12127 - protein, 183 aa, Artificial Sequence; identical to SEQ ID NO: 12126
  Synthetic

SEQ ID NO: 12128 - protein, 183 aa, Artificial Sequence
  Synthetic
SELDEVAKRIKELIKESRRINEEVERRIKKTIDEVRKINKEAAKTVDDLIKTIRDVVRRKGGETKEVREIVDEILERIRELVKEVKRFTDEVHERNRELLRRVVEVSEEILRRIEKLLREARERGVDEKKLRDLEEEVRRVVEESKDHLRKVYERSRKVVEESRKHLDEVLTRVDKVVKDIRT

SEQ ID NO: 12129 - protein, 183 aa, Artificial Sequence; identical to SEQ ID NO: 12128
  Synthetic

SEQ ID NO: 12130 - protein, 185 aa, Artificial Sequence
  Synthetic
SELEEAEKKIERLIEEVRKMNKTVHEENERLIEDLRRVVKEAHERNKRLIEELEDVVRKISDKETVTRIVEEVVRRVRKTVEDVRRIVDEVLKKVKDTVDRVKRITDEMLRKVKELVDDVRRKVDDKDVEKKLKDVLDKVRKVVEESRRHLEESLDKVRRVAEEIRKRLKESKDRVDEAAKEIRR

SEQ ID NO: 12131 - protein, 185 aa, Artificial Sequence; identical to SEQ ID NO: 12130
  Synthetic

SEQ ID NO: 12132 - protein, 185 aa, Artificial Sequence
  Synthetic
DELEEAEKRIKELIDRLEEFNEEVHRRNEKLIRELREVLKRVEEEIRRLIKELRDEVRKISDKDTVEDIVRKVLETVKELIKEVKKIVDDVLREVRKTVRKVKEITDDMLRRVRKLIEEVRKRTRDKRVEERLERVLREVEEVVKRSRKHLEDSLREVEKAVKEIRDRLDEVLRRVEKAVEEIRT

SEQ ID NO: 12133 - protein, 185 aa, Artificial Sequence; identical to SEQ ID NO: 12132
  Synthetic

SEQ ID NO: 12134 - protein, 185 aa, Artificial Sequence
  Synthetic
SELEDAERKVKELIDRLREVNRKVHEDNKRLIDELRDVNRKVAEEVRRLIEELKEVARRVDDKETVVRIVDEVLKRVEELIEKVKRISDRVLEEVKRTVDEVKRITDKVLEDVKRLIDDVKRKTRDKRVRDRLKEVEDRVRKVVEDSRRHLEKSLREVEEVIRESREHLEEVLRRVKEEADKIRK

SEQ ID NO: 12135 - protein, 185 aa, Artificial Sequence; identical to SEQ ID NO: 12134
  Synthetic

SEQ ID NO: 12136 - protein, 185 aa, Artificial Sequence
  Synthetic
SELEKVREDIKRLIEDLRRANDRVRRESERLNRELREVNKRVHDDNRRLIEELRRLVKDIKDKETVRRIVDEVLKEVRKTVETVKRISKEVLERSRKLIEEVKEITKRALEEVEELVRDVERKTRDERVRDELRKLLRTVEKVVEESKKHLKEVLDRSREVVEESKTHLEKSLTDVEKVVREIRT

SEQ ID NO: 12137 - protein, 185 aa, Artificial Sequence; identical to SEQ ID NO: 12136
  Synthetic

SEQ ID NO: 12138 - protein, 185 aa, Artificial Sequence
  Synthetic
STLDEAVKRIDELIKRLREVNEEVARRSKRLNDELKKVNEDVARKIEELIRRLRDVVRKISDKETVDRIVDKALEDVKKLIEDVKRISDKVLEDSKRLIEEVKRITDRVLEEVERLIREVKKETRDKRVEEELERVLRKVEKVVKESRDHLEEVLRRSEDMARRSREHLEELLKRVEKVVREIRT

SEQ ID NO: 12139 - protein, 185 aa, Artificial Sequence; identical to SEQ ID NO: 12138
  Synthetic

SEQ ID NO: 12140 - protein, 185 aa, Artificial Sequence
  Synthetic
SELEEAIRRIEKLIRELREVNKRVAEEVKKSNEESKEVNKRVKDDVKELIERLRDIVKKVKDKDTVEEIVKEVLKRVKELIDEVRRISDEDLKTSKRLIDEVKRITDEMLERVRRLVEDVRRKTRDKDVEDKLREVLRRVEKVAEESRRHLEKVARESEEVVKRSRKHLEEVEREVKKVIDEIRK

SEQ ID NO: 12141 - protein, 185 aa, Artificial Sequence; identical to SEQ ID NO: 12140
  Synthetic

SEQ ID NO: 12142 - protein, 185 aa, Artificial Sequence
  Synthetic
RTLEEVEKEVEKLIEDLRRVNREVAERIKKSNEDSKRVVERVEDEIRRLIEELKDMVRKVSDKETVVRIVDEALERVEELIRRVKKIVDDDLRRSKELIDRVKEITDRMLETVKRLIDEVRAETRDERVDKRLRDVLRKVKKVAEESRKHLEELAERSKEVVERIRRRLEEVLKRVREEAEKIRK

SEQ ID NO: 12143 - protein, 185 aa, Artificial Sequence; identical to SEQ ID NO: 12142
  Synthetic

SEQ ID NO: 12144 - protein, 185 aa, Artificial Sequence
  Synthetic
SELEDAERRIERLIRELRKANEEVARRIEKSNEDSRRVNKKVAEEIERLIKELRDVTKDVDDKETVKRIVDEMLERVKKLITEVKEISDRDLEESRKLIREVEKISEDVLDTVRKLVEDVRRKTRDKRVEEELKRVLDEVKRVIEESKERLKKWLRDSERVVEESRRHLEELRKRVEKAVREIRT

SEQ ID NO: 12145 - protein, 185 aa, Artificial Sequence; identical to SEQ ID NO: 12144
  Synthetic

SEQ ID NO: 12146 - protein, 184 aa, Artificial Sequence
  Synthetic
RVEDEVRKMREKSEKVDREIREAVRRSLTRIKEVVDEIRDEVRRSEDKVKKEIDRLRKEGADEKALKELLDRVKRSVEEVERVVEEVLRRVEESARDVERVVTENHRISKELVEDVRRKVSREEVDKLLDEVRREADESNTRLRERVKEVNKRNEEVIEELRKRVEEVHRTNEDLIRELRKKTT

SEQ ID NO: 12147 - protein, 184 aa, Artificial Sequence; identical to SEQ ID NO: 12146
  Synthetic

SEQ ID NO: 12148 - protein, 178 aa, Artificial Sequence
  Synthetic
REEEELERVKRRSEKVDEEIKKRLREVAEEVKRSNEEVKKRLEEVLRDSKRKLDELREEGADEKAVEENERTVRTVARRVEKVVRENEKTLREAERAVEEVLDRNRKTVEDVERLLKRREKDVRELIRELEESNKRVKDVLRKLIEEVKKSDDELREIVKRLVEEVERSNKELEDRVR

SEQ ID NO: 12149 - protein, 178 aa, Artificial Sequence; identical to SEQ ID NO: 12148
  Synthetic

SEQ ID NO: 12150 - protein, 178 aa, Artificial Sequence
  Synthetic
REEERLKKLKEDSDRVDREIERKAEKVLEESEEVDRDIERKLREVERKSREVLEELKKRGADKDAVKRNEETVRRVVEEVRKVLDENTRSVEKVLEEAKRVVEENKKTVDRVDKVVRRRDKDLEELRKEVEKSNTDLEKIIEDLIRRLKKSNEDVRRTVTELVKEVDRSNKKLEDEVR

SEQ ID NO: 12151 - protein, 178 aa, Artificial Sequence; identical to SEQ ID NO: 12150
  Synthetic

SEQ ID NO: 12152 - protein, 178 aa, Artificial Sequence
  Synthetic
REEEELEKLRERSERVDDEIRKRLREALERSREVDEELRRRAEESKKESDEVIKDLARRGADRKALEENRETVRESLERMRRVVDENTKSVEDVFKAVEDVLRRNKRTVDEVRKVVERREKDLDELRREVEKSNEDVRRFLEKLVRDLEESNRRVRERIKRLHEENKKSNDELRKRTK

SEQ ID NO: 12153 - protein, 178 aa, Artificial Sequence; identical to SEQ ID NO: 12152
  Synthetic

SEQ ID NO: 12154 - protein, 181 aa, Artificial Sequence
  Synthetic
SELEELKKKSKKLNDDIERVVEEVLKRSEDINERVKKEVKDVIDRNTDVLRRVKRDVEREDKSRELIRRLIEEIKKTTKELEDRVRELVKESEESVRRIEKLIRELIKESEKVVEEVKRTVSKGKEEAVRKVEKENRESVEKLKKAVKEVRDRNRKVIEELKDLVRRSRDKSKKVVDELRK

SEQ ID NO: 12155 - protein, 181 aa, Artificial Sequence; identical to SEQ ID NO: 12154
  Synthetic

SEQ ID NO: 12156 - protein, 181 aa, Artificial Sequence
  Synthetic
REVDKARKDVDDILKRVTEAVDRMDRDNERVLREVEETIRKLEEDSRRINKDIEDAVRKEDKSRELIKKLIEESKRSVDELRKVITRLERRIERTTKELKKLVEKLIRELKKVVEDAIRKVSKGSRKDVEDVRRKVEEVVRRMEKRLRESEKKSRDVVRKLRKVIEDVERDNDRVVKELEK

SEQ ID NO: 12157 - protein, 181 aa, Artificial Sequence; identical to SEQ ID NO: 12156
  Synthetic

SEQ ID NO: 12158 - protein, 181 aa, Artificial Sequence
  Synthetic
SELEEMRRRIERLAEEVRTTVEEVVRRSEELNKEVEKAVRKVVDENRRVLEEVKEEVRKEKDSRELIERLIRRIEETTKKLEDLVRKLVKELRDSVEEIRKLIEDLIRRLKKVVREAKETVSKGKKEEVKRVEERVERVVEELRRLVEEVRKRNEDSIEKLKDLVRRSKEESERVVKELED

SEQ ID NO: 12159 - protein, 181 aa, Artificial Sequence; identical to SEQ ID NO: 12158
  Synthetic

SEQ ID NO: 12160 - protein, 181 aa, Artificial Sequence
  Synthetic
SDLERVRKESEDLNRRIKTEVRRVLEELKELLKRIKEEVEELVRRNEEVLKRVREEVTKRREARELIRDLIKKIRDTTEELRRVVERLVEEIKKVLRDLKKLIEDLIRESKKVVREILERVSKGKEEAVRKVKEDNDRSVEELKELVKDVERKLREAIKELEDLIRRSEEKSREVVERLRR

SEQ ID NO: 12161 - protein, 181 aa, Artificial Sequence; identical to SEQ ID NO: 12160
  Synthetic

SEQ ID NO: 12162 - protein, 183 aa, Artificial Sequence
  Synthetic
SLEEEVRRVKKELRRVLEKSTKLIEEVTRELETVLRESRDRVRRAKEELKEAVREVRRDVGEGEKLRDAERVVEDLLRELDDSLRKTEEMVKELKKKLDKSNKTTADLVRELLKRLDKVLKDGGEEEVRKVVEDVERVLRELEKHDRDVAEEVRRVLDELRKHDEDVRRKLRKVLEELKEKIK

SEQ ID NO: 12163 - protein, 183 aa, Artificial Sequence; identical to SEQ ID NO: 12162
  Synthetic

SEQ ID NO: 12164 - protein, 183 aa, Artificial Sequence
  Synthetic
SIEDRVRRVEKELREVERKSTETVKRVEEELEEVVRRSRELVERVKERLKKMVEEVKRDTGEGEKLKRAEEMVRRLLRELEESNKKTKTLVDRLLEELRDSNKKTRDLVRELLKKARDVLRRGGEKELEDVERDVRRVLKEAEDNDRRVVERVRRVLKEAEKHDRDVVRRVDEVLKRLKEEIR

SEQ ID NO: 12165 - protein, 183 aa, Artificial Sequence; identical to SEQ ID NO: 12164
  Synthetic

SEQ ID NO: 12166 - protein, 183 aa, Artificial Sequence
  Synthetic
SIEEAVERVAKRLEEALRRSTEEVKRVKEETRESVERSRREVEKVEKELREVVERVRRERGEGEDLKRAEDVVRELLKLLRESLKRSEELARDSVRKLDKSNTDTERLVRELLKRARDVLREGGDDRLRKVVEELETVLDELRKNDRRVIEEVRRINDELRRRDEEVIKRVRDMLKKLTEEIK

SEQ ID NO: 12167 - protein, 183 aa, Artificial Sequence; identical to SEQ ID NO: 12166
  Synthetic

SEQ ID NO: 12168 - protein, 179 aa, Artificial Sequence
  Synthetic
SLEDKLRENKRRSEAVVEEAERRLRKNEEDSRKVVRELEDKLRRLREESKEMADRLRRKGADERVVRKVNKDSEDIIRELERLVREVERVSEELIRRIEEIVTRVLRVSEEILRRLKRVDDKVVEKLLKESKEILDRARETVKRILDDSERILRELRRRVEKLIKESRDILRKVDEDER

SEQ ID NO: 12169 - protein, 179 aa, Artificial Sequence; identical to SEQ ID NO: 12168
  Synthetic

SEQ ID NO: 12170 - protein, 181 aa, Artificial Sequence
  Synthetic
KAEEILEDIKRAVEEALRKLEESVRRNKERIREAVERLRETVKEAKERVDEVKRELEEKGVDRSLIRRVEEVVKRVLDINRRLIEEVEDVVKKSEEINADLIREVRTVVTDVERIIRENGELEEVLRKVREDLERIIRRVEEESKKSHKDSEDVLRRVEERSKKSLEELEDIIKKVKEEAD

SEQ ID NO: 12171 - protein, 181 aa, Artificial Sequence; identical to SEQ ID NO: 12170
  Synthetic

SEQ ID NO: 12172 - protein, 181 aa, Artificial Sequence
  Synthetic
DMEKIVRDVEDRVREVEDRLRRIAERNKREIERVVEELKKTVKEIEDKVREVVKRLEEKGIDESLRERVEKVVRDVVRENEELIKEVEDAVRESLKIVKDLIDEVRRVVAEVERIIRENGELEEVLRKVVTDLERILRRVLEDAKRVHEESKRRLDDVRRRSEDSVRRLEEELKRVEEEVD

SEQ ID NO: 12173 - protein, 181 aa, Artificial Sequence; identical to SEQ ID NO: 12172
  Synthetic

SEQ ID NO: 12174 - protein, 181 aa, Artificial Sequence
  Synthetic
DAEKILEDIKREVDEVLKRLRDIIRRNEEEIRRAVEDLKRIADEDREAIKRVIDELRKKGVPEELLKEVKDVVDESLRRIEKLIEDVKRAVAESVRRAEKLIRDVERVVKRVEDIIRKNGEAEEALRKVVEELRKILRDVTEVAKKVHRDSEEVLKKVREDVRKVHEDSKRVLDKVDKDAN

SEQ ID NO: 12175 - protein, 181 aa, Artificial Sequence; identical to SEQ ID NO: 12174
  Synthetic

SEQ ID NO: 12176 - protein, 176 aa, Artificial Sequence
  Synthetic
SRLEEVLRRHEELNERVERTVKKVHDDSKELIDRIRKDVEKVVRELEKVIDEVEKNSRDKDLVREMIKRIEDVLRRLEDRVRKLAEKIDRVLEESRRLVEELAKRSRESLKRLVDTIGKESEKVEEIERHARKVERRLEEIVDRNRKSVDKAKKELEKIVRDVRRRVEEVVDRLRK

SEQ ID NO: 12177 - protein, 176 aa, Artificial Sequence; identical to SEQ ID NO: 12176
  Synthetic

SEQ ID NO: 12178 - protein, 176 aa, Artificial Sequence
  Synthetic
DEVRRVLEELRRLLDEVRERVRRVVEEHKRLNDRIRREVERAHEENKRVDDDLRRKVRTRELVKEVIERSKEVLERTEKLVRDLARDSDRSVEEARKRVEELMREIDDVLEKLVRTIGKDSKDVKEVKKEVERVKEELRRLVEELRKHAEKVKEELKRIVDRDRETNERTVEELKK

SEQ ID NO: 12179 - protein, 176 aa, Artificial Sequence; identical to SEQ ID NO: 12178
  Synthetic

SEQ ID NO: 12180 - protein, 176 aa, Artificial Sequence
  Synthetic
SEAEDVLRKLERLLEEVRERVADAHRRSKELLDRVDKEVKRVNEENRKLDDDIRKKVRDKDLVRKAIEDSKTVLEKTKRLVEDLMRKIDRVLEESAKVVEKLREEIEKVLRELLETVGEDNDEARKVREKVKKVEEELRRIVEEDRKEVEKVKRKLEKDVREDEKENRKTVRELEQ

SEQ ID NO: 12181 - protein, 176 aa, Artificial Sequence; identical to SEQ ID NO: 12180
  Synthetic

SEQ ID NO: 12182 - protein, 185 aa, Artificial Sequence
  Synthetic
TLEELLEEIRRKVEEVLKKLEDLLRRDHEEVKKVEEELEEINKRSEDRVRKAVRRLERDAKDDKETVKRVKKKLEEVVRKDHDVVRDIKRRLKESNDKSERVMREIKKRLKEVLDEVKKVVDDGVGEEAIRKVLRKLEEEAKRLEKRIEEVLKESKDRIDELRKRIEESHKDLERIIEELERRIK

SEQ ID NO: 12183 - protein, 185 aa, Artificial Sequence; identical to SEQ ID NO: 12182
  Synthetic

SEQ ID NO: 12184 - protein, 185 aa, Artificial Sequence
  Synthetic
RLEELLERIRKRVEEVKRESERLLKEDHDRVEEAKKRSEDINRRSKEEVDRMLRELETKAKDDEKVVREVKELLKRVVEKDHDLSRRSVELLDTSNKKSKDLSEESKKELDEAVKEVETIVRNNVGEEAIRRVLKKLEEIAKRLLDENRRVLEESKKIIDKLEEDNRRSHRELKRILDELRKRIK

SEQ ID NO: 12185 - protein, 185 aa, Artificial Sequence; identical to SEQ ID NO: 12184
  Synthetic

SEQ ID NO: 12186 - protein, 181 aa, Artificial Sequence
  Synthetic
KEAEDLEKKVEDILRRVRELLEELHRRSEKILKDVKDRSRDLLRRVREILKRVEEKKERVREDELDKILKEVTERVKRVLEESEELLRRVEKVVKDINKRAEEILERVRKVVEDVLDDMRKKGVDERLVREVEKKLRTVEEEVRRIVKENKERLDEAREDVKRSNKTIRDELERARERIET

SEQ ID NO: 12187 - protein, 181 aa, Artificial Sequence; identical to SEQ ID NO: 12186
  Synthetic

SEQ ID NO: 12188 - protein, 181 aa, Artificial Sequence
  Synthetic
SEAEDLTRRVREILKRVEDLSKKLNDDTKKILDELRELSKRLMEEVKKILRRVEEKKERVSEDELRRILEDVRRRVEEVVKTSERLLRRVEKASKDSVETSRRLLERLREFVRRVLEEARRRGVDKRLVDTVREELERVRKKVEDSDRRNEEELRKVKEEARRSNERIRELLKTVEDRIRT

SEQ ID NO: 12189 - protein, 181 aa, Artificial Sequence; identical to SEQ ID NO: 12188
  Synthetic

SEQ ID NO: 12190 - protein, 181 aa, Artificial Sequence
  Synthetic
DEVRKLVREVEDILRRVREKSERLVRLVEEILRRVLEESRRLLEETREILERVEEKKERVSEKELKEILEEVARVSEKTVRDSERLLDDVRRKVEEVLERSRRLLDEVRKTVEKVLEDARRRGVDERLVREVKELLDRVADEVRKSDEDIRRLLEDAARKVEESNKRNRDLLETVRRRIEK

SEQ ID NO: 12191 - protein, 181 aa, Artificial Sequence; identical to SEQ ID NO: 12190
  Synthetic

SEQ ID NO: 12192 - protein, 178 aa, Artificial Sequence
  Synthetic
SEVEKLKKEVKESSKEVIKEVEKLHRESEKSSEDVKREVEKLHRRSKEVADEVRERVRRRKDKEVIDKLADDLRRIAEETIDRVKKLVDEDREVVKDTIRRLRELADEDRRRVEDVIRKIRDERVVEEIERDVRESLRRIEEIIRRNEKRVRESLEDLKRILRENKETVRKVVDELRK

SEQ ID NO: 12193 - protein, 178 aa, Artificial Sequence; identical to SEQ ID NO: 12192
  Synthetic

SEQ ID NO: 12194 - protein, 178 aa, Artificial Sequence
  Synthetic
SEVDDLTRRVRDVLRRVEEKVRDLHRRSEKVARDVEREVEELHERSKDVARKVEEKVRRIERREDIKKLAEDLKRIVDESIKRIEELAKRLEKIVRETIKKVRELVEEVKRIVDDVIRKIRDKDVVDRIRREVEEMLRRLEDILRRNEDTVRRVKEKLKRIVKRDEEEVRKVLDRLRK

SEQ ID NO: 12195 - protein, 178 aa, Artificial Sequence; identical to SEQ ID NO: 12194
  Synthetic

SEQ ID NO: 12196 - protein, 178 aa, Artificial Sequence
  Synthetic
SEVEELKKRVEDVAEEVKDRVRKLHEKSERSSREVEKEVRKLHEESRRVAREVTERVRRIDDRDTIRELVERLKDIFRKSIEDIKRLVEEDKRRVDETIKEIKRLVDELRERVTRVIEKIRDEEVVKEIRDTVEKVLEEARKIIEDNRKRVAESVETLKDIIRRDEKTMRDVVDELRT

SEQ ID NO: 12197 - protein, 178 aa, Artificial Sequence; identical to SEQ ID NO: 12196
  Synthetic

SEQ ID NO: 12198 - protein, 178 aa, Artificial Sequence
  Synthetic
DEVEELRREVEESSRRVEKEARRLHKRSEESSREVEERLKRLHDDSRRVAREVEEIVARSEDRRVIEDVVRRLEEEVKRSIETMEELVKRDRDVVRKTIEDMERLAREDRKIIERVIKEIQDEDKVRDIKRRIDESKRKIEEIIKRDKEEAEKSEEKIKEIIERDRETVERVVRKLRE

SEQ ID NO: 12199 - protein, 178 aa, Artificial Sequence; identical to SEQ ID NO: 12198
  Synthetic

SEQ ID NO: 12200 - protein, 182 aa, Artificial Sequence
  Synthetic
EIEEIEEELKDRVRRSEEKLRRIEKELRELVEKSRKELEDLLDKDRRDMKRVADELRRDDGPDVEEALRRITEVTRKSEEEVTRLVEENKRVVEDIRRLLRELAKENKDVVREIRDLLKKVDDRRVVEELTRKLEESIKKSEDEVKKVKERLEESIRRSKERLEDARRESERVLTEIRERLR

SEQ ID NO: 12201 - protein, 182 aa, Artificial Sequence; identical to SEQ ID NO: 12200
  Synthetic

SEQ ID NO: 12202 - protein, 182 aa, Artificial Sequence
  Synthetic
EVERILDELRRRVEEVVKENEKALDTLRKESERTEEENKRLLDEAREKVDRVVKELKRDDGPDVEELLREIRTVLEDVKRRVEKSTREDKEVVKDVERLVRESSKDIRRVLKEVEEELRKTRDEKVLRDLAKKLEDVIRKSEELTKELAKRLRESSKRSIDLTRELLKRLEEVLKKVRDALR

SEQ ID NO: 12203 - protein, 182 aa, Artificial Sequence; identical to SEQ ID NO: 12202
  Synthetic

SEQ ID NO: 12204 - protein, 182 aa, Artificial Sequence
  Synthetic
SVEEIVEEIRRRSKETEDRNRRVVEELEERVRRVLEELKKIVEDARRKVEKVARELKRDDGPDVDELLKEIRDVLERVVTEVEKLLERIKKVLREIAERIKRSSERDREVVERVEKRLREVRDEKVVEELLRRLKETSDDSLRRTDELRKELERVLKEVRERLKELDRELKRVLDDVREKIR

SEQ ID NO: 12205 - protein, 182 aa, Artificial Sequence; identical to SEQ ID NO: 12204
  Synthetic

SEQ ID NO: 12206 - protein, 183 aa, Artificial Sequence
  Synthetic
KLEDILRKIEKELKEVKEKSERIVREIEKRHEDDKRRVEDIVRRIKEEVERVVKEIKEAPVPEEVIRDLIRLLEEVLREVDEVLKRVRDLNRRVVEEVRKVSEENEKLLRELLRRVREVLRANRDEVMKKVEKEVRDVIKELEDTAREVEKKSEKVLKETNDLAKEVMDKVRKVAEDLRKKLE

SEQ ID NO: 12207 - protein, 183 aa, Artificial Sequence; identical to SEQ ID NO: 12206
  Synthetic

SEQ ID NO: 12208 - protein, 183 aa, Artificial Sequence
  Synthetic
ELEEIVRRIEEEVRRADKEVKEILTEIEKEHRRDVERSDRSLEKIKRDVDRALEEVERVPVDEKVIRRIEKLLRDVLEKVKRVSERVKELNTRAVDLVRRVVEEISELLKRVLDRVRDILKANRREVMKKVTEEVREVLDRLRELLKEVAKRSEEVIKRTNELNETVMRDVERVLRELREELR

SEQ ID NO: 12209 - protein, 183 aa, Artificial Sequence; identical to SEQ ID NO: 12208
  Synthetic

SEQ ID NO: 12210 - protein, 174 aa, Artificial Sequence
  Synthetic
SEVEKLEEDFREMIERSERTLEKLKKENEDASKKSKEKLEKLLREMKEIIDRIRDLIRKGRDITELLRRLEELLERIEEELKESIRESRKLLEDIERISRDSIRRLRELLEKAERDGADEEVIKKLRELLERLEREHRKVIEELKKSNKKNEEDIRRVLEELRRLVKKLADDAR

SEQ ID NO: 12211 - protein, 174 aa, Artificial Sequence; identical to SEQ ID NO: 12210
  Synthetic

SEQ ID NO: 12212 - protein, 174 aa, Artificial Sequence
  Synthetic
REAEELLKEMKRASEKSEKIIEDLRRENEKLSKESEDIIRKLKEDNERMIRTIEELIRAGRDIDKLKKESEKLLKEIADELERSIRESRRLLEEIEKILRKSIKELRDLLEEIERRGLEEEVIKELRELLERNEREIKKVLDELRRSNEKNERDIERALEELKRTNDELAKRAK

SEQ ID NO: 12213 - protein, 174 aa, Artificial Sequence; identical to SEQ ID NO: 12212
  Synthetic

SEQ ID NO: 12214 - protein, 174 aa, Artificial Sequence
  Synthetic
DEVEKLRREIEEIIKEWEKRTRDLKREMKKISDDSRRRIEELLRDFKRIIDELRKAIEDGRDVTDLLRELRRLLEEIERRLEESIRRLKELLDRIHEEDKRLRKELEDLLKRVEDDGLSKEVIERLRELVKRVTDKVRKVNEELRKLLEDNADEIRRAIERLRELLRRLEEEAR

SEQ ID NO: 12215 - protein, 174 aa, Artificial Sequence; identical to SEQ ID NO: 12214
  Synthetic

SEQ ID NO: 12216 - protein, 174 aa, Artificial Sequence
  Synthetic
SEVEKLVREAEKIIEDIRRVIEELLRRARKINKEWDDVSRKLKEDAKRIIDTVLKLIREGRDITELAKRLDELLREIKKINDEMLKRDRDLVDEIRRRLERLLEELRRLLEKIRADGLDKDVIERLRDLVRRVKEDIERVLDEWRKSSEEAEERSRRVIEELRRLLEELKERVR

SEQ ID NO: 12217 - protein, 174 aa, Artificial Sequence; identical to SEQ ID NO: 12216
  Synthetic

SEQ ID NO: 12218 - protein, 182 aa, Artificial Sequence
  Synthetic
SELEELKKTMDEVNKETKKENDRLLDEARKVNEESRRRLEKLRKELDDVVREVEDARRRNTDKDELLRKLREILDRVRRDVERIVKRNKEILKRVEEDLRRLNEENRRILKELEDRARKNNVRSDKVERVLRELRKSSRKVHEDSKKVVEDLERSSRTVEKELRDALKELEDKVREVEKKLK

SEQ ID NO: 12219 - protein, 182 aa, Artificial Sequence; identical to SEQ ID NO: 12218
  Synthetic

SEQ ID NO: 12220 - protein, 182 aa, Artificial Sequence
  Synthetic
DELEKLLEEARKVNEETKEANERLLREMEKVNKESEDANRKLLEELKEVVDRVDDLARRNSDRDDLLRRLEEILEDLRRKAEELNRRNKRILEEVEKRLEDLNRENERILREVEERLKKANLSSEDVKRVVDELRESSREVHRRSREVVERLRRSSEEVHKKSRDVLRELTRLVREVKERLR

SEQ ID NO: 12221 - protein, 182 aa, Artificial Sequence; identical to SEQ ID NO: 12220
  Synthetic

SEQ ID NO: 12222 - protein, 182 aa, Artificial Sequence
  Synthetic
DELETLLRELERVNKETERELERLKREAEEVNKATRKDLDELRKEIDKVVKEVEEARRRNKDKDDLLRRLRDILRRVTEKLRKLIEDNERITEKIVRELKRLVRENEEILREVKKRLDEANLESERVKKVVDELRDSSRRVKEKLEDVVRRLRDLSRRTKEEVEKVEEDLRRKVREVEERLR

SEQ ID NO: 12223 - protein, 182 aa, Artificial Sequence; identical to SEQ ID NO: 12222
  Synthetic

SEQ ID NO: 12224 - protein, 182 aa, Artificial Sequence
  Synthetic
DELETLLDEAKKVNEETRRANRELRERVREVNKRTEEELKKLRDRLEKVVDDVDKLRKRNTDTEELLRRLREILKRIEEELEELKERNRRITTRVEEELERLNRENEEITRRLTERLRRANLESRRVREVEERLKKLSEDTHRDSRRLVEEMRRLSKETEKKVEDVVRDLRRLVKEVEERVK

SEQ ID NO: 12225 - protein, 182 aa, Artificial Sequence; identical to SEQ ID NO: 12224
  Synthetic

SEQ ID NO: 12226 - protein, 182 aa, Artificial Sequence
  Synthetic
DELEKLRRELEEANRRTKKANEEILREAERVDERSEEELRKILETLKKVVKDVDDMARRNSDKDELLKRLREILKELEDRLRDIVRRNREITKDLVERLKELNRRNEEITRRLTEDLRRANLEDRRVRTVVEELKKLSRETHEDSKRVVEELERLSRESERKLREVVKEMRKLVKDVEDKVK

SEQ ID NO: 12227 - protein, 182 aa, Artificial Sequence; identical to SEQ ID NO: 12226
  Synthetic

SEQ ID NO: 12228 - protein, 182 aa, Artificial Sequence
  Synthetic
DELEELLRRVEEVDKESKRRLDEIKRRMKEVNDRTREALRDLLRRLAEVVKRVLDLIRRGSDKDRLLEDLRRILREVKEAAKELLKRNREITEKMVRDLKRIVKDNKKILDDVEKTLREANLESERVKKVVDDARDSSRKTVERLETVVRDLKRSSDDVEREVRELLKELERLVKKVEDDAK

SEQ ID NO: 12229 - protein, 182 aa, Artificial Sequence; identical to SEQ ID NO: 12228
  Synthetic

SEQ ID NO: 12230 - protein, 183 aa, Artificial Sequence
  Synthetic
RELEELLRKVRKLVEEIERELKKLLEEDRRLSEESREELRKLLEDARRMIREIEELLKRRRTEEVSTTIDKILKEVEKKVKDLERRSKKISEDSRRKAERVLREIKRILEEIEKDVERVLRERDSEDAKRVLKEIRRLAEELKKSVKRVIEEVEDSNRRNEEEVRRVLEEIRRLLEDLDRKVK

SEQ ID NO: 12231 - protein, 183 aa, Artificial Sequence; identical to SEQ ID NO: 12230
  Synthetic

SEQ ID NO: 12232 - protein, 183 aa, Artificial Sequence
  Synthetic
SELEELLKDAKRVIDTSRRLITELEKRDEEIIRRIKDLLRRVTEEAKRMLDEIREELKRRRDEEVKKRIKELMDKIREDLKRVLEEIDKLSRDSEEDVRRVLDENRKLVEEVERKVREVLRRRDSEKAKRVLEEIRKLLEDSKKESEDVARKLKKSNDELRRDVERVLREIEKRLEDLKREVE

SEQ ID NO: 12233 - protein, 183 aa, Artificial Sequence; identical to SEQ ID NO: 12232
  Synthetic

SEQ ID NO: 12234 - protein, 183 aa, Artificial Sequence
  Synthetic
SELEKLLREVEKIIRDSDDLLRRLEKRNRDLIRTSEKLLKEVKDDVDRVIRELERLLEEERSEEVARRIEELMREVEEKAKRLLKENEDISRRSREDVRRVLETNKRLLDEIRRRVKDVLDRRKSEKAEDVLRRIEKLLDDSRRRSEKVAKELEESNERSKRKTEKVLKEIKEALDRVREKVK

SEQ ID NO: 12235 - protein, 183 aa, Artificial Sequence; identical to SEQ ID NO: 12234
  Synthetic

SEQ ID NO: 12236 - protein, 179 aa, Artificial Sequence
  Synthetic
SEIEKVARDVEELLKKVEKKNRDMVERVRRLLEKVKRENEELVRRVEESNERLKERVDRSNRDERIRRDVERIVKESEDLLKESHDIVKKIIEEVDELLKESHKRVREIIERIKEMVKDGGERVEELEKTVRKLARDAEKISEDVERRVRELARRLRKISEEVLRRNKELVRRVDEEIR

SEQ ID NO: 12237 - protein, 179 aa, Artificial Sequence; identical to SEQ ID NO: 12236
  Synthetic

SEQ ID NO: 12238 - protein, 179 aa, Artificial Sequence
  Synthetic
SEVEEAVERVKKLLEKVRKDNEEFRERVRKSNEEAEERNRRVVEEVRRSNEELKEKVERSNRDERIKEKVKRIVETSEKLLRESHKTAKDIIRETEELLERSHEIVREIIERVKKLLDEGGEDVEDLKRRVKELADEARRISEKVLRDNKRLLTELDKISERVLRENEKLVREVEETIR

SEQ ID NO: 12239 - protein, 179 aa, Artificial Sequence; identical to SEQ ID NO: 12238
  Synthetic

SEQ ID NO: 12240 - protein, 179 aa, Artificial Sequence
  Synthetic
SEIEKVAREIEELLRKVAEDNRRMVERVRRLLEEVKTRNKKMVDEVKESNERLKDKVRRRNASEEIKKRVDEIVETSKELLKRSSEEVERIREEVEELLRRSHETVREVERRLKDLVRKGGERVEELKRRAERLIEELRKISEEVERRVKRLVEELEEITRRIKEENDKLVREVEKELK

SEQ ID NO: 12241 - protein, 179 aa, Artificial Sequence; identical to SEQ ID NO: 12240
  Synthetic

SEQ ID NO: 12242 - protein, 179 aa, Artificial Sequence
  Synthetic
SEVEKVVEELKDLVRKSSEKNRKVAEEVKKSNDDLRRKVEEAVREVRESNERLKREVDESNRDERIREKVERIVRESEKLLKEIEDRAREIVKTTEDLLRESHKRNKEIEEEIRDLARKGGERVEELKDRVRKLIEESERISREILKTNRKLLKELEELLKRLLKRNRELVREVKEEIK

SEQ ID NO: 12243 - protein, 179 aa, Artificial Sequence; identical to SEQ ID NO: 12242
  Synthetic

SEQ ID NO: 12244 - protein, 179 aa, Artificial Sequence
  Synthetic
SDIERVVKEVKDLLEEVRKDNERVMDEVRKLLEELKRKLRKVVEEVRRSNEELKKEVDRRNVSEEIRRKVEEIVRRSEELLKRLEDTVKDIERKVRKLLEDSHREVKKAEDRIRELLKRGGEDVETLRKEVEELADDLRRISEEVRDRVRKLVTKAEEILRRVLETNKKLLKEVKETLK

SEQ ID NO: 12245 - protein, 179 aa, Artificial Sequence; identical to SEQ ID NO: 12244
  Synthetic

SEQ ID NO: 12246 - protein, 179 aa, Artificial Sequence
  Synthetic
SEIEKVAEEIKKLLRKVEEDNKTVVEEVRRSNEKLKRDNDKVVRDVERSNRELKEELDRSNVDEEIRKKLKEIVDTSRELLRESSERLEKIVRETEKLLEDSTREVKRVVTEIKDLVRKGGERVEELKKRVEELARRAKEISDKVRDDNEKLLRELREITKRVKEENDRLLKEAKDAIK

SEQ ID NO: 12247 - protein, 179 aa, Artificial Sequence; identical to SEQ ID NO: 12246
  Synthetic

SEQ ID NO: 12248 - protein, 179 aa, Artificial Sequence
  Synthetic
KEIEDVAKRVEELLRESSREVEEVLREVEELVRRSTRRNEEAVRRVRKSNKELEDEVRRSNRSEDIKRRVKEIVEESKRLLEESSKRNRDIAEEIRKLLETIKRLNDEMVRRLKELVKKGGEDVKTLLDEAKRLVDRSRELLERLLRDVRRLIKESDKITRELERKNEKLLKEVKEEID

SEQ ID NO: 12249 - protein, 179 aa, Artificial Sequence; identical to SEQ ID NO: 12248
  Synthetic

SEQ ID NO: 12250 - protein, 179 aa, Artificial Sequence
  Synthetic
SEIEDAEREVRRLLRESSERVKTVIEEVRELLRRVKRENDEAVKEVEKSNRDLEDKVRRGNLSEEIKKKVEDIVRESEDLLRRSSERVRELVEEIKRLLEELKKRNDELVRRIEELVKKGGERVEELKERVKRLVADSERLLKELRDRVKELADEARRTTEEVLRRNRELVRRIEEDIR

SEQ ID NO: 12251 - protein, 179 aa, Artificial Sequence; identical to SEQ ID NO: 12250
  Synthetic

SEQ ID NO: 12252 - protein, 184 aa, Artificial Sequence
  Synthetic
SELDEVLKTVRKIIEENEKIVKEVLDTSRRSVEEVRKHTKEVLDRVRELAKELEDATRKTSRKEDLERLLREVADRIRKLIEENRELVDRVNKENRRLIRELEERNKRSAEDLKRLIDELRKSSQTEEVDKVAEEIEKLVRESNRKVREVVKEIEKLNRDMRKESEDAVKEIEELLRTLEEKVR

SEQ ID NO: 12253 - protein, 184 aa, Artificial Sequence; identical to SEQ ID NO: 12252
  Synthetic

SEQ ID NO: 12254 - protein, 184 aa, Artificial Sequence
  Synthetic
SELDEVLKTVEKIIRDNEEIVKEVLRRSERSIKELKKHTDDILRKARKLAEELKRVVERTEDKRELERLVRRVEKEVRDLIRENRELVKEVNDRNKKLIDELKKINDDSRKTLEELIRDLERREDDKRVKDVAERIRELVEESNRKVREVVERIKDLNRKVNKTSEDAAREIEKLLEELREEVR

SEQ ID NO: 12255 - protein, 184 aa, Artificial Sequence; identical to SEQ ID NO: 12254
  Synthetic

SEQ ID NO: 12256 - protein, 184 aa, Artificial Sequence
  Synthetic
DELEEVLKRVREIIKRNEDHSDRVREKSRESVKELEEHTERVLRDVERLARELEEMIDKTDDKRDLKRLVEEVRRRIKKLIEENRRLIEEVNRRNEELIKENEKLNRESEERIRELIEDLRRRRQDKKVDDVAREIEKLLKESNDKSRELVKEIKDLNKRLNEKSEEAVKRIEDLLRRIEERVR

SEQ ID NO: 12257 - protein, 184 aa, Artificial Sequence; identical to SEQ ID NO: 12256
  Synthetic

SEQ ID NO: 12258 - protein, 184 aa, Artificial Sequence
  Synthetic
KELEDVLERVKEIIKRNEEILDKVRREVEESVRRAEEILKEVLERVRDLVRKLDDIKDKMDDKKDLKKIVDDVKKEIEDLIKELEEIITELNKENRDLIRRLREINKRSREELEELIRDLDRRRRDEEVKRVADEIKRLADESNEKVRRVVRRIDELNKEVDRKLKEVMKEIKKELEDAERRVR

SEQ ID NO: 12259 - protein, 184 aa, Artificial Sequence; identical to SEQ ID NO: 12258
  Synthetic

SEQ ID NO: 12260 - protein, 184 aa, Artificial Sequence
  Synthetic
DELEEVLRRVRKIIEENKEIVRRVLEDVKRSVEELERHTERVLREAKRLADELEDARRKIERKEDLARLVEEVKREVTRLIKENKDKIRKVNEDNRKLIEELKKINDDSKRTIDELIRDLDRRRRDEEVKRVAKELRELLERSNREVRRVVEEIKKLNDEVRKKSEEMRRRIEKLLEELERKVK

SEQ ID NO: 12261 - protein, 184 aa, Artificial Sequence; identical to SEQ ID NO: 12260
  Synthetic

SEQ ID NO: 12262 - protein, 184 aa, Artificial Sequence
  Synthetic
SDLEEVLRRAEKLIEDLERIVRKVLEDSDRSIDEVRRHTEKVLRDVRKLAEELKDIARKTSRKEDLRRIVEEVKREVKELIKDNRRLLERVNRENEKILRELRKIVEKVKRDVERLLDALDKRSRTEEVKRVIDEIRDRLRKAEERVRKVIEDIKRKNKKLREDSEKAEREIDELLRKVEEDVK

SEQ ID NO: 12263 - protein, 184 aa, Artificial Sequence; identical to SEQ ID NO: 12262
  Synthetic

SEQ ID NO: 12264 - protein, 184 aa, Artificial Sequence
  Synthetic
SELEEVLERVKDLLKKLKEHSDRVLEESKESIDRVRKHTEEVLRTARELIERLDEMRKRTSDKKDLKDLVEKVRKTVEDLLRENEELLRRVNDRNRKLIERNRDLLRKVATTVDRLIKELDKRSRTEEVKDVAREIRRRLDELRKDSERVAEEIRRLNKKLRDESRKAIKEIEELLRRVTKKVE

SEQ ID NO: 12265 - protein, 184 aa, Artificial Sequence; identical to SEQ ID NO: 12264
  Synthetic

SEQ ID NO: 12266 - protein, 184 aa, Artificial Sequence
  Synthetic
DELEEVLERVRKLIDELRKHSKEVLDTVRDLLRRHKKKNEDSLRTVRKLLTDLEDAVRKIERKEDLRRLIEDVKRKVEKIIRDNERHLREIEEEIRKLIEENRKLIEEVIRRIEELIKELDKRERDERVKRVAEEIKKLLEDLRKESEDVVKELEDLLDELRRRTEKVVREIEELLKRLEERVK

SEQ ID NO: 12267 - protein, 184 aa, Artificial Sequence; identical to SEQ ID NO: 12266
  Synthetic

SEQ ID NO: 12268 - protein, 177 aa, Artificial Sequence
  Synthetic
SEVERVERRLEKVIEEDKERTKRVEREVEDSNKKDDDLTREVLDRVRKSARDVERKLEEGKDEELLRRVLARHEEKNKKLEDDLRESTRRNAEEIKRLKKEIKESTDRTRRELEDLERKLDSREALRRLRELVKKLEDDNRRVLRRLDKLLDDVRKKNEEAMRESRDLSRKVAEKIR

SEQ ID NO: 12269 - protein, 177 aa, Artificial Sequence; identical to SEQ ID NO: 12268
  Synthetic

SEQ ID NO: 12270 - protein, 177 aa, Artificial Sequence
  Synthetic
DEVREVEKRVRESNERDKKLLREVLEEVRRSDKDDDDRTRKVLKRVEKAAEEVKRLLEKGEDRELLERVLDKLRRFIEKLKKELKESDKENEDRIRDLKRRLEESNKRNDDTIKDLERKLRSEDVIRKLRKSLKEVKDDSRRVLKELDDSLRETHKRNRDAMRRLDELLEEVARRIK

SEQ ID NO: 12271 - protein, 177 aa, Artificial Sequence; identical to SEQ ID NO: 12270
  Synthetic

SEQ ID NO: 12272 - protein, 178 aa, Artificial Sequence
  Synthetic
DEIEEIKRRIEKSSEDDKRVLRELEARAREIRKELDERVKRLEKRIKELLERLRKLKEDNRDLTEALRDLERVLEEIKRRLEEVARELKERLDEIADESRRTVEEDRRRLEELKRRVGDDRDVRRVLEEWKRLSRKNEEENKAVIEKLRALLEDLKRRLKEVLKRIAELVKKIADELK

SEQ ID NO: 12273 - protein, 178 aa, Artificial Sequence; identical to SEQ ID NO: 12272
  Synthetic

SEQ ID NO: 12274 - protein, 179 aa, Artificial Sequence
  Synthetic
RESEELRREIEKISRENKELVRRLEEAIKRLSDEDKELVERLRRETKKIADKVEDLLEKLKDVKEVVEKLLRDLKRLNDRVERESRESIKKLRDLVKKIKEASERSEREFEKLLEEIRRRRKEAEEVLREIKKIIDDNRRENREALERIKDIVRRNEEENEKALRESRKRTRELEERLR

SEQ ID NO: 12275 - protein, 179 aa, Artificial Sequence; identical to SEQ ID NO: 12274
  Synthetic

SEQ ID NO: 12276 - protein, 177 aa, Artificial Sequence
  Synthetic
SRVETIRKRVEDLIRRSEDLIRRLEEDVKRVVDEIRKLLEKLKEDDERVIRRIEDLLRKERSEEVEREIEELSKKSLDDARRVLEEIEKLARTITKEVERVLEENDRLIRKIEDEVRKINVDERVVEEIKERLDRSRRRTEEALERIRKRLEEVKKEVEDVLREVEKTNREIKKEVR

SEQ ID NO: 12277 - protein, 177 aa, Artificial Sequence; identical to SEQ ID NO: 12276
  Synthetic

SEQ ID NO: 12278 - protein, 177 aa, Artificial Sequence
  Synthetic
SRVDELRRRVEELLKRSKELLEEIKRRDEEVLRRIKELLDRLRERVDDALRKISELLTRERSEEVARRIRELLKEIEDDVRRVKKEIEDLSEDSKRKAEELLRRNEELVKRIDEEVKRINVDEEVVREIKKKLTESREDTKRLLEELKKTNDDIRKDVERLRREVEKKVRDIERRVK

SEQ ID NO: 12279 - protein, 177 aa, Artificial Sequence; identical to SEQ ID NO: 12278
  Synthetic

SEQ ID NO: 12280 - protein, 178 aa, Artificial Sequence
  Synthetic
SEVEKLLEEVRELTKRHKEELRRLNKEMEKATRDHLRKSKKLNDEAREMVRRVEELVKNNGDKDTILKTIEDVLRELEKRHKELLDTNRELLDRLRKEHDRLLKHNREVIEDVKRRLDETERAARVKEELDKLHKDLEREVRESKRTLKELHDRLRKAVEESKEHLKRLLDELRKKVK

SEQ ID NO: 12281 - protein, 178 aa, Artificial Sequence; identical to SEQ ID NO: 12280
  Synthetic

SEQ ID NO: 12282 - protein, 178 aa, Artificial Sequence
  Synthetic
DEVERLLEEVRRVVKEIEDRSRKLNEDARRVTEDHLRKSEELNRRVEDAVRRIRELTKNNGDKDKILEDLERLVREVLKAHDELLRTNRELLEEIKRRHDELLRTAEEIIRRVEERLDETEEARKIRETLKRLLDELRKKLEESKKHLDELHDRLRRELEKSKRHLEELLKRLEDELR

SEQ ID NO: 12283 - protein, 178 aa, Artificial Sequence; identical to SEQ ID NO: 12282
  Synthetic

SEQ ID NO: 12284 - protein, 178 aa, Artificial Sequence
  Synthetic
SELERLLEKARRDTERHLRESERLNRELKKATDDHLRKSRELNKRLEEVVRRVEEESRNNGDKDELLKRLEELVRRLKEEHERLLRTNRELLRRLTEEHERLLKHNRDLLKDIRDKLEKTREAKKVEDDLRDLHRRLKEAVDRSKKHLEDLHKELEDELKRSIDHLRKLLEEVKRKLD

SEQ ID NO: 12285 - protein, 178 aa, Artificial Sequence; identical to SEQ ID NO: 12284
  Synthetic

SEQ ID NO: 12286 - protein, 178 aa, Artificial Sequence
  Synthetic
SRVEDLLRRVREVVKRVKKDLTKLLEEVKRMTDEHLKRSKELNDRAEEIVRRLKELLDRRGDKDEILRRIEEVAKRLTEEHKRLLKTNKEVLDEVRKELERLLDELREIIERVKRELDDTERAREVVERLDELLKEVADRVEEVKDRLRKLHRKLEESVKKSLEHIKRLIDDLRRKAK

SEQ ID NO: 12287 - protein, 178 aa, Artificial Sequence; identical to SEQ ID NO: 12286
  Synthetic

SEQ ID NO: 12288 - protein, 178 aa, Artificial Sequence
  Synthetic
RELEKLLEDARRVVTTLTRASEKLNEDVKKVTEEHKDRIRRLLDTVRRIVEEVDKRTKGKGDKEKLLRELEKAIRDVERKLEELLKTNEELLREVKKKHDELLRTITEVMKEIAERLKKTEEARKVKEELDRLLEDLRKKLEDSKRHLDELHRELEETVREVSERLKELLDAVRRRAK

SEQ ID NO: 12289 - protein, 178 aa, Artificial Sequence; identical to SEQ ID NO: 12288
  Synthetic

SEQ ID NO: 12290 - protein, 178 aa, Artificial Sequence
  Synthetic
SELEKLLKDVADMVREITERSKKLNDELKKLTEDHDRKIKRLNERLEEIIREVEKLVDDNGDKDRILARVEKLVEEAKRAHDDLLRTNKEMVDDLKRRHDELLRRIDEIIKDARRKLSETDEARKVAERLKELLDRLRRKLEESKRHADELHERLRKSVEDSKKHIKDLVDELKRRVD

SEQ ID NO: 12291 - protein, 178 aa, Artificial Sequence; identical to SEQ ID NO: 12290
  Synthetic

SEQ ID NO: 12292 - protein, 178 aa, Artificial Sequence
  Synthetic
SRVEELLKRLEDATRRHLEVSKRLNDDLRRATKDHLDKLRELNERVKKVVDDVVEKIKSNGDKDKLLRDAEELVRRVKKRHDELLKTNEDLLRRLEELHKRLLDHNRELLREIKERLDDTEEAREVRERLDRLHEELEKEVRRSEKTLKELHDRLRKEVERSKRHLDELLKDLEDKVR

SEQ ID NO: 12293 - protein, 178 aa, Artificial Sequence; identical to SEQ ID NO: 12292
  Synthetic

SEQ ID NO: 12294 - protein, 178 aa, Artificial Sequence
  Synthetic
SRVEKLVREVEKVVEEVERTIRKLLEDVKEMTDRHLKMIEDLNRELEEIVRRVTELIKNNGDKDRILEEVEKAVEEVDRRHKRLLETNKEIIDEVKKRLDDLLRRLRKIADEVRKRLDDTDEARKVKKRITELVERVEREVDRVKKELEKLHERLKREVEKSSEHIKRLLDELRKRAE

SEQ ID NO: 12295 - protein, 178 aa, Artificial Sequence; identical to SEQ ID NO: 12294
  Synthetic

SEQ ID NO: 12296 - protein, 178 aa, Artificial Sequence
  Synthetic
RELEEILRRVKEVTKDHLDKIDELNKRLDKATKEHLERLRDLNRRLKEVVERIEEEIRNNGDKKKILERLERVIRELRKRHKDLLDTNRKLLEELRKRHKELLDHNREVVERVEEELKETREADKVRKDIRRLHEELAREVKKSEDHLRKLHEELRDEVRRSEEHLDALLEDLKRKVD

SEQ ID NO: 12297 - protein, 178 aa, Artificial Sequence; identical to SEQ ID NO: 12296
  Synthetic

SEQ ID NO: 12298 - protein, 178 aa, Artificial Sequence
  Synthetic
SELEKLLRDMEEATKRHDEMLKKLNDEIRKVVERILKELEDLNRRLEEIVRRLKEESKNNGDKDRILEEIRRVVRELEERHDRIEEEIRRVLERLEREHERLLEHNRELLEDIKRRLSKTEEADDVRRRLERLHRELRKSVETSKKHLKELLDRLAKSIEDSKKHARELLKRLEEDIK

SEQ ID NO: 12299 - protein, 178 aa, Artificial Sequence; identical to SEQ ID NO: 12298
  Synthetic

SEQ ID NO: 12300 - protein, 178 aa, Artificial Sequence
  Synthetic
SEVEELLDRVRKVVEDLMRESKRLNDELKKIVDDILRRLRELNKEIKDVVDEIKKLLDNNGDKDEILKTIKKVLEDLKRKHDELLKRITEVVEDLKRKHDRLLEEAEKVIEDVERKLDKTEEADKARKDLKRLLDRLRREVERSKEEMDKLLEDLERAVRESEKHLEKLLRDLERRAR

SEQ ID NO: 12301 - protein, 178 aa, Artificial Sequence; identical to SEQ ID NO: 12300
  Synthetic

SEQ ID NO: 12302 - protein, 178 aa, Artificial Sequence
  Synthetic
SRLEELLKRLDDIVKRVLTKIRELNERLKKIVEELLRRSEELNREVRRVAEEIRRLEEGNGDKDKILDEIRRILKRLKEEHERLLKEAKEVVDKLRRDHEELLRELKEAADDAERKADDTDKARDVRRTIRKLVRDVAEAVRRSTEHIDKLLEDLEREVRRSERDIERILRELEEEAR

SEQ ID NO: 12303 - protein, 178 aa, Artificial Sequence; identical to SEQ ID NO: 12302
  Synthetic

SEQ ID NO: 12304 - protein, 178 aa, Artificial Sequence
  Synthetic
SDVEKLLEDVRRMTEEHKELIKELNERVERIVRKVVEDSKKLNDELREIVKRVEDESRNNGDKDKLLKELRDVVRELKKRHDDLLRDAERVIEEAKRRHDELLKHNKELIDDVKRRLQETEEAARVREDLDRLHEELERFVRESKKHLDEMLKELRRRLERSKEEIDRLVKEAEEKLR

SEQ ID NO: 12305 - protein, 178 aa, Artificial Sequence; identical to SEQ ID NO: 12304
  Synthetic

SEQ ID NO: 12306 - protein, 175 aa, Artificial Sequence
  Synthetic
REVEEVLKEVKKIVDRNREELKRVLDEIRELVKRIEDDLRRVNEESEKLVRTLLELMRRGELREEEIRKIIEDIERKYRELERKVEEIIKEIEERITRLEEKNRRNLEDIRRLLDEINAPEEVRERIERLIEKSERDVREVKKKVEELARRLREEVEKLKKHVKRLLEELKKAAD

SEQ ID NO: 12307 - protein, 175 aa, Artificial Sequence; identical to SEQ ID NO: 12306
  Synthetic

SEQ ID NO: 12308 - protein, 179 aa, Artificial Sequence
  Synthetic
SEAEDALRKIKKLVDEVVERIKKVDDDSRKLVEEVERTIEKLDKESEDLVKKVKDMKRRGDVREKDIKRVIDTSRELVKKLKEDVDRVVEEIKDLNRKLNEDVKRVMDEIRELLKELEKRGVLREEVKKEVKRLLEELKRRLDESNKRNKRLIDELRKKLEDSRRRNEELLRDLKETAT

SEQ ID NO: 12309 - protein, 179 aa, Artificial Sequence; identical to SEQ ID NO: 12308
  Synthetic

SEQ ID NO: 12310 - protein, 179 aa, Artificial Sequence
  Synthetic
DEAEEVERRSRELVERAKTEIEKLDRESKRLVDTVARKIEEVDKRSEELVRTVEELRRRGDAREEKIKKVIEDSKELVRKLKEIVKKVIREIEKLNDELNKEVERLSKESEDLLKKLREDGILREEVEKENRELNRRLKEALDESNKRNRTLLEDLRRKLRESEERNRRLLRKLEEDAR

SEQ ID NO: 12311 - protein, 179 aa, Artificial Sequence; identical to SEQ ID NO: 12310
  Synthetic

SEQ ID NO: 12312 - protein, 179 aa, Artificial Sequence
  Synthetic
SEAEEALKKVEELVRRVEEEIKRVDERSKDLVRRVERKLEELVERSKELVKRLLDMRRRGDIREEEIERVSRESKRLLDEAEKDVRRVVREIEKLNEDLNRRVDKVAKEIRDLVRDLKRRGVLREDVERRVRELIERLKRKLEESNRRNKKLIDELRKRLEEVKRENEKLNEDLERETK

SEQ ID NO: 12313 - protein, 179 aa, Artificial Sequence; identical to SEQ ID NO: 12312
  Synthetic

SEQ ID NO: 12314 - protein, 179 aa, Artificial Sequence
  Synthetic
DELERVLKRVKELIDKSRREDEELDERSKELVKKVLDELKDALRKIEKLVRDLKEMTDRGDIREEEIKRVAKEIEELLEELERRVRKVTEEIDRLNKESHERNRRVAEEIKRLLDELKRRGVIREEVRKDAERLIRENEEDNRRSNERNKKILKELKDALDRVKEEVRKLIRRLEEEAR

SEQ ID NO: 12315 - protein, 179 aa, Artificial Sequence; identical to SEQ ID NO: 12314
  Synthetic

SEQ ID NO: 12316 - protein, 179 aa, Artificial Sequence
  Synthetic
SEAETVLEEVKKLVERSREEDKEVDDESRELVERVEEKLRRVLKKSKEDVDRVMRLIEEGKVREKVIEEVSRTSEKLLRDLEETVRRVVKRIEELNRESHERNRRLEEDIRRLADELRKRGVLTEEVEDTIRRLIEENKKRNEESNRRNRELIKKLERKLEEVKRRNEDLNRKLEETAR

SEQ ID NO: 12317 - protein, 179 aa, Artificial Sequence; identical to SEQ ID NO: 12316
  Synthetic

SEQ ID NO: 12318 - protein, 176 aa, Artificial Sequence
  Synthetic
STLEEAEEEVRRLIKRTEDETRRVADEVKKLLDKHRRATEDVEKKVRELLDRLKKDEKDEDVRRVEERVRELLEELKRTSERIAEEVTRLLEELERSSRRVVEENERLLEELKRLTDDREIEKIVRRAKETNEENREIIERILKEIKELIDDANRKLKEILDRIRELVETVKRKAK

SEQ ID NO: 12319 - protein, 176 aa, Artificial Sequence; identical to SEQ ID NO: 12318
  Synthetic

SEQ ID NO: 12320 - protein, 176 aa, Artificial Sequence
  Synthetic
STLEEVERRIRELLDRHRRATEEVEKEVDRLNKETRDELDRVRKEIEKLLKDLDRKERDEEVKDVERRVRELLKEAEKIVRDLERENKRLLDELRKTSKEIAKRVTDLLEDLRRLTDDEELRRILKRVEKLVKDLNDKLRKILDDARRSNEEIKRRLEEILKEVKRLVDTVTERAR

SEQ ID NO: 12321 - protein, 176 aa, Artificial Sequence; identical to SEQ ID NO: 12320
  Synthetic

SEQ ID NO: 12322 - protein, 175 aa, Artificial Sequence
  Synthetic
SRIERAEEELKRSLKELREDLERVVRTIRKILREHEEKSKDVKRRIEELLREVKKRMVKDREILRELEERVRKIEEDLERISDELRKVAERVIEEAKRLVDEDADRIRKIIELLRAGKDVDKVLRDVEDLNRTTLKLLEDLLRTVEEVVRRADKLLEDLLREIKRLVDEVMERDR

SEQ ID NO: 12323 - protein, 175 aa, Artificial Sequence; identical to SEQ ID NO: 12322
  Synthetic

SEQ ID NO: 12324 - protein, 175 aa, Artificial Sequence
  Synthetic
SEIEEIEKEIRKSVEEVKKTLDKVVTEIRKSTREHEKKSEEVRKRSKELNKDLRDRLVRDEKILKEVEDRSREMNDRLRKLSERNRKLNEDLIRRLEELVKRDKERVEDVERKLRAGKDVKTVLDDVRRVNEETKKRIRDLLEESKRSDEEADRRAEELLERNERLVRKVAEEAR

SEQ ID NO: 12325 - protein, 175 aa, Artificial Sequence; identical to SEQ ID NO: 12324
  Synthetic

SEQ ID NO: 12326 - protein, 175 aa, Artificial Sequence
  Synthetic
SRIEEVIRRAREILEDHRRKSTEVRERLKKLLKEHEDKSRRVKEESEKINRDVKRELVRDRKILEELKRRSDRLNEELDRLSKDVADKIRELIKELKRISDDLKRRIEEIIEMLRRGKDVDKVLKEIEDLVRKADELLRELLKRVEDLVRRADEVLEELLRRNRKLAEDVMRKDK

SEQ ID NO: 12327 - protein, 175 aa, Artificial Sequence; identical to SEQ ID NO: 12326
  Synthetic

SEQ ID NO: 12328 - protein, 175 aa, Artificial Sequence
  Synthetic
REIEEVEKEIKKLLDEHRKKSDDVVRKLEKILRDHERRTEDVKRESEKINREVEKRKVRDREILTDLKRRSKELNDRLDKLSRELAERIKELIKRLRDLSRRVAEVVREVRKLLRAGKDVDEVLERVRELLERADRKLEELLERVRKLVEDANRVIEEVLERNKRLADEAMKKDK

SEQ ID NO: 12329 - protein, 175 aa, Artificial Sequence; identical to SEQ ID NO: 12328
  Synthetic

SEQ ID NO: 12330 - protein, 175 aa, Artificial Sequence
  Synthetic
SRIEEIVKRIRDILKEHEDKSRRVVEDIKRSTEELKRALREVVERIKTILDDVRRRLVRDEKILRELEKRVREVIRKLEKLVEEDEDRDRELIERLKEISRTLRDVVRTVEKLLRDGKDVDKVLEDVRRVAKEADDRLEELLERSKKLNKETLDELERLLREVEELVKEVAERDR

SEQ ID NO: 12331 - protein, 175 aa, Artificial Sequence; identical to SEQ ID NO: 12330
  Synthetic

SEQ ID NO: 12332 - protein, 175 aa, Artificial Sequence
  Synthetic
SRIEEVSERVREILRRHEEKSREVVERIKKSTKELRDEVRKVRATSKEINDDVRRRLVRDDKILKELEKRSKELNDRLDELVRRDEELDRRLIEELKRLSDELRKELEDVDRKLKAGKDVDRVLERVEKMVRDADKRIDEVRKESERLNEETRRRIERLLRENKKLADEVAERAR

SEQ ID NO: 12333 - protein, 175 aa, Artificial Sequence; identical to SEQ ID NO: 12332
  Synthetic

SEQ ID NO: 12334 - protein, 175 aa, Artificial Sequence
  Synthetic
SRIERVEERMRELLDRHRETSKRVVEEIRKSTEEHKEKSERVVRESERLNREVERELVKDKDILRELKKRSKELNDELRKLSKDNEERNRELIRRLEELSKRVEDTIREVIKLLRAGKDVDRVLEEVERLVTEVNREIKELLERSKRSDKEADRRLEEVVKTNRELAERVARRAT

SEQ ID NO: 12335 - protein, 175 aa, Artificial Sequence; identical to SEQ ID NO: 12334
  Synthetic

SEQ ID NO: 12336 - protein, 175 aa, Artificial Sequence
  Synthetic
SEIEEVVRRLEELVKRVAEELKRVVDRIEDLLREHKDKSRRVEERSKEINEDVARRLVSDKDILRELEKESRRLNKELRELSERVEREIKKVIKEMEEMLKELEDRVREIIKLLRAGKDVKEVLERVKKLVDDLIRRLKKLLEDLKKLVDDADEEIKRVLEENEELARRAAERDT

SEQ ID NO: 12337 - protein, 175 aa, Artificial Sequence; identical to SEQ ID NO: 12336
  Synthetic

SEQ ID NO: 12338 - protein, 175 aa, Artificial Sequence
  Synthetic
SEIEDVVRRARELLERLRKRVREVVEDIRRSTEEHKEKSERVVKTSEELNKRLEDELVRDKDLLKKVKDESKKLNDELRRLSEENSKRNEELIKRIEKLVDDVAERIKEIEKMLRDGVDVDKVLEDVRRLVKEAVDRIDKILRDSRESDRRADEEIKKVLDRNRELVKKVADEDT

SEQ ID NO: 12339 - protein, 175 aa, Artificial Sequence; identical to SEQ ID NO: 12338
  Synthetic

SEQ ID NO: 12340 - protein, 175 aa, Artificial Sequence
  Synthetic
DEIERVEEEIRRLLEEHKKRSDEVVRRLEKLLKDHKEVTRKVVEESERINRDVERRLVRDERILKDLKDKSKELNDELRKLSEDVERMIKRLIEELRKLSKDVEDTIRELEKALKAGKDVKEVLERIRKLVKDVNKRLEEILEEVERLVRRANRRIEELLERNRRLVEEVARRDE

SEQ ID NO: 12341 - protein, 175 aa, Artificial Sequence; identical to SEQ ID NO: 12340
  Synthetic

SEQ ID NO: 12342 - protein, 175 aa, Artificial Sequence
  Synthetic
SEIEKVEEEIRRILEEHKRISDEVKRRVRKSTEEHEKRTEDVERRSREINEEVEARLVRDKDILRDLKRRSKELNDEARKLSKRNRETNTRLLEELDDISRELKERIERIEKMLKDGKDVEEVLRRIRKLAEEVNKELKRLLDESKESDDRLNKRLTEILRENEELARDVARRVK

SEQ ID NO: 12343 - protein, 175 aa, Artificial Sequence; identical to SEQ ID NO: 12342
  Synthetic

SEQ ID NO: 12344 - protein, 175 aa, Artificial Sequence
  Synthetic
SKEERIEEALRDLVRRHKEVSRRVVETIKDLAKKLEEKLRRVETDSKRINDEVRDKLVRDKDILRDLERRSRKLNEDLRRLLREIKERLRKIIEELKRLSKDVEDKVRELIKLLRDGVDVERVLEEIKKLVEEVNRELRELLKRIEELLKRAEEMLERLLRENRRLVEEVARRDK

SEQ ID NO: 12345 - protein, 175 aa, Artificial Sequence; identical to SEQ ID NO: 12344
  Synthetic

SEQ ID NO: 12346 - protein, 179 aa, Artificial Sequence
  Synthetic
SESEELDKEIDDIVREDEELNKELRKRNDDAVRRVEKVIEDLLRRNEDAAEKVKKLLEELKDVKEVLEKLIRDLERLHRETRELLERLIRELEELHERSKRESEKSIRKVKELLERIKERSKEVRELLRKLREILEDLRRKNERTEEESEEILRRLTKLAEEVLRRSRKILEDLREALR

SEQ ID NO: 12347 - protein, 179 aa, Artificial Sequence; identical to SEQ ID NO: 12346
  Synthetic

SEQ ID NO: 12348 - protein, 179 aa, Artificial Sequence
  Synthetic
SEKDELRKRMRDISKENKELLEKLEREIRELSKENEKLNEKLRRELEELRKTIKDLLDRLKDVKEVVEELLRRAERLLERIKELLDRSNKKLEELLRKVEEDLRRSNEKLETLLREIKERSKEARELLKEAKELLEENRKRNEEILRRAEKVLRDNAEKDKRTLEKVEEILDRLRRELT

SEQ ID NO: 12349 - protein, 179 aa, Artificial Sequence; identical to SEQ ID NO: 12348
  Synthetic

SEQ ID NO: 12350 - protein, 179 aa, Artificial Sequence
  Synthetic
KEAEDLEREMREISDRNRKLNKKLRRDIKEISDDNRRLLEELRRRLKKMEEDVRRLLEELKDDKDVVEELRKELEELVRRIEKDLRKSNEKLEKLLRDVEEALRDSNEKLERLLRKIKERSKEVRELLTEARKLLERNREEDKKSLDDARKALKENKEENDKIKEEIDKILRELEEELR

SEQ ID NO: 12351 - protein, 179 aa, Artificial Sequence; identical to SEQ ID NO: 12350
  Synthetic

SEQ ID NO: 12352 - protein, 179 aa, Artificial Sequence
  Synthetic
EESERLAKRVDDLSRENEELNKRLRDEMEKISRENKELLKDLRRKADKIVKDVERLLEELKDVDEVVRELKKRLEDLMDEIRKALKRSNEKLKKLLEDIKEALERSNRKLKELADDIRRRSKEARELTRRIEKLLKDNTDRDKKSEDDLRELLKENKKRNDEILEEIRRILEELRKKLT

SEQ ID NO: 12353 - protein, 179 aa, Artificial Sequence; identical to SEQ ID NO: 12352
  Synthetic

SEQ ID NO: 12354 - protein, 180 aa, Artificial Sequence
  Synthetic
SLDKEIERKVEEIERRLKESNDRLREKVDEIRRRSERLNTELNERVDRIAERIRRMKRDGTKDVEELVRKLAKELRELLKEVVERDEKLLRDLEKTAEEVIRENKRLLDELRKLVEDLKRAGSLEERLEEKIDRIIRELERRNDKSREELEKIIRELRERTKESEKRLEDIIRELEERTR

SEQ ID NO: 12355 - protein, 180 aa, Artificial Sequence; identical to SEQ ID NO: 12354
  Synthetic

SEQ ID NO: 12356 - protein, 180 aa, Artificial Sequence
  Synthetic
DADKRLRTDVRRIVEDLKRSNEELRRRSEEIAKRSDKLNKELNKKSKEIEERVKRMRDEGRKDVEELVKRLIEESRRLTEEVLKKDEELVRESRRLTEEVKKRNDKLLRELEKRLDELKKEGVITKDLEKELRDIIRELRERNRESEEEDERIIRELEKRTKDSEKRDDEILRELEREIR

SEQ ID NO: 12357 - protein, 180 aa, Artificial Sequence; identical to SEQ ID NO: 12356
  Synthetic

SEQ ID NO: 12358 - protein, 180 aa, Artificial Sequence
  Synthetic
SLVEKIAREVRKIKEDSKRLNDELNEKVRKAVEDLERSNRELEKRVREIEERVRRAETEGRKDVEELVKRLVDELRDVLEKVKRTNERLLRELERTAKEVSDRDRELVRRLRELVKDLKRKGSATKELEDDIERIIKELEELTRRSEEKLRETIERLEERNKETAERLERIIKELEERSK

SEQ ID NO: 12359 - protein, 180 aa, Artificial Sequence; identical to SEQ ID NO: 12358
  Synthetic

SEQ ID NO: 12360 - protein, 180 aa, Artificial Sequence
  Synthetic
KEAEELEERVKRIEEESRRLNRELNEKVKDIAKKLEDSNDKLRKDSEEIAERVKRARTEGRKDVEKLVDKLIKESEKLTEEVKRENKRLMDELRELLKKVKDDDRELLERLRKLVKDLRREGSIKDEVVKKLEDIIREIEKTTRESEKRLEDIIRKLKKKNDDTEREDREIVKRLREETK

SEQ ID NO: 12361 - protein, 180 aa, Artificial Sequence; identical to SEQ ID NO: 12360
  Synthetic

SEQ ID NO: 12362 - protein, 182 aa, Artificial Sequence
  Synthetic
SLLEKLERDVERLSEEDEKLNEDVRRVDREIVERDKKLNREVNERVKRLAEEVKDIRRRVKDDETAKRLLDKVAEEIKELAKRLEEESRKLVRESEELVKRLERMSEELVKEIERLVKKLKDEGKLRERAEERLRRIIKRNKEENERTAKESRDSIEELKERNERSKRRLEKILEDLERETR

SEQ ID NO: 12363 - protein, 182 aa, Artificial Sequence; identical to SEQ ID NO: 12362
  Synthetic

SEQ ID NO: 12364 - protein, 182 aa, Artificial Sequence
  Synthetic
REAEELEKRVRKIEREDDKLNEELNRRAKDVSREDKELNDRVREVVRRLVEEVDRIRRDVKDKRDAREKVREIMDRIRRLLEELKRRSDELAKELRELLEELERRSKKLVDEIKEVVRKLKEDGKLREELEKKLEDIIRELKKRNDESAERIRRLIKTNEDENRRTAEEIKKILDDIRRKVK

SEQ ID NO: 12365 - protein, 182 aa, Artificial Sequence; identical to SEQ ID NO: 12364
  Synthetic

SEQ ID NO: 12366 - protein, 186 aa, Artificial Sequence
  Synthetic
SELEEIRKKIDDLRRRVEEINERITREDKRLVDELKEINKRITDRVRKIARDVEELLRKGEPKSRVKKMLDDAERELRRLLKELREMHERIVETSKELNERLREVHKRIAEEAKKLVDELRREGGRDEERLRTVDEEVKKILDELREKLDRNRRRSEETNRRLDELLKENARRVEEIIRRLREEVK

SEQ ID NO: 12367 - protein, 186 aa, Artificial Sequence; identical to SEQ ID NO: 12366
  Synthetic

SEQ ID NO: 12368 - protein, 186 aa, Artificial Sequence
  Synthetic
SELEEIKKRVEEIARTLEKLNRDITKLDEDLAREVEDINRRITETVEEIAKRVERLREKGEPKEDVRRVLDEVEKELKKLLDELEKFHRDIMETSKDLLRRLREAHDRVIKELKDLVRELEREGGRDKERLDKLRTEVKKIMDDLRRILEKNAKDSKRSLDRLRKILEDNKEKVKRIADRLREAVR

SEQ ID NO: 12369 - protein, 186 aa, Artificial Sequence; identical to SEQ ID NO: 12368
  Synthetic

SEQ ID NO: 12370 - protein, 178 aa, Artificial Sequence
  Synthetic
KDEKRIKDVLKKLEDDNKKLNDEIKKLNEEIARKNEELNKRIEDMIRKAEREVDELKRNGADKEVLERILRRVKELIDRLTRALEDSLRESKRLSEELARALEESLRRIKEVIDRLREENKEAKEVDDEARRILEKLRRENERTKEESKEINEELEKRNRESVERIKEILRRLEEKLR

SEQ ID NO: 12371 - protein, 178 aa, Artificial Sequence; identical to SEQ ID NO: 12370
  Synthetic

SEQ ID NO: 12372 - protein, 181 aa, Artificial Sequence
  Synthetic
SEVERLLREVEKVLRRVVKRSRDLNEELKKRSKEHKETSERLNREMKRVLREVEKKIDETRDKETLDRLLREVEEVLKELKKRHDELLRHNKKVVDELKEEHKKLLKEAEDALREVKKELDKRGGVREVKKRLDELLKRLEREVRESEKRMDRSHEDVRREAERSKKELEELLKKLEDKVR

SEQ ID NO: 12373 - protein, 181 aa, Artificial Sequence; identical to SEQ ID NO: 12372
  Synthetic

SEQ ID NO: 12374 - protein, 181 aa, Artificial Sequence
  Synthetic
SEVEKILRDVEDATRRHKRTSEELNRRLEEVVRRVKEESKELNERLREVVKRVKEEIRKTTDKETLDRLAEELKRVVEDLKRRHEELLRRAEEVVKDLKRRHDELLRHNRRLLKEVKERLDDRGGVREVKKRIDELHDDLRRVMEASKERIDRILEDLRRVVERSKEELRKLLEDLKRTVD

SEQ ID NO: 12375 - protein, 181 aa, Artificial Sequence; identical to SEQ ID NO: 12374
  Synthetic

SEQ ID NO: 12376 - protein, 181 aa, Artificial Sequence
  Synthetic
SEVEELLKRVEEATERHKREIERLEDEIRKVLEDVDKRSKELNDHNRDVIEKIRERIERTRDKDTLKKLVDDLRELSERHKREHDRLLEEVKRVAEDIKRRIDELLRHNEELLRDVKRRLEERGGVREVKTELDKLHEDLKRTAEEVKKRLDDLLKELEKKVEESKTEIDRSLEELEKTAR

SEQ ID NO: 12377 - protein, 181 aa, Artificial Sequence; identical to SEQ ID NO: 12376
  Synthetic

SEQ ID NO: 12378 - protein, 177 aa, Artificial Sequence
  Synthetic
DEERRVKEELEKLLEDLRRTIKKVEEDSDRINKDLERVIRRSEREADKILEDLERAGVSEELLKRLEDLVKRIKETHEELLRRLKKSSDELREELERLLREIEKMVRDAEDVLRRNVSEEKLRELLERAKKLVEDIKRRLKELLDRHRDLVRRIKERSKELNKRLKDLIDEIKERAR

SEQ ID NO: 12379 - protein, 177 aa, Artificial Sequence; identical to SEQ ID NO: 12378
  Synthetic

SEQ ID NO: 12380 - protein, 177 aa, Artificial Sequence
  Synthetic
SSKDDLRRKIEKLLRDLERVIRESEKRSEEINRDLERTLKRIKEEADKILDKVRRGGVSEDLLRELEELVKKIERRLEELRKELEDSSRRLRETHERLRRDLERIVDELEKALRNNIDDRLLEKLLRELEKLIRRIEEESRKLNEEHEKLLKRIKDELKKLLDDLRRLAREIEERRR

SEQ ID NO: 12381 - protein, 177 aa, Artificial Sequence; identical to SEQ ID NO: 12380
  Synthetic

SEQ ID NO: 12382 - protein, 177 aa, Artificial Sequence
  Synthetic
KSTEDAKREIDKLLEELEETIRRAEDRSRRLNEDLARTLKRIEEELKRINEEVEKRGVSEKLLEDLRRSTEELKRSLRELLRRLEESSRRLKERAKRLLAELERIVEELKRALDDNISDELLKKLLDELRELIDRIRRDLERLLREHEELIERIKRTLEELLRRHRELVKRIEETAR

SEQ ID NO: 12383 - protein, 177 aa, Artificial Sequence; identical to SEQ ID NO: 12382
  Synthetic

SEQ ID NO: 12384 - protein, 177 aa, Artificial Sequence
  Synthetic
SEEDRLEEEIKRILDDVARVVKRIKEELKRINDELKKVIDESRDHARRVNDDVRRRGVSEELLRELKESTERNDELLKKLLKEAKESTETITRELDRLLEELKKIVDELRELLKKNISEELLKELLKRLEELARRIKKKLEELLREHEKLLEEIEKALRRSNEEHRKLVEKIKRDAT

SEQ ID NO: 12385 - protein, 177 aa, Artificial Sequence; identical to SEQ ID NO: 12384
  Synthetic

SEQ ID NO: 12386 - protein, 177 aa, Artificial Sequence
  Synthetic
DEEERVKEAVERLLRDLERAIKESEDHLRRLNEDLDRVIRESKEHLKKVNDDVRRAGVDKRLLDELKKSTEDNKKTADDLKRKLKRSTDENKKRLKRLEEELRRLVERLKEALRDNISEELLKKLLEELKRLIERIKRDLKRTNDEHEKLIREIKKRLEDSNRDHERLVKDIKETAR

SEQ ID NO: 12387 - protein, 177 aa, Artificial Sequence; identical to SEQ ID NO: 12386
  Synthetic

SEQ ID NO: 12388 - protein, 177 aa, Artificial Sequence
  Synthetic
SKEDRLREELKKLLKRLREEIERLKRALEESNKDLKRTIDRSEKHLRDVNEDVKRAGVSEELLRELERSTRENKERAKELLKRHEDLVRKVEKELRDLLRRLEEIVRRVDEMLKRNIREEELDKLLKEARDLIREIEKRLEELLKRVEKLTEDAKRDLERSNREHKELADRIKETAR

SEQ ID NO: 12389 - protein, 177 aa, Artificial Sequence; identical to SEQ ID NO: 12388
  Synthetic

SEQ ID NO: 12390 - protein, 177 aa, Artificial Sequence
  Synthetic
SEAERIEEEARRLLEELRRAIERVKEEADRLLEELRDAIRKSKEHLKRLNEDVERAGVEERLLDALRKSTEDNERLLRDLLRKLEEAVRRLEEEARRLLKEAEEIVREIKKVLDNNVSEEALKRLLEKLKRLIEEIKRELKRLLDDLKRLIDEIAEALKRSNDRHEELVRRIKEKAR

SEQ ID NO: 12391 - protein, 177 aa, Artificial Sequence; identical to SEQ ID NO: 12390
  Synthetic

SEQ ID NO: 12392 - protein, 177 aa, Artificial Sequence
  Synthetic
DSKEEIRRKIDELLKRLEETIRRSEEHFRRSLDDARKELKRSRDHVRKVNKELRDRGVSEELLKEAERSTRENEKLLKELEERLKRHLEENKKIADKLLEELERLVRRLREVLKKNVDDEELERLLRDLERLIREIEKTLEDTNRSNEELVRRLKRRLEESNKRHEDLADEIRRRTD

SEQ ID NO: 12393 - protein, 177 aa, Artificial Sequence; identical to SEQ ID NO: 12392
  Synthetic

SEQ ID NO: 12394 - protein, 177 aa, Artificial Sequence
  Synthetic
SEEDRIREEMEEILRRVERTVEEIKKELKKINDDVDRTARESEKHVREVLERVEREGVDKDLLDELRKIVEENKRLAKRLKDELRKSTKKIEDDLKRLLDELKRLVEEVDEALKRNISEELLEKLLEDLKRVVEKIRRDAEDLLERHKDLVRRIKEELRRSNRKLEDLVKKISERAT

SEQ ID NO: 12395 - protein, 177 aa, Artificial Sequence; identical to SEQ ID NO: 12394
  Synthetic

SEQ ID NO: 12396 - protein, 177 aa, Artificial Sequence
  Synthetic
DEDREVRRTLEELLDDLRRVIEESERHLEKLNEDVREAIRRSEEHVRRVLDRVRRGGVNEKLLEELDKIVKENRKLLEELLRRLEESTKRNRDEAKRLLEELADIVRRIEELLRDNISEDLLRKLLEEAKRVLDEIRKTLKKTNEDHERLVERIKRELEKSNKDLERLAKEIIDRDK

SEQ ID NO: 12397 - protein, 177 aa, Artificial Sequence; identical to SEQ ID NO: 12396
  Synthetic

SEQ ID NO: 12398 - protein, 177 aa, Artificial Sequence
  Synthetic
SSKEDITKKIEELLRELEEELKKSEKHLRELNEEAKRTAEESRRHLEESLRKVEKDGVDEDLLRKLEEHVRDNERRARKLLKDLKDSTDTNRRTAKRLLERLKELVERIKEMLKRNIDDEELKKLLKELEDLVKEIKERLRKTNEEHRKLVEEIKERLKRSNESNERLVRRIEEEAR

SEQ ID NO: 12399 - protein, 177 aa, Artificial Sequence; identical to SEQ ID NO: 12398
  Synthetic

SEQ ID NO: 12400 - protein, 179 aa, Artificial Sequence
  Synthetic
SELERAEEEIEKLNRDLKRTLDEIRDRIRKINDDLRKTLRKSDEDSKRLLKELRDEVPDLREVDDRIRKIIKENKDLARELKREAEDSSRDLERILREIEETVRDSSRKLKELLERDKESGEKLKDMLDKHRKLIDDLKRRLERRLREHKRLLDEIEKRLRDSLKRIEEIVREILERAR

SEQ ID NO: 12401 - protein, 179 aa, Artificial Sequence; identical to SEQ ID NO: 12400
  Synthetic

SEQ ID NO: 12402 - protein, 179 aa, Artificial Sequence
  Synthetic
DELERIRRELERINTTLDELLKRSKEETDRILKKVEDSIREVEKKVKELLEELKRRVPDLRKVEEDVKRVLDELRRRLRKLLEKLKRLADDNRRKLKELKDEAERSSREVERLLREKKESGELLKKILDEHRDLLRRIEEELRRSLEDIKRVAKEVEERIKKVLDELRRLIEELLRRAK

SEQ ID NO: 12403 - protein, 179 aa, Artificial Sequence; identical to SEQ ID NO: 12402
  Synthetic

SEQ ID NO: 12404 - protein, 185 aa, Artificial Sequence
  Synthetic
SVLEEAEKELRKIVEDNRRTLREVKERNKKLNKENRDTIKKIEDDVRRIIRELKEDLKRSEKDELRKELKEVEEEIRKLIKDAREHSDRVIRESKKLVEELERRTRELEERIKKLIKDIADRFGGGEEDLRRLEEEIRRRSEENKKRIRDLLRRSEELSRRDKKKLKEILERIKRLADEVREKIR

SEQ ID NO: 12405 - protein, 185 aa, Artificial Sequence; identical to SEQ ID NO: 12404
  Synthetic

SEQ ID NO: 12406 - protein, 186 aa, Artificial Sequence
  Synthetic
SDLEDILRKIEDLSRKNEEELKRVLEENKKLSDDDKRRLEKILREVEKKIRKIKKDIKDEKDKEKLRKKVEDLEREAKELVDDLRRHSEELSKRSEKSLRDVKKHSDDVAKRARELVKELVDRRGKETEEVRKLEEDVRRIIERNKKLTEDLARELKKLNDDNERTLRKVEEDIRRIIADLRRTLK

SEQ ID NO: 12407 - protein, 186 aa, Artificial Sequence; identical to SEQ ID NO: 12406
  Synthetic

SEQ ID NO: 12408 - protein, 186 aa, Artificial Sequence
  Synthetic
SELDEILERLRRLSEENKRRIEEALRRNKKLSEDDERLSREIRRRVRELVEEAKEVLRREKDKDKLRDKLERIVDELRKLLEDNTRHSRKVSEDSKESLKDLRRHSKEVIETLEKLLEELIRKDGEETEEVKRVAEELDKLVKENRRVTEKVARELKKLNDKNREVNERLERELDKIIKDLRRTDK

SEQ ID NO: 12409 - protein, 186 aa, Artificial Sequence; identical to SEQ ID NO: 12408
  Synthetic

SEQ ID NO: 12410 - protein, 186 aa, Artificial Sequence
  Synthetic
SEIEKILEDVKKLADDLRRTLKRALEENKELSDRDKEELRRILEEIKKLAEEIDKLIKEEKDKDTLRKKVKDLEERVRELIKRLERHSREVSKESERSIRELERLIDEIVKRMEELLEKAIRDKGKDTERVREVARRIEKIIEDLRRDLERVRRELKKLNDDNRRVLEEVKRTVEEIIKRLRESAK

SEQ ID NO: 12411 - protein, 186 aa, Artificial Sequence; identical to SEQ ID NO: 12410
  Synthetic

SEQ ID NO: 12412 - protein, 185 aa, Artificial Sequence
  Synthetic
DEVDELLKEAEEVIREVTREHKRLLDEARKISEENKKRSEESNREVRELVRRIKEEIKKGLPEEDLKRLLDELRDMIRKVRETNERSDKEVEKVVRDILRRLRELNKRVEEIIRRILKEIRRDVRDSEKAKRVEEELKKLLDKLSRITEEVERRLEELLKDNERVSRESDEELKRILEDVERDTR

SEQ ID NO: 12413 - protein, 185 aa, Artificial Sequence; identical to SEQ ID NO: 12412
  Synthetic

SEQ ID NO: 12414 - protein, 185 aa, Artificial Sequence
  Synthetic
SEVEELLDRLRKLIEDVVREHKRLLDEVRRISRENEELIRRLLEKVEEVIRRIKERIKSGQPEEVIKRILDEARRRLRKVLEEIKRSDEEVEKMLRDVLKTLKELNDRVREIIKDILKKIRDKVKDEKTAREAEEELRRLLERLSEVTRKVEKAIEDILRRNRETSERVAREIRRLLKELEDTAR

SEQ ID NO: 12415 - protein, 185 aa, Artificial Sequence; identical to SEQ ID NO: 12414
  Synthetic

SEQ ID NO: 12416 - protein, 185 aa, Artificial Sequence
  Synthetic
SSVEELLERLRRISEENKRRIEKLLREVEKVLRELKDRHRKLLKRVEEIIRKVKEEIKSGLPEEVVKRVLERVRERVKEVLEEADRLNDEMRRIVTEVEKELDKSDKEVEDMVRDILKKIEEEVRDRETAERARETLKRLLDENRDRSKKVKEEIRRILEDLTRTTERVKREIKKLLKELEDTAR

SEQ ID NO: 12417 - protein, 185 aa, Artificial Sequence; identical to SEQ ID NO: 12416
  Synthetic

SEQ ID NO: 12418 - protein, 178 aa, Artificial Sequence
  Synthetic
DLLRKLLEEAKKILKEIKDAHEKLLRELEESNKELEKAHRKLLEDAKRMLDDLKRTDPREDLLRKLEELVRRIKEESKRLNREHAELVRRIEEISRRLNEELRRLVKKIEEELRRKVDDEDRVRDLRRALEELIKESDEVSRRLKEEIDRSLESSKKVSRDLEEELKKLIKDLEDTRR

SEQ ID NO: 12419 - protein, 178 aa, Artificial Sequence; identical to SEQ ID NO: 12418
  Synthetic

SEQ ID NO: 12420 - protein, 178 aa, Artificial Sequence
  Synthetic
SELEKLLRDDRELLKELKKAHKKLLDELKESNDRVRKRHEELLRRIREIAKRLRDTDPREDLLRRLEELVRRIEEDSKRLNEEHKKLIEEIERRSRKLNEDHERLSREIRERLERRVDDKDKVRRVERESKKTHDESREVSEKLRRDAEDSLRSSEKLSEDLERELRKLIKEVRDEAK

SEQ ID NO: 12421 - protein, 178 aa, Artificial Sequence; identical to SEQ ID NO: 12420
  Synthetic

SEQ ID NO: 12422 - protein, 178 aa, Artificial Sequence
  Synthetic
KDIERLLEELKRILEDLKRKHKRLLERLEDSNRRIRRTLEELLKRLEKLVKDLSDTDPREDLLKELKRLIDEIRRRLEELIRRHEELLREIKERSDELNKRLEKLVREAIDRMRKRVDDKDKVDDAKRRLEELLKESREVSKKLRDDIERSIRSLREEVKKLDEDAKRLLDKVREEIR

SEQ ID NO: 12423 - protein, 178 aa, Artificial Sequence; identical to SEQ ID NO: 12422
  Synthetic

SEQ ID NO: 12424 - protein, 178 aa, Artificial Sequence
  Synthetic
SVLEDLIRRDREMLKRAKEEHDRLRKEIERSNREIDEEVKRLLAEIKKIVEEVSKTDPREDLLREAKRLLDKIKEDLKRLLDEHRKLLRRILEESRKLNEEHRRLSREVDELLRRRVSDKKAVDEVRKESDDTHKESEAVSRDLKRELERSIKSLEKRIREAEEELKRILKELEDEKR

SEQ ID NO: 12425 - protein, 178 aa, Artificial Sequence; identical to SEQ ID NO: 12424
  Synthetic

SEQ ID NO: 12426 - protein, 178 aa, Artificial Sequence
  Synthetic
EELERLLEEDKELVRRVERELERLLRELKRSNDEIKKTLEDLLRRIEEILKEIRRTDPREDLLRTLEDLIKKIKDELDRLIKEHRDLVEEIEREARRLLDEHRRLSKEIKDRLEKRVDDKEKVKRAEDRSRETHRRLEEVVKKLKEDAERSIKSLEELVDKLRKELRRLLEEVREEVR

SEQ ID NO: 12427 - protein, 178 aa, Artificial Sequence; identical to SEQ ID NO: 12426
  Synthetic

SEQ ID NO: 12428 - protein, 178 aa, Artificial Sequence
  Synthetic
RELEELIKEDEDLLRRLAETLKKLLEDVRRSNEELRKFHEDLLRDLERLLEELRNTEPREELLRKLEKMIRDIERIARELNDRHERLVEKIRETLRKLLEEHKELSDRIREKMEREVDDKEKVRRVEERSRRTHKELEDLAREVDKELKKSIKSSRDVTRKVKEDADRLLKKVADDTK

SEQ ID NO: 12429 - protein, 178 aa, Artificial Sequence; identical to SEQ ID NO: 12428
  Synthetic

SEQ ID NO: 12430 - protein, 178 aa, Artificial Sequence
  Synthetic
SILETLADRDRDMVRRVKEALKKLLERDKRALERLKRVHKELLDRLRKILEDLKRTEPREELLKRLEDLIREIEETARRLNKEHEDLSREVRKILKELLDRHRELSKEIKEIMDREVDDEEKVKRVEEESRRTHKELKDVADRVETESDKSHEESKKVTDEVRKELERLLRELEETVR

SEQ ID NO: 12431 - protein, 178 aa, Artificial Sequence; identical to SEQ ID NO: 12430
  Synthetic

SEQ ID NO: 12432 - protein, 178 aa, Artificial Sequence
  Synthetic
SEAEKLLRELEDILKKLKDALKRLIEEDERLLKRLKREHEKLLKRLEEVLRELKKTEPSEELLRELKKLIEDIEREAERLNAEHERLSREVEKTLRKLLTDLERLIREIKKKLDDRVDDREKVKRVKDEADRLLKELEDVVREVKKRSDESHKRSRDVTREMKKELKRLLEELEKTVR

SEQ ID NO: 12433 - protein, 178 aa, Artificial Sequence; identical to SEQ ID NO: 12432
  Synthetic

SEQ ID NO: 12434 - protein, 178 aa, Artificial Sequence
  Synthetic
SELERLLREDEEMVERVERVLKELEEEVRKALKRAKEMHRRLLERLKTILDELERKEPREDLLRELETLAEEIKRILEELNKELRKLLREIEEELKRLLKEHKELSDRIKKILEEKVDDKEKVKELERRSRKTHKELADKADTLRKRLEEVIKESEDVTEELERRLKKLIDDLRRSVT

SEQ ID NO: 12435 - protein, 178 aa, Artificial Sequence; identical to SEQ ID NO: 12434
  Synthetic

SEQ ID NO: 12436 - protein, 178 aa, Artificial Sequence
  Synthetic
SELEKLLRELEELLKELKRVLEELIERDKRLLDRLKEVHERLLRRLEKLLKELKDKEPREDLLRRLKELIDKIREDAERLNEEHRRLVEEVKKELDRLLRELEDLLRRIEDILRKRVDDEDKVREAKRELERLIEELRRAVRRVEDESRRSHEESKKVTDDLDKRARELLEELRETIR

SEQ ID NO: 12437 - protein, 178 aa, Artificial Sequence; identical to SEQ ID NO: 12436
  Synthetic

SEQ ID NO: 12438 - protein, 179 aa, Artificial Sequence
  Synthetic
REVEELEKDVRRTLDELRKRHRDNNERIKKILRELEDLHRRNNERTKTLLARIRELRERGGEDKERMVKTVEDILRESTRHSERVIRESERLLEEAKRHSEEVARRSKEVLKELEDKVRESRVPRELERKLKELVKDVEKVIEDDDRSADKLLTKVKRDADEDRKSNEKLVREVREELR

SEQ ID NO: 12439 - protein, 179 aa, Artificial Sequence; identical to SEQ ID NO: 12438
  Synthetic

SEQ ID NO: 12440 - protein, 179 aa, Artificial Sequence
  Synthetic
SEAEEVLKRVEEVVERLKKLHDDNNKKLRDAVRRLKRLHTEHNKETKEIKKEIEDLIRKGGEEKEKLVERVERLVKRSTDTLREVVRRTEKLLKEVEDHSRRVIEESKELVKEMEKRLRETDVSREVEKRLKEVVKRIDEVAEEDERSIREILRELRKVIEDDERSNRKVAKEIRESAK

SEQ ID NO: 12441 - protein, 179 aa, Artificial Sequence; identical to SEQ ID NO: 12440
  Synthetic

SEQ ID NO: 12442 - protein, 179 aa, Artificial Sequence
  Synthetic
DKVREVLERLKKLVEDLKRLHKRNNEEVRRVIEEIKDRSRRNNKRTEDILRDIEREIRRGGERKEELVKRVKELLEDSTRHSEEVVREVEEILREVKRHSEEVVKESERILREAKKRLDESDVDERIKEELKKLVEDVRRTAEDDRRTIEDLVRKVEEVLERDRKSNEEAARDVDRKLK

SEQ ID NO: 12443 - protein, 179 aa, Artificial Sequence; identical to SEQ ID NO: 12442
  Synthetic

SEQ ID NO: 12444 - protein, 181 aa, Artificial Sequence
  Synthetic
RSVEEVKKELDDSDRRDREVVKEARRRLEESKDRLRKIIERAKEELDKSDERIKKNGVSEELLRRLKEVSEEHRRELERLLRRLKEVTDEHTKAIKKIHEETKKVSDDHRRAVEELRKRGGVDEELKKLLKHNREVLEDSRRKIEELLRTNEKALEDVKRAIEELLKHNEEVLKEVDDRTR

SEQ ID NO: 12445 - protein, 181 aa, Artificial Sequence; identical to SEQ ID NO: 12444
  Synthetic

SEQ ID NO: 12446 - protein, 181 aa, Artificial Sequence
  Synthetic
KEVEDAEKRLRDLLKEDRELIERLRRALEESLKEDRKVIKELREELDKSDRKVEEDGVDERLLTELRKASEEHRRKLDEIHERTREETERHKERLDKIHEDTERVARELKKRIDELKKRGGRREDIKRLLEELEEVLRRSEKKLRELLDTNRKILEESKERLRRLLEHNKRVLRRVVEETR

SEQ ID NO: 12447 - protein, 181 aa, Artificial Sequence; identical to SEQ ID NO: 12446
  Synthetic

SEQ ID NO: 12448 - protein, 181 aa, Artificial Sequence
  Synthetic
SDEERVEKELKKSDDEDKKLIDELTRRLRESLKRLEEEVRRAREELDKSDEEVRKAGVSEELLTRLEKMSREHKKRIDDLLRRAKEVTERHERKLEEIHKRTKDMSDDHRRKIEDLRAKGGVREDIERLLDHNRKVLEKSADDLRKLLKTNEEILRRVAKAIRDLLEHNRRVVEEVKERAR

SEQ ID NO: 12449 - protein, 181 aa, Artificial Sequence; identical to SEQ ID NO: 12448
  Synthetic

SEQ ID NO: 12450 - protein, 181 aa, Artificial Sequence
  Synthetic
SEVEEAKRRLDESDKDDRRVIDKLRKELEKSREEAKRLIDRLREELKDSNREAEEAGIDEDLLRKLRKATDEHRRKIEDLLRELDRVTKEHKERIDKIHEETKEMSKRHKDELEKLRARGGSREDLRRLLEHNKEVLERSKKRLEELSETNKKFLEEVKDALRELLKTNREVLREVKERTK

SEQ ID NO: 12451 - protein, 181 aa, Artificial Sequence; identical to SEQ ID NO: 12450
  Synthetic

SEQ ID NO: 12452 - protein, 181 aa, Artificial Sequence
  Synthetic
SSVERAKRELDKSLKEDRDTIRDLKRRLEESRKRDREVIEELKKILKKLLDEVKDSGISKDLLKRIEDAVRTIEEELKRIHDDTERMTREHKERIERIHDRTKKVSDEHKKTIEDLKRKGGDDDKIKKLLDHNRKVLEDSKEELRRLLETNKRILEESKKRLDRLAEEIEKVARTVKEEAR

SEQ ID NO: 12453 - protein, 181 aa, Artificial Sequence; identical to SEQ ID NO: 12452
  Synthetic

SEQ ID NO: 12454 - protein, 181 aa, Artificial Sequence
  Synthetic
DEVERAEEELRKSDEEDRRVVKRATETLKKSKDELEREIKRLEDELERSNREVEERGVDKSLLEELEKVTRDHKKRLRDLLETVRRLTEDHLEKIKKIHEDTKRASEEHLKAIRELERRGGVREEIKKLLDHNRRVLEESERRIRELLRTNREVLERVKKELDELLEHNRRVLEEVEKRVR

SEQ ID NO: 12455 - protein, 181 aa, Artificial Sequence; identical to SEQ ID NO: 12454
  Synthetic

SEQ ID NO: 12456 - protein, 181 aa, Artificial Sequence
  Synthetic
SSVEKAKKRLDESDKTDRDVIKRLREELKKSEDTDRELVKKVKEEIEKVEEELRRRGIDESLLTELKRVAEEVKETIDDIHRKTKRVTEEHTKAADKIHEETKRASKEHKERIEELRKRGGDDDKIRRLLEHNEEVMKRSKERLDDLVRTNRKILEESKRKIEKLLKELREVVEEVDRRAR

SEQ ID NO: 12457 - protein, 181 aa, Artificial Sequence; identical to SEQ ID NO: 12456
  Synthetic

SEQ ID NO: 12458 - protein, 178 aa, Artificial Sequence
  Synthetic
DKAERVREEIEKLERELRRVLKESREHTKKLEEDLERVLRRSREATKKLKEDLERNNLPDEARKRADEILKRNEDLLRRIKKTMRDVLEENERLLDKIERDLREAIKRLEEVLRDKKDDGELIKRMLEELKRLLEELEKRIRDSNAELEKLLRDLIRKLERSLREIKRVLEELKEEAR

SEQ ID NO: 12459 - protein, 178 aa, Artificial Sequence; identical to SEQ ID NO: 12458
  Synthetic

SEQ ID NO: 12460 - protein, 184 aa, Artificial Sequence
  Synthetic
SEVETLMREIKKLIDDIKRKNEDSNREIREVSRKTEEDLRDLLRKAREVAEKLKDELRRRKDKDVVERVRRLVDELRRRMEDLVRKVKEINDRLRRLVEELVKDSERLARDLERRVRSLARKIDDEEKVKRLEDSLERLKRDLRKIIKENEDELRKINRRNEELIKKAEEDLRRLSEDLKRAEK

SEQ ID NO: 12461 - protein, 184 aa, Artificial Sequence; identical to SEQ ID NO: 12460
  Synthetic

SEQ ID NO: 12462 - protein, 180 aa, Artificial Sequence
  Synthetic
SELEEVLRRIEKLVRKAHKENEDVLREIERLVRTAHRLNKKVDDDSAKIAEDLKREKREDKDKVEEMLRRLRELYRRLEEENRRILREIEELVKELEKRNREILKELEDLVKDAERKDKDGTERVRRLKEILERLKEEVRRSLEELRKEVERLKKEVEDSLRELKKSLEEWVKDLEEATR

SEQ ID NO: 12463 - protein, 180 aa, Artificial Sequence; identical to SEQ ID NO: 12462
  Synthetic

SEQ ID NO: 12464 - protein, 180 aa, Artificial Sequence
  Synthetic
SDLEAVLDEIKKLAEEAHKRNEEVDKESAKLVKEAHKVNEDVDKESAEIVKRIDEEKKEDRDKVRTMIRELKKKYEDVARRNKKILDELEEKYDRLRKDNDRILDEIRRKVEDVERKDKDGTERVKRLKDELRRLLKEVKDSLEELDRMLEEWKERVRRSLEELRKRAKEWEDKLRESLR

SEQ ID NO: 12465 - protein, 180 aa, Artificial Sequence; identical to SEQ ID NO: 12464
  Synthetic

SEQ ID NO: 12466 - protein, 180 aa, Artificial Sequence
  Synthetic
SELEDVLKKIRKLVRDAHEENKRVLEEIRKTVDEIRKELEDVDTKSAEIAERAKERKKDDKDKVRRLLEELEKLYRRLIEKVEDILRRIEEKVRDVERRNREILERLRELVERLAKEDKDGKERVERLRRELEKLVREVEESLKRLKEELDKIKEELRRILEELEEKLRRWSRELKETAR

SEQ ID NO: 12467 - protein, 180 aa, Artificial Sequence; identical to SEQ ID NO: 12466
  Synthetic

SEQ ID NO: 12468 - protein, 180 aa, Artificial Sequence
  Synthetic
SELEKVVEDLRRIVEEIERRLREVIKEIRELVRRAHERNKDVDRKSAEIVKDIEEKKKEDKDKVREMVRRLEELYRKLVEENEDILRRIEKKVRDAVETVERLIKEMRKIVEKVARDDKDGTERVERLKRALDELERRLKELVRELEDSLKKLADEVKRSLEELDKSLKDWKKKLDDELK

SEQ ID NO: 12469 - protein, 180 aa, Artificial Sequence; identical to SEQ ID NO: 12468
  Synthetic

SEQ ID NO: 12470 - protein, 180 aa, Artificial Sequence
  Synthetic
SEIERVLEEIKERVERADRKNEKVDRESAEKVKELHRRNEEVDRESAETVKRAERDKKDDRDKLRDVLRRLEERYKRLEDENKRLLKELRERYERLKKENKDILKKIRDDLRELARRDKDGTDKVREIRERVERLVKAVDESLERLERSLEEWARRLDKSLEDLKRSLKRWKEELDRKAQ

SEQ ID NO: 12471 - protein, 180 aa, Artificial Sequence; identical to SEQ ID NO: 12470
  Synthetic

SEQ ID NO: 12472 - protein, 180 aa, Artificial Sequence
  Synthetic
SELETLIKEATDLAEEVKEDLRRVDEESAKLVEDADDENKRVDEESAKIVEDLKREKKDDDEKVRRVLKELEDKYRRLAERNKRILDELDKLYKELAKRVKEVLDRIREKVKDVEREDKDGTERIRDLKEKVRRLMEDVKRLLEELERSLERWKEKVRDSLEKLKKSLEEWAKELKDTSK

SEQ ID NO: 12473 - protein, 180 aa, Artificial Sequence; identical to SEQ ID NO: 12472
  Synthetic

SEQ ID NO: 12474 - protein, 180 aa, Artificial Sequence
  Synthetic
KDLETVLEEIKRIVDDLDRRNKEVDKESAKLVKEADEKNKRVDEESAKIVKRLEREKKDDKDKVTEARRRLERTYREVDKDNKRILDELRRRYEELERRNEELLREIREKVERAAKKDKDGTDRVRRLREEVTKLLDEVRRSLDRLRESLKEWKERVDDSLRRLRDSLRKWKRKLEEATR

SEQ ID NO: 12475 - protein, 180 aa, Artificial Sequence; identical to SEQ ID NO: 12474
  Synthetic

SEQ ID NO: 12476 - protein, 180 aa, Artificial Sequence
  Synthetic
SELDDLLRRIRELVRRAEEDLKRVNEESARLVEEMDKDNKRVDEESAKIAEDLKREKKEDRDKVREVLKRLEDKYRELARRNKKILDELRKKYEDLIKKVRDIIREIDKRVKEVKDEDKDGTKKIEELKREVKKIADELERILKELEDSLREWSERVRKSLEELKDSLRRWAEELKRDLK

SEQ ID NO: 12477 - protein, 180 aa, Artificial Sequence; identical to SEQ ID NO: 12476
  Synthetic

SEQ ID NO: 12478 - protein, 180 aa, Artificial Sequence
  Synthetic
KDLERVVKEIERLVREAEKKIREVNDRSAKLARDLDRRNREVLKEIKKIAEDLEREKKEDEKAVRDLLREIRKKVEDVKETNERILRKLRKEYEELRREVKKILEEIEKLVRDVERKDKDGKERVERLKRELERLKRELEETLKRLDEELEKWEERVRESLKRLEDRVREILKRLEDDAR

SEQ ID NO: 12479 - protein, 180 aa, Artificial Sequence; identical to SEQ ID NO: 12478
  Synthetic

SEQ ID NO: 12480 - protein, 180 aa, Artificial Sequence
  Synthetic
DELETVMKRIRELAKELNKKNKDVLDEIEDLVRKADKRNKEVLKRIEEILREARKRKKDDKDRVREVLEEIKREVKKLERENEEILKRIEDTLRELERDNERILEEIRRLVEDAERKDKDGTERVKRLKDELRRLIEEVRRNLKRLKEEVDKIRERVRRSLKKLKEDVKRLSDEVKETLK

SEQ ID NO: 12481 - protein, 180 aa, Artificial Sequence; identical to SEQ ID NO: 12480
  Synthetic

SEQ ID NO: 12482 - protein, 182 aa, Artificial Sequence
  Synthetic
KEIEDLLRELRELVKEIDDLIKDATREIERLVKEVHDKNEKVTRRLEKLMRELREVARRGDLRDDDIRKAIREMEELSKEVEDTNRKVIEDLRRLSERLEEEVRKLIRRAEELVADIARKRGRDERIETLERALRELVRELEEKVDEHRKRTDKVARDLKKSVDDHRRRTEELVRELRKTEE

SEQ ID NO: 12483 - protein, 182 aa, Artificial Sequence; identical to SEQ ID NO: 12482
  Synthetic

SEQ ID NO: 12484 - protein, 182 aa, Artificial Sequence
  Synthetic
SELEDVLRRAKKLVEDVHRDNKRVTEELEKLARELHKKNEDVLRELKKLADDLREMLKRGDLREEDIKRVRTEIRKLLEDVRETNKRLIERIKDLSERVREINEEVIKEMEELLEDLRRRDGDDEKVKRLEEEIRRLARELRESVRRHKERTEELVERLKESLKKLEEDIRRLEKELEDDRR

SEQ ID NO: 12485 - protein, 182 aa, Artificial Sequence; identical to SEQ ID NO: 12484
  Synthetic

SEQ ID NO: 12486 - protein, 182 aa, Artificial Sequence
  Synthetic
SDLDDVLRRIRELAKRVHDENKRVTEELERLVEELEKKARELLRRIEELVRTLKEMRERGDARREEIEKVIEDIERLVRKIEDLIRKLIERARRLSEEVEDINRRVIEELRELVRELERRTGEDERVERLRRELEKLVKELEESVRRHKKRTRELEERLKDVLRELEDAVRRLVEELEKTDE

SEQ ID NO: 12487 - protein, 182 aa, Artificial Sequence; identical to SEQ ID NO: 12486
  Synthetic

SEQ ID NO: 12488 - protein, 182 aa, Artificial Sequence
  Synthetic
EEIERLLEEIKRLVETVHESNRRVLKELRDLAEELKRRNTKSNRDMERLVEELEEMRRRGDAREEVIRRVIEELKELLDRLHKDNRDAEREVERLVREVKRENDDVIRRIEELVEDLRRKRGEDEKVKTARDEVRRLVEELKESVERLARELKKLVDELRKVDEDNKRRLEELERRLRESTR

SEQ ID NO: 12489 - protein, 182 aa, Artificial Sequence; identical to SEQ ID NO: 12488
  Synthetic

SEQ ID NO: 12490 - protein, 182 aa, Artificial Sequence
  Synthetic
SELEDVLRKLEKLAREVDKINKDLIKRVEELARELKKKNEKSNKEARDLVKKLKEMKDRGDLRREDIDRVEKRLEKLLKELHEENKRVIDEIRKLLEEAEETNRRVIEEIKKLVKELEDRDGDDERVRRLKKEVEELERRLRRSVDDLRRKIKELEDRLREIDERNKREIEKLVKELRDTDR

SEQ ID NO: 12491 - protein, 182 aa, Artificial Sequence; identical to SEQ ID NO: 12490
  Synthetic

SEQ ID NO: 12492 - protein, 182 aa, Artificial Sequence
  Synthetic
DELETVAKLLEDLSRTNEDRLREVKETLKRLADTVDKINKEVLRRLRELAKRLKELKERGDLREEKIERVKEELERLVDKVRKENKEVDDEVRRLVDEVRKHSKRVIEELRKLVDDLRRRRGEDEDVRRLEEELRKLEERNRRLVRELEEVLKKLKDELKKSVDRLKEELDRLVKELDEIKK

SEQ ID NO: 12493 - protein, 182 aa, Artificial Sequence; identical to SEQ ID NO: 12492
  Synthetic

SEQ ID NO: 12494 - protein, 182 aa, Artificial Sequence
  Synthetic
SEIEDALRKMEKLAEDVNRKNEEVIREVRRLSEENKKKLDDVLETLKKLVRELAEMTKRGDIREEDIKRVIREAERLVKELDDHSKEVIKEIKERLRRVEEENKRVIDEIKKLVKEIVDKEGRDERIRTLEKAVRDLVRELEESVDRLRREADRLVEENERVVERLKRELKRLVEELERRAK

SEQ ID NO: 12495 - protein, 182 aa, Artificial Sequence; identical to SEQ ID NO: 12494
  Synthetic

SEQ ID NO: 12496 - protein, 182 aa, Artificial Sequence
  Synthetic
DELREVLERVKRLVDTVNKINDDLTKRNEDLSRKNVDKIRRLTEEIERLVEEVDRARREGRLREREIEKVIRRSKKLSEDLKKHSEDVIRESDELLKDAERVNREVIKEIEELVRDLERRRGRDEDVRRLEEEVRKLVEELRRSVEDHKRRNKESVDRNRRAVEEHERRNREVVERLERKAK

SEQ ID NO: 12497 - protein, 182 aa, Artificial Sequence; identical to SEQ ID NO: 12496
  Synthetic

SEQ ID NO: 12498 - protein, 182 aa, Artificial Sequence
  Synthetic
SDIEEALKTMEELSRRNEETLRRVLKRLKELADEVNRKNERVLEEAKELADRLRELRERGDLRKEDIDRVIREIERLVKEVADTNKKVIEEVKRLVERLEEHSREVIRRLEELLRDIRRKKGDDERIKTLEEDLRRLVEENKKVVEELKRRLKKLVDELRESLKELEKAVRKLVKELRDDEK

SEQ ID NO: 12499 - protein, 182 aa, Artificial Sequence; identical to SEQ ID NO: 12498
  Synthetic

SEQ ID NO: 12500 - protein, 177 aa, Artificial Sequence
  Synthetic
SSKETVAKRVEDVKRELEEVLKELARESKRLSDRDKKLNEEAAEEIERLKDELRKKVRDKDTLEEVLRRLEELLRRLNEHSRDVIRRSEDSLRKAADFVRRLKETADKLLEELKRVDDDEVLERIVKRVRDLVEEIKRRLEKLAEDNRRLSKRNEDVIRTLLEEARKLVEKVKEEVR

SEQ ID NO: 12501 - protein, 177 aa, Artificial Sequence; identical to SEQ ID NO: 12500
  Synthetic

SEQ ID NO: 12502 - protein, 177 aa, Artificial Sequence
  Synthetic
RSKEEVAKEIKRLKEENKRLLDELAKRSEELERRDRRLNEEHHREIRRLTDELRKKVRDEDTLREVEERVRKIDEDVNRHSEEVIRESRESLKRVADHSRKVVEDLERLLEEAKRVDDDRVLKEIVDEARRLSERNEEVLRRLLKENEDLSKRNEDFIRKTMKELRDLAEEVKERAK

SEQ ID NO: 12503 - protein, 177 aa, Artificial Sequence; identical to SEQ ID NO: 12502
  Synthetic

SEQ ID NO: 12504 - protein, 177 aa, Artificial Sequence
  Synthetic
KSKEDVKREIERLKKENREVLDTARKRIEDLIREDERVNREAAEEIKRLVEELERRVRDREELRKVTEELKKLLEDLNRHSEEVIRTLRKLLDDLRKHSEEVERRLEKLLEELKRVEDDRVLKEIVEELRRLSEENKRRIERALEELEKLSKDNTDRIEEAREDLRRLVRELLEKEQ

SEQ ID NO: 12505 - protein, 177 aa, Artificial Sequence; identical to SEQ ID NO: 12504
  Synthetic

SEQ ID NO: 12506 - protein, 177 aa, Artificial Sequence
  Synthetic
KDEEEVAKEIERLKEENDRVLKEAADKIEKLKKENREVNTRAAEEIERLKKELREKVRDKDLLRKLEEELRRLLEELKEHSERVERELEKLLEDLARHSEDVKRRLDEILEELKRVRDSRVLEEVVRRLRKLSEENKKRIKEMLDDVERLSRRNEEKIRRVLEDARRLLEDLTRKAK

SEQ ID NO: 12507 - protein, 177 aa, Artificial Sequence; identical to SEQ ID NO: 12506
  Synthetic

SEQ ID NO: 12508 - protein, 177 aa, Artificial Sequence
  Synthetic
SEKETVAEEIRRLIEKNKKMLEDHTRDIRRLEKENDDVNRKHHEDIRRLKDRLRKEVRSEETLRDLTKKVEEIDEEIKRHSEEIKRRLREINKELKEHSDRVVERLRKLLEDAKRVDDSRVLKEIVDEARELSKRNEDKIRKSLEELKRLSERNKKKIEDTLKELRKLAEEVKRRAT

SEQ ID NO: 12509 - protein, 177 aa, Artificial Sequence; identical to SEQ ID NO: 12508
  Synthetic

SEQ ID NO: 12510 - protein, 177 aa, Artificial Sequence
  Synthetic
SEKERVADDIRKLEEENKEVLDRAAEEIKRLKKRDRELNKRHHKTIRDLVDELEKKVRDEETLRRVKERMREIDERVKESSKRVEDELEKLLEELKRHSEEVVRRLRELLERLKRVDDSRVLDEIVKEARDLSEENRKLIEEALERLRRLSRENEETIKKTMEELKRLVEEVKERAR

SEQ ID NO: 12511 - protein, 177 aa, Artificial Sequence; identical to SEQ ID NO: 12510
  Synthetic

SEQ ID NO: 12512 - protein, 177 aa, Artificial Sequence
  Synthetic
KSKEEVADKIRKLKEENRKVLERHTREIEKLKRDDEEANKKHHEDVKEVMKRLEKEVRDKDTLEKVKREAKKIDEDLRKSSEEVMRTLDEINKDVARHSKEVAERLEELLERLKRVDDDRVLEEIVREAEELSKRNKDRIDESLKELRKLSEDNKREIERTLEEIKRLAEEVRRRDT

SEQ ID NO: 12513 - protein, 177 aa, Artificial Sequence; identical to SEQ ID NO: 12512
  Synthetic

SEQ ID NO: 12514 - protein, 177 aa, Artificial Sequence
  Synthetic
SSKERLKEMIDRLKERNKDLLRKAAEEIKRLEDEDREVNRRHHEEIERLKKELREKVRDKDTLKELEERVEKIDEDVKRNSKRVVETLRELLKRLADHSKRVLEELDRLLEELKRVDDDRALDEIIKEAKKLSDDNERLIRDVLRRARDLSRRNKETIRRTLEKLKREAEKVKEDAR

SEQ ID NO: 12515 - protein, 177 aa, Artificial Sequence; identical to SEQ ID NO: 12514
  Synthetic

SEQ ID NO: 12516 - protein, 185 aa, Artificial Sequence
  Synthetic
SDADRIIEEARRLSEENKRRIEEVLKRNRKLSKENHDKNDELLKRVRELLRRVVERLRREEGREEIKKLVEELEKELDKILEESRRSTEEVKDESRRLLEEIRRSTKEVKKTLDDLLRKVRERVRDKDKLKRLEDEVRKLTDENRRVTEKAERDLRRSNRENDRSTERLEEEIRRIKKRLRDEAR

SEQ ID NO: 12517 - protein, 185 aa, Artificial Sequence; identical to SEQ ID NO: 12516
  Synthetic

SEQ ID NO: 12518 - protein, 185 aa, Artificial Sequence
  Synthetic
REAEDLIRRLRELVRRHHELNRKLAEELRKLSEENKRKIEKVTREVEKLVKDVADTLKDDRGDERLERLVKELKDRLDELVKEIERSTREVERRMREVLKRSRDSAREVEERVERLLEEVRRRVRDKDKLKRLEEELERLKEEVRKSNRDLEKEVRDLRKENEKVTEEVKKRIEDLKRKLDEDRR

SEQ ID NO: 12519 - protein, 185 aa, Artificial Sequence; identical to SEQ ID NO: 12518
  Synthetic

SEQ ID NO: 12520 - protein, 185 aa, Artificial Sequence
  Synthetic
SEVDKIIKDARDLLKEHHEKNKRLIEENRRLSEENKDRIRRALEKLKKLVDDLRRLIEEVDDRDTLRELVRRVERTLDELLKDIERSTDEVRRESERLLEESRRSAEEVKRRLDELLKEVRRRVRDKKKLDELETEVRRIKETIDRSNERLERELEKSNRENKKVTDDAREVVKKLKEEIKRDED

SEQ ID NO: 12521 - protein, 185 aa, Artificial Sequence; identical to SEQ ID NO: 12520
  Synthetic

SEQ ID NO: 12522 - protein, 185 aa, Artificial Sequence
  Synthetic
SEADEIIKEAKKLADDHHRLNKEIIERNKRLSEENHKLNEKIIEDVRRLVKDVAERLKRDEDRRDLDRLVDEVREELRRLLEESERSTEDVKRESKRLLDESKKSAEDVKRDLDRLLKEVEEKVRDKEKLDRLREKVEEIKRRVDKSNDELRRSMEESNKRNDESTDRLREELRRLDEELDRRRK

SEQ ID NO: 12523 - protein, 185 aa, Artificial Sequence; identical to SEQ ID NO: 12522
  Synthetic

SEQ ID NO: 12524 - protein, 185 aa, Artificial Sequence
  Synthetic
SDLERVLKELRELVRRHHELNKDIIRRARRLSEENEKDIKKLLDDARKLLEEVKRTLDRMEGKEEVDKLIEELERRLDKLTKRLEDSSRDVKRRLRELLKRSEESAREVKKTIRKLEKELTERVRDKKKLDEARTELRKLEEEVDKSNKELRDEVEKLERRNDELLERAREEVERLKEELRRKAT

SEQ ID NO: 12525 - protein, 185 aa, Artificial Sequence; identical to SEQ ID NO: 12524
  Synthetic

SEQ ID NO: 12526 - protein, 185 aa, Artificial Sequence
  Synthetic
SKAERIIEEVRRLSEDNKRRIKKLLDEAKELLDRHHKRNKELLEEIERLLREVKERLKKDRGRDRIRRLVEEAKKRLDEVLEDSKRSARELKKTLDELLKRLEKSSEDVERRLRKLEDDVRREVRDKDRLEELRRDLERLRKENKDVLDRVREDIKRLKEELDDSNRRLKDTIEDLKRELDEEAR

SEQ ID NO: 12527 - protein, 185 aa, Artificial Sequence; identical to SEQ ID NO: 12526
  Synthetic

SEQ ID NO: 12528 - protein, 184 aa, Artificial Sequence
  Synthetic
SEVEELVKDLKRILDEIKRTNDELNKELKRLSDESRKLSKENIDRLRRILEEIEKTIRRRKTEEVKRRIEELVERMRRSSEEVVRRIEKLNEEANRKVEKVKRENKELLERAERKVREVAKRIKDEEKVRKLEKLLEDIKRTVDKIIRESEKRAEEINRDNRRIIEENKKKLEEIARRVEELAR

SEQ ID NO: 12529 - protein, 184 aa, Artificial Sequence; identical to SEQ ID NO: 12528
  Synthetic

SEQ ID NO: 12530 - protein, 182 aa, Artificial Sequence
  Synthetic
SSIEELAKRLEDLIRELRDRHRRLNEELKELTDRNRKEIEEANERIKRLIDDLERLRRRGDIDEKRIREIIKRIRELSKEIEKRSEKIIRELERLVEELAKETEDIIRRARELVEAIRKERGDNEEIDKLRRELERLEEELKKVLDRTREELERLVRDNRRLNKEHKDHSDTLVRRLEESRK

SEQ ID NO: 12531 - protein, 182 aa, Artificial Sequence; identical to SEQ ID NO: 12530
  Synthetic

SEQ ID NO: 12532 - protein, 186 aa, Artificial Sequence
  Synthetic
SEVEDLIRDLERLLKEHDELNKRSMEELEKLLKDLEKMVRDSLREAREIAERVKETIKRTSDKEDLRRRLKKVKDDLDESHKDLARLLKEIEERIDRILRENERHLEEIKREIKKILEELERAKKGEEKKLDEARKVLEEIKKRLEDSLRRLREEAERIKRELKRILDEHRKEIERIKKEIDEAAR

SEQ ID NO: 12533 - protein, 186 aa, Artificial Sequence; identical to SEQ ID NO: 12532
  Synthetic

SEQ ID NO: 12534 - protein, 186 aa, Artificial Sequence
  Synthetic
SEIEKVLRDVEKLVREHEDLNKKSAEEAERLTRDNKRRVDESKKRIREILKEVDEIIRRTERKEDLERKLTEVRRRIDKSHKELKEHSDEVVKRLKEILDRNAEHLEEIERRIDKILDDVRKRKQGDDKDLRRLAEEAERIKKRLRDSLDELRKIIEELEERNRRINEDHRRDLEDVKRRIEEKSK

SEQ ID NO: 12535 - protein, 186 aa, Artificial Sequence; identical to SEQ ID NO: 12534
  Synthetic

SEQ ID NO: 12536 - protein, 186 aa, Artificial Sequence
  Synthetic
SEIEEVARRAEKLTKENEELIRRSLRDIERLVKEMEDIVRKSLKEIKELVERLKDISRKTSRKEDLRRIIEDIKRKIEESHKRLAELLRDIVRKIRESHERVNKHSKEVMERLDRLLEEVEKAKKGEDEKLRRLAKRIEELKKRNEDLNREHRKRLEEAEKRLKDVLDEHRRRLEEVKKELDEEAK

SEQ ID NO: 12537 - protein, 186 aa, Artificial Sequence; identical to SEQ ID NO: 12536
  Synthetic

SEQ ID NO: 12538 - protein, 186 aa, Artificial Sequence
  Synthetic
DEIERVLEEIKKLTDDNRKLVKESIDRAEELLKRHEEENKKSVERARKLVRDLDEIRRKTDRKEDLRRIIKEVREELKKILKENADHAREIMRRLEESHKRLNEHSKRVVEEIRRLLEEVKKAKKGDKKKLDELARRAEDMERDNKRINKEHRERIKEIKERIKESLDRLAEEIKKIEKELEDKAR

SEQ ID NO: 12539 - protein, 186 aa, Artificial Sequence; identical to SEQ ID NO: 12538
  Synthetic

SEQ ID NO: 12540 - protein, 186 aa, Artificial Sequence
  Synthetic
SEIEKVLEDAKKLTKENEDLIRKSLEDNERLLRRHEEENKKSAEDMRDLLRRLEDIIRKTSRKEDLERIIREVIETIRRILKRNAEHAEEVIERSRRSHEEVNRHSKEVIDTLRKLLEEVREAKRGSEELLERLAREIKKLIDKNRKLNEDHRRESEKSERRLRESLRKLAEEAERIEREMDKSRK

SEQ ID NO: 12541 - protein, 186 aa, Artificial Sequence; identical to SEQ ID NO: 12540
  Synthetic

SEQ ID NO: 12542 - protein, 184 aa, Artificial Sequence
  Synthetic
SKIEKIVRDAERLLDELRKLAEDVLRRLEELNRRAEDVIRRLAEENTELLKRLEDLLETEKTADEKLKRAVEKLEKASEESVDRLRRLIEELKKEHKRLLEELERVVKKVDDDLKRLTKEIEGTDKKKAEELKRKAEEIKRRIDKIVDEVRKAIRDSAEHLKRLLEEYRRRVEEVKKRVRDAAK

SEQ ID NO: 12543 - protein, 184 aa, Artificial Sequence; identical to SEQ ID NO: 12542
  Synthetic

SEQ ID NO: 12544 - protein, 190 aa, Artificial Sequence
  Synthetic
DELERLREEVKRLSEENKELIKEMEKRNRELSKENEKVNRELKKRVDDIIRTLKELRKEGRDEETLTRMLDRVRKELKRLKEENKKILEDLRRRSEELARRLERADEELKKRLEDLARDLKRKLKDGDEKEEREIRRVLEDIKRIADENERENREALKRLEETNKRNTDHNRDVLREIDKLFREVAEELR

SEQ ID NO: 12545 - protein, 190 aa, Artificial Sequence; identical to SEQ ID NO: 12544
  Synthetic

SEQ ID NO: 12546 - protein, 180 aa, Artificial Sequence
  Synthetic
SEKEEVIKRIREELKENEKENRDVIRKIRELLDELRRRVEEVLRRLKKSNEDIEREAEKKPRTEELKKLLDEVKERSKELTERLREALKEAAKVVERVVEEIKRINDELRKRIERLEEKLDEVREEELKERIKKLSKENKDRVRRMLERIKKLVDDLRRLLEELRRRNEKLLDRLRKAIK

SEQ ID NO: 12547 - protein, 180 aa, Artificial Sequence; identical to SEQ ID NO: 12546
  Synthetic

SEQ ID NO: 12548 - protein, 180 aa, Artificial Sequence
  Synthetic
KDEEKVIEDIRRILEENHRENKEVIDKIRELLRRNEEENKEAIRRMRKSNKEITDRAEEKPQTEDLRRLIKEAKDESDKIIRRLEELNKRLRDAVRELEKKIKEINKELKRRIEELERRLDKIRREELERRVRELSKENKEMLKRVEDKIRELSERNKRTVKKVREDNERLIRRLEEEDK

SEQ ID NO: 12549 - protein, 180 aa, Artificial Sequence; identical to SEQ ID NO: 12548
  Synthetic

SEQ ID NO: 12550 - protein, 188 aa, Artificial Sequence
  Synthetic
SELERIEEDVERLNRRNEETLKRIDEALKRLEKSNKELDEKLEETVKRIKDRVERVKRRNVDEEDLRRLDEEIERTLRELKKELDEHLRRVEDTLRRLKTESRRLLKEIKDRLEEIEKEEADGNLPDKAKREVDKVRTDAREILKENKRRNEDVIRKIEEKVRDLERRNRDLLRRVKTKIDRLREELK

SEQ ID NO: 12551 - protein, 188 aa, Artificial Sequence; identical to SEQ ID NO: 12550
  Synthetic

SEQ ID NO: 12552 - protein, 186 aa, Artificial Sequence
  Synthetic
KELEDIARRVDELNKRNEELIKDAKRVLKEASDKNKEMNERVDDKLRRLAKKVKELTGTSEEMVERLKRELETVKEKIRKESREILEELKEVLKDLERRMRKLEEENKTVLREIEERLRKRNGGKEERDKIRDLLRRIREKIEKNRKDAEDVLREIKKLIDENKKRNEEVLKKIEELLRELEKRLE

SEQ ID NO: 12553 - protein, 186 aa, Artificial Sequence; identical to SEQ ID NO: 12552
  Synthetic

SEQ ID NO: 12554 - protein, 182 aa, Artificial Sequence
  Synthetic
SRLEKVIKEIKKTHEELERRFKKNSDEAEESLKRLEDELRKVVTDIERKLRDLERRVREAGRRREELEKLAEDLKETIERLRKEVKELMDRHRDVNREIEERLRRLARENEERLRKADEKPRSEELITRLKKHVDDTAREVEELIKRHTEHNEKLRRDIKKLLEELKRKVDELRKEIETRTR

SEQ ID NO: 12555 - protein, 182 aa, Artificial Sequence; identical to SEQ ID NO: 12554
  Synthetic

SEQ ID NO: 12556 - protein, 181 aa, Artificial Sequence
  Synthetic
SELEELIKRAEDTIRRLEREIDELIERHRRSAERLRETLKELIDRHRKSIEDVMRELKRRRGRVPDEVKRTLEKSKRDLDRLAEELEKTLKESEEELKRLKDRLKETLDKLREDLKELAKRGRTGKEEIERLIKELEKKIKEVVKRIRDIDEDLKRKAKKVVDDLRELNERLERKAKEATK

SEQ ID NO: 12557 - protein, 181 aa, Artificial Sequence; identical to SEQ ID NO: 12556
  Synthetic

SEQ ID NO: 12558 - protein, 185 aa, Artificial Sequence
  Synthetic
SEEERLRDHSRRVEELARRAAEKLRRHSEDVKRLITELIKLIEDVMKKIEDEVRDAEKRGDTDETLVKRIEELVTRLEKTLRDMTREIRRSHKELEDTVRRLVEELKRSNKELKKEIDEGDLRDELKKRIDELHKRNKDKLDEISERLKRLLEENRKLIKEVEERLRKLLEDLRKLIEDVKRRLR

SEQ ID NO: 12559 - protein, 185 aa, Artificial Sequence; identical to SEQ ID NO: 12558
  Synthetic

SEQ ID NO: 12560 - protein, 185 aa, Artificial Sequence
  Synthetic
DFEEEIRRNLKRVRDLAKKLEDLIRKHSEEVKRLAEEVKREIEEVIKRAKKKMEDVRRDGDNDETLLRELERTLRELERKLRELSERLRRSNEKLKRDLKRVRDDLKRSHDDLERRIREGDLRDELKKRADRLLDEHREELKRIEDRLRELLERNNRLLEDIDRRLKELLEDLRRVLKEIEEELR

SEQ ID NO: 12561 - protein, 185 aa, Artificial Sequence; identical to SEQ ID NO: 12560
  Synthetic

SEQ ID NO: 12562 - protein, 186 aa, Artificial Sequence
  Synthetic
SEVERLLEDLRRLAKESDESLKKSHRELRKRHEEVRRTIEELLKDLERTVKEIKEELERDVKDEKKLKELEDRLRELIERLRELMKRLTDESRRNLEEDKRLLEEYREALKKLEEELKELRRAGLPEEDVRREIKRVLDTIRKLNEDWKRRNEESKRRLDKLLDDAKKAIDKIVEDVKKLLEDARR

SEQ ID NO: 12563 - protein, 186 aa, Artificial Sequence; identical to SEQ ID NO: 12562
  Synthetic

SEQ ID NO: 12564 - protein, 186 aa, Artificial Sequence
  Synthetic
SEVEKLLRDLERLARRVREELRKSHEKLDKLARDSKKSIEDLLEDLRRIIEEIEEELDRRVRDKDKLKRARDELRRLIDELRKIVEKYEEELKRLKKEDRDTLKDVDDKLRDLRRRLKKLREDGLPREDVEREVRRIKREIKELLDRWRRANEEIAREIRKLNEEVKRRVEKILRDLEELLRRLRK

SEQ ID NO: 12565 - protein, 186 aa, Artificial Sequence; identical to SEQ ID NO: 12564
  Synthetic

SEQ ID NO: 12566 - protein, 184 aa, Artificial Sequence
  Synthetic
SELEKLEKELKDLLDKIRRDLEKSLKENDELVKKIEEDLKDLLKKLDDRLEKVARDLKREKSGREKELEDLRRELEKIKEELKDELRRLKDENRKSKEDNERILKKLEDELREIERRLREAKIERETATKRVKEVLDKLRKMLEDLRRHNEENKRRNKEVLDELRKKAEDVLRRIDEALKELKR

SEQ ID NO: 12567 - protein, 184 aa, Artificial Sequence; identical to SEQ ID NO: 12566
  Synthetic

SEQ ID NO: 12568 - protein, 183 aa, Artificial Sequence
  Synthetic
SVEEMETRLKEVADDLKKKIDEVLTRLEKLNRELTKRSRDMNRELERLNKEAEDRARDVLKRVDKDTLKRELEELKKHVKEVKDRSREIEEKLRRHLDEVRKRVEELKRRLDDTLRRLRERQVDRDEARKLLRDLERLIEEIKKTLDELLKHHKEELDRIDREHEELLRHHKKTLERIEEKID

SEQ ID NO: 12569 - protein, 183 aa, Artificial Sequence; identical to SEQ ID NO: 12568
  Synthetic

SEQ ID NO: 12570 - protein, 176 aa, Artificial Sequence
  Synthetic
DRVEKVLREIEKRLRDHRKRLKDALDEIRKRIEEHEEKSERLNRESKKLLKDLEDMKRRGDLDEDTVRRLEEENKKLLDELDKHLKRLKEEIEKLLRDLNRHLEKLKEDIKRLEDEVNIDEEVVRRARELVKRLEEDHRRMVEEIRRTIKRAEERHKKSVEDNEKLLRDLRDRLEK

SEQ ID NO: 12571 - protein, 176 aa, Artificial Sequence; identical to SEQ ID NO: 12570
  Synthetic

SEQ ID NO: 12572 - protein, 176 aa, Artificial Sequence
  Synthetic
SEVEKVLEDLKRLLDEHEKRSRELNKRSKKLADEARRINEELLRELKKLLDELKELKDRGDLDERTVEELRKTAEDINRRNKEMLKKLSDENEKLLDELNKHLEELERRVRELERDANVDKKFLDDMRRLLEELKERHERSERENRKLLRKLEEDSKRTNDESKKLLDKLRDDLEK

SEQ ID NO: 12573 - protein, 176 aa, Artificial Sequence; identical to SEQ ID NO: 12572
  Synthetic

SEQ ID NO: 12574 - protein, 176 aa, Artificial Sequence
  Synthetic
DRVEEVLKRVEELVKRHDERLKELEDDLRRLIEEHLEKSRRLNKESEKLLKEILEVKRRGEADEKVAEDVERRNEKLLRELNEHLERLERTAKKILEEIDDHLRRLEEEIERLKRELNLSEEVVKTIDEIVKELRKRHEEVRKRLKELLDEMRERHERSVRRNRERLEKLLDDLRK

SEQ ID NO: 12575 - protein, 176 aa, Artificial Sequence; identical to SEQ ID NO: 12574
  Synthetic

SEQ ID NO: 12576 - protein, 176 aa, Artificial Sequence
  Synthetic
SEVERVLRDVERLLEEHRKKSKEANDTSRELARRHKEESDRLNKKSEDDARRLEDVKRRGEVDEEKLKELSKRNKKLLDDLNRHLEKLKEDNERLLRELDEHLRRLEETIKKLERDVNIDEDMVRRIREIVKKLKRDHEKSVEDNRRLLRELEERHRESVERNEDLLRRLEERARK

SEQ ID NO: 12577 - protein, 176 aa, Artificial Sequence; identical to SEQ ID NO: 12576
  Synthetic

SEQ ID NO: 12578 - protein, 176 aa, Artificial Sequence
  Synthetic
DEVETVLRDLKRLLDEHRRRSEELNKRSEELLREHEERSKRLNERSEKLARELREMKKRGEVDEETVKDLARENEELLRRLDKHLEDLERENKRLLRDLDRHLEELKKTVEDLKRRANVSEEFVKRMDELLRKLEEDHRRSVRENEKLLEELRRRHKKSVDDNRRLLEKLKRDADR

SEQ ID NO: 12579 - protein, 176 aa, Artificial Sequence; identical to SEQ ID NO: 12578
  Synthetic

SEQ ID NO: 12580 - protein, 176 aa, Artificial Sequence
  Synthetic
DEVEEVLRRIEELLTRHRKKSDDLNRRSEELAERHERTNRTLLEELRDLAKKLEDLKREGKLDERTVEELKKRAEKINRENKKHNDELRERNKRLLRELDKHMRELEERIRKLEKDVKVDEEVVKRMRDLVRRAKEEHKKSVDDNRRTLKELHDRSKKTNDDSRELLKRLEDRLRK

SEQ ID NO: 12581 - protein, 176 aa, Artificial Sequence; identical to SEQ ID NO: 12580
  Synthetic

SEQ ID NO: 12582 - protein, 176 aa, Artificial Sequence
  Synthetic
REAEEVLERIRRRLEEHLEDNERILREIKKRLDEHREKSKRVNDRSRELVERLLAVKREGKVDEEKVERLKKENEDLLRELDKHLEELKRRIRKLHEDNRRHNKELEDEIRRLEREANLSEDIVREIRRIVRELHERSKDSNREVERLVRKLEDDHRESVERNRELLKKLEDDLRR

SEQ ID NO: 12583 - protein, 176 aa, Artificial Sequence; identical to SEQ ID NO: 12582
  Synthetic

SEQ ID NO: 12584 - protein, 180 aa, Artificial Sequence
  Synthetic
RLEDVLREVREDLRRLNEESRKVLEENDKLDKDLNRRLKRLEEEARTEIKKVKDRLRDDEELKRLEKELEKILDRLRREVRKLNERNREELERLDKADKDINRELKRIEDEVKKLKERVDEDELEKRLTEVRKELEDRYRELIERSKDIIRRLEEEVRKLEKELRKVLEDLDRRAREATR

SEQ ID NO: 12585 - protein, 180 aa, Artificial Sequence; identical to SEQ ID NO: 12584
  Synthetic

SEQ ID NO: 12586 - protein, 177 aa, Artificial Sequence
  Synthetic
SEREDIKRLIEEIRKLVDEAAKEIERNIEEIRRLVKELEELSKKHIDEAREILERLKRRDDKKTIDEATERLRRSHKRLEERIREVKKRIDESHEKLREDLETLIREIRKLLRELRERTGDTELVEEMERDVREVERALRRLLDKHRRVLEDVERRLRRALEENRRVLEEIEEDSRR

SEQ ID NO: 12587 - protein, 177 aa, Artificial Sequence; identical to SEQ ID NO: 12586
  Synthetic

SEQ ID NO: 12588 - protein, 181 aa, Artificial Sequence
  Synthetic
KDEEATKKLRKAHEDSERHIKKLSEDTKKVHEESDRHIRKVSKETEDEARRIEKELRKLPDREELRDVMRRLKELLKTLREENERVRKRSEDLLRELEKRNKEVADESRKLLRDVEEALERGEVDEDTLEKIIEENKRLNDELAKENKEVIKENRKLNRELEERNKEVIDRMERILEETKR

SEQ ID NO: 12589 - protein, 181 aa, Artificial Sequence; identical to SEQ ID NO: 12588
  Synthetic

SEQ ID NO: 12590 - protein, 181 aa, Artificial Sequence
  Synthetic
REEELKREMEKAHEESERHLEELSRKTRDVHRRSEEHLKRLHERTKEVVDRIVEELRRLPKTDELRKVIEELERLLRTLKKENEDVRRESEELLKRLEEENKRVLKESRDLVRKVEEALRRGEVDEETLRRVIEKNRKLNEDIAKRNEEVIETNKKLNEEIARRNEEAIKTARKIVEDTKR

SEQ ID NO: 12591 - protein, 181 aa, Artificial Sequence; identical to SEQ ID NO: 12590
  Synthetic

SEQ ID NO: 12592 - protein, 181 aa, Artificial Sequence
  Synthetic
REKEVVDRLREEVRRVEEEVDRLNKELEEIARKVERELDKINEDYKRRLDKVREDIKRLPKTDELRTVEKRSDDHARELHKRSEEIKRDIRRRLKELHDRSREIKKTIRDLLRELEEMMRRGDVDEETVKRILETARELLDRWKKEVDEIVKTLEELLDRWRKEVERVKRENDKLLEELEK

SEQ ID NO: 12593 - protein, 181 aa, Artificial Sequence; identical to SEQ ID NO: 12592
  Synthetic

SEQ ID NO: 12594 - protein, 181 aa, Artificial Sequence
  Synthetic
DEKKVLDDLRRIVEKVKRDLDELLKDNRRVLREVEEELKRLNEELRRIAEEVTRELRRLPRTRELERIEKEIERRLKELHERSDELRRRLRKLHDELREKLERLKKRMEDLLRTLKDLVDKGDVDEKLAEEVARELRRLLREAEETSRDTKRKLREVLREWRELVKKIVDEMRRLLEEIKR

SEQ ID NO: 12595 - protein, 181 aa, Artificial Sequence; identical to SEQ ID NO: 12594
  Synthetic

SEQ ID NO: 12596 - protein, 179 aa, Artificial Sequence
  Synthetic
DLERLVEEIKRRLRELLKELHKKSKEIEEEIRRILKRHHELLERIVRRLEELVEEVKRRNSDDDTVKKRVKEEIDRLLEDYKRHLEEVERLLRKLLREYEEKVKEIEKEIRKLKKRLEEAGVDKKLLEDLEREIEKVKKAARDDLRRLEEIVRDVERRLRENVKRLKEEADRVKEELEK

SEQ ID NO: 12597 - protein, 179 aa, Artificial Sequence; identical to SEQ ID NO: 12596
  Synthetic

SEQ ID NO: 12598 - protein, 186 aa, Artificial Sequence
  Synthetic
EELERIKDEIRRILEELKREMEELTKESDRILRELERENEESAKRIKEILDELEKRVRDKPVDEKLKRELEELKERLKKLLKEVEDTTRKLKRELKELNRELRRRLEELEKRLRELLKKVDRDKSDDETLLRRLRESLEKLAKEVEDLLRKYERDVRELAKEDRKLNEELLKRVDDLAKEVRERLR

SEQ ID NO: 12599 - protein, 186 aa, Artificial Sequence; identical to SEQ ID NO: 12598
  Synthetic

SEQ ID NO: 12600 - protein, 182 aa, Artificial Sequence
  Synthetic
SKLEEIERELRELERSNEEEDRKWDDTTRKLEEDNREKNREWKKLTKDIRERVERLIRDLKDDKKTVRELRKEIRERSEKVRKELERHLEEVKDASRKLKKRLDDHRRELRDTVRRIRERLDKSEEARRLDEELEKVLRELKKRNEDTERRDREVNKKLEKENRDSEKENRDVLREIERALR

SEQ ID NO: 12601 - protein, 182 aa, Artificial Sequence; identical to SEQ ID NO: 12600
  Synthetic

SEQ ID NO: 12602 - protein, 179 aa, Artificial Sequence
  Synthetic
KKLEDLEEEIKKLLEELKERNERSAREDREILERLRDENRRTAEELDKSVREILKKTGDTEDLKKLKEEHKELKKRLKETTDRIRKTSKDLEKELRDATERIARELKRLVDDLRRKNLEDDRKLKEVRDTLEKLREENRKLNEEWRRKSEELRRRNEKVNKEVRDRNRETIERVDRKAK

SEQ ID NO: 12603 - protein, 179 aa, Artificial Sequence; identical to SEQ ID NO: 12602
  Synthetic

SEQ ID NO: 12604 - protein, 186 aa, Artificial Sequence
  Synthetic
EELERADRRLDRLLEESERDLDTIIRKLKKVVEELERTLEEAKRKAERTLEEIRRELKEAGLEERRLRELEEKLRRAEEELRKLEEDHRRRLKEVTDEVRRLIERHRRRLEEIKRRLEDLRRKGEPVEDLLREIKELLDDLRRHNEKLHRELEELIKTLRRHNEKLLEDIERLLRELRKEVEKLRR

SEQ ID NO: 12605 - protein, 186 aa, Artificial Sequence; identical to SEQ ID NO: 12604
  Synthetic

SEQ ID NO: 12606 - protein, 186 aa, Artificial Sequence
  Synthetic
DELRELRRELRKLLEDIRRRLEELTRENRDVLRKSREELERLLRRLKELLDRIRDSLRKRNGDEDKKRELEKVEREIEKLLRDLKRDLERLEKESEDSLRELEKELKRIEDEIKKLLEDAERLLERGEVDKDKMKKLLRDLERKLKRAEEESKRHIRENEKLTEEAARKVEELLKEIKRKLEELEK

SEQ ID NO: 12607 - protein, 186 aa, Artificial Sequence; identical to SEQ ID NO: 12606
  Synthetic

SEQ ID NO: 12608 - protein, 172 aa, Artificial Sequence
  Synthetic
SVEDTIRELEKRIRDLNREMERLNRESVEKIKRLNEKVRREIEDILREIKRLAENLKDVDERDLERLLKELRDELERLSRDSERELKRLEEEHRRARKKSEEDLRRLDKEVKDKPIDESLRRKLKKLADEHRETVDRMHEKNRKLADDHRDSVRKLEERIKRLTDRLREERK

SEQ ID NO: 12609 - protein, 172 aa, Artificial Sequence; identical to SEQ ID NO: 12608
  Synthetic

SEQ ID NO: 12610 - protein, 172 aa, Artificial Sequence
  Synthetic
SEVEETLKRLEEVIREAEKTIDDSNREIEEAVRRIKTTIEKSNRDLKDLVEKLKRLKEIDSEEVKRRLDEAAKRHKEILDDLRRKLEELEKRHRDTLKRLRERLDRIREEIERRGTTEDVRRRVKEIIDKLERKIEESERNLKRIIEDLEREMRESEERVKEIIRDLERTEK

SEQ ID NO: 12611 - protein, 172 aa, Artificial Sequence; identical to SEQ ID NO: 12610
  Synthetic

SEQ ID NO: 12612 - protein, 179 aa, Artificial Sequence
  Synthetic
SEIDEVLKRVEDSVREIERKLEEIERRLRRLNEEVKKRLDEIEEEIRRLVEELRRRNTKDERALRRIEEKIRDLKRKLDEILKKLKEDYERLKRELDKLLREHEERSERIKEELKKRGLPDDRLREIEKRIDDLNKKVRDEVERLKREADKSLETIKRLVEELKEKLDRLLEEVREEVR

SEQ ID NO: 12613 - protein, 179 aa, Artificial Sequence; identical to SEQ ID NO: 12612
  Synthetic

SEQ ID NO: 12614 - protein, 175 aa, Artificial Sequence
  Synthetic
STRERLKKVLRDVERANKELSDRNKRVLEKLRRDVERLSRENEKLVRELEEAIKDLRRKGRDLREEVERLSDEDRRANEELKRRLKKLEDDLDRIDRDLERKSRRLVEELEDLLRRLNVDEDLRREVEEVLKRIRDSNRDNRRKNEKVKKDIREILRRNEKRNREVNEKIRRDET

SEQ ID NO: 12615 - protein, 175 aa, Artificial Sequence; identical to SEQ ID NO: 12614
  Synthetic

SEQ ID NO: 12616 - protein, 185 aa, Artificial Sequence
  Synthetic
KETEEVKDVLRRVRKRIEDLSKKNKDDLRRVEERNKELNERVKRLLEELKRRVDDLKRKGRREDDLTREVEKLERELEEVLRRMREETRKLEDEIRRLNEELDRRLKKLEKEIRDTLKALRERVERREDLERVEEDVRRVIKEIRDLARENHEENRDVIRRIRESNKRTEDEAREVLDRIRKTAT

SEQ ID NO: 12617 - protein, 185 aa, Artificial Sequence; identical to SEQ ID NO: 12616
  Synthetic

SEQ ID NO: 12618 - protein, 177 aa, Artificial Sequence
  Synthetic
KEREEAEEMLKRLEEELRRLLEESEKIIERSERHLEKLLKDAEDEIRRVKEELDKIDIEEKVIEEVKRKIDEIKRRLEELAERARKVHKDLRDRHRKLFEEFKRVLDEIRRRLDSGGDREEIRRLIERLRELLEEIARRIEKTNRELEELNKRLADDIKRLIDELERVLREVEERSR

SEQ ID NO: 12619 - protein, 177 aa, Artificial Sequence; identical to SEQ ID NO: 12618
  Synthetic

SEQ ID NO: 12620 - protein, 175 aa, Artificial Sequence
  Synthetic
DEVETLLEEARKVLEELRKKIKELNEDSKRVLEELEKRIRDLDRRSTEVLRRLEESDLDRKEVKKMLDDLRREYEDMERRIKEVLDELEKKYRELEKEIDRAREELTKRLEDLKREGKSTEELEDALRKIRKAVEELKKDVRRTLEEIKKEVKRLIEEARRSLDKIRRDVEKRDE

SEQ ID NO: 12621 - protein, 175 aa, Artificial Sequence; identical to SEQ ID NO: 12620
  Synthetic

SEQ ID NO: 12622 - protein, 175 aa, Artificial Sequence
  Synthetic
EEVKRLVDDLREVTKENEKRARDLDRDSKRVSEENARKIETLNRDNERVNKELADSDRREEEVEDALRRLEEEYRRVHKENREETKRLREKYEELHERNKEVLERLKRKVDELRRKGKSTEKLDEDLERLERRNRKINEDAKTTLREIERENEELNKRLEETLRRSEKHLRDRRK

SEQ ID NO: 12623 - protein, 175 aa, Artificial Sequence; identical to SEQ ID NO: 12622
  Synthetic

SEQ ID NO: 12624 - protein, 179 aa, Artificial Sequence
  Synthetic
REVEKLIKELEDLNRDHARKVKELIAELEKLLRDHAEKVRKLIEEARKTLEDLREIVERKGPVEELLKEAEKKLKEIKEEIERSSKELKKEIDRIEEDIRRSTERLRREHKRVADDLRKKGLDKKDVREMIRRSEENLKRLNEEVKRAIRKVEEDLKELNKRARDVLEELRKRVEDTFR

SEQ ID NO: 12625 - protein, 179 aa, Artificial Sequence; identical to SEQ ID NO: 12624
  Synthetic

SEQ ID NO: 12626 - protein, 177 aa, Artificial Sequence
  Synthetic
SEEEELEKRLRDSEREIEKWLRDLERVIEEVAREDKKIHEELEKILEDVKRELDKLGIDDELRKELEKKLRKIKEELEKLNEDTRRELERVRRDLERLAEELKRRHDEIRKELERTGDSKVVEKLVEDLRRINEEAKRRLERLKEELRKVLKDYKDEIDKLVEELKRTLDEVRKKAK

SEQ ID NO: 12627 - protein, 177 aa, Artificial Sequence; identical to SEQ ID NO: 12626
  Synthetic

SEQ ID NO: 12628 - protein, 177 aa, Artificial Sequence
  Synthetic
DEEEDVRRTLEKVERDVERIDEDVERELRKVEEDDKRLHKELSEVVEKVERDIRRTGIEEELMDTARRRLEEARRELERLNKRTKELLDRIRKALEESHREVKELLERIEEELERTGDKKKLEELKERLKEALKRHEDKVRELKKELKKILDDYTEDVKRIKERLKRILEEIRRRKK

SEQ ID NO: 12629 - protein, 177 aa, Artificial Sequence; identical to SEQ ID NO: 12628
  Synthetic

SEQ ID NO: 12630 - protein, 177 aa, Artificial Sequence
  Synthetic
SSEEDVKRELERVRREDERIHRDLERVLEESERRVETWDRDAKRTLEKVEEDLRRDGLEKELVDKLKEALDRIREDIERSHRELRKLHEEIRDELRKLNEETDRRLRDIEDKLRKTGEEELLEELKRRLKEILDRYRREAERLKRENEEMNKRHRERLEELKKRLKELLERMKEARK

SEQ ID NO: 12631 - protein, 177 aa, Artificial Sequence; identical to SEQ ID NO: 12630
  Synthetic

SEQ ID NO: 12632 - protein, 177 aa, Artificial Sequence
  Synthetic
STEEDVRRVMKKVEDDVREINRDLERDLRRVEEAVERLDRDAKREIDRLREEIDREGIEERLKKEADEVLRRVEEEIKKSHEEVRRLLEEVERRLRESTKELEDRLRKVKEELDRTGDEKFAEDLKRKLKKVLDEHRRRIEELKRELEEVLERHARELKRLKDELKKLVDDIRRRRK

SEQ ID NO: 12633 - protein, 177 aa, Artificial Sequence; identical to SEQ ID NO: 12632
  Synthetic

SEQ ID NO: 12634 - protein, 177 aa, Artificial Sequence
  Synthetic
SDEEDVERELKRVKDEVDKINEDVRRELRKSEEDVERWDEDLERVVRRVEEEVRKTGIDEELKRKADERLEEAKKRVEDSHRRLREEHRRIEKDLRDSTREIEKLLRDIRKRLTDTGDKKVLEKLKKDLRDALKRHRDRVEKLKEENRKLNEDHKKTLEDIKEELKRLLDELKETRR

SEQ ID NO: 12635 - protein, 177 aa, Artificial Sequence; identical to SEQ ID NO: 12634
  Synthetic

SEQ ID NO: 12636 - protein, 177 aa, Artificial Sequence
  Synthetic
SDEEDVERELERVKRDVERLDEDAKRVLDEVRKAVEEINRDVERDLRRVEEEIKKTGIEERLMEEAKRRLERIKEELKKSTEELERLLEEVKRRIEESHRRMEEELRRIREELERTGSKEKLKELKERLKRLLDEHRRELKRLKDELKKALDDHKRKVDKLKKELKDILKKIRDDRR

SEQ ID NO: 12637 - protein, 177 aa, Artificial Sequence; identical to SEQ ID NO: 12636
  Synthetic

SEQ ID NO: 12638 - protein, 177 aa, Artificial Sequence
  Synthetic
DDEDDVRRVLRRVAEEVRKLDEDLKRVLKESKERVKRWNDDAKRRLDKVREDLKRKGLDESALRRAEDVLRRIKKRIDESTEDLDRLHKEIEKEVRDSHKKMREDLDKVREDLERTGDKKVLEELKKRLEDLLKRHEEEVRRLKEENKKLNDDHRRELERLKKELTDLLKRLDDERK

SEQ ID NO: 12639 - protein, 177 aa, Artificial Sequence; identical to SEQ ID NO: 12638
  Synthetic

SEQ ID NO: 12640 - protein, 177 aa, Artificial Sequence
  Synthetic
SLEEDVKRVIDRVREAVKKINDEVEKELRKSEKAVEDWNRRLEEIHDRARRELEKAGIDEELRKREKREHERSEEELRRSTEELKKKHDEIRKRLEDSTREAKKTLEEVERELRETGDKDKLEELKRRLKRLLDEHRKRVEELKEENKRLNKEHEKKVEDNVRRVRELLKRVEDRRR

SEQ ID NO: 12641 - protein, 177 aa, Artificial Sequence; identical to SEQ ID NO: 12640
  Synthetic

SEQ ID NO: 12642 - protein, 179 aa, Artificial Sequence
  Synthetic
SEVEEIVKKLEELLRRWEKTVRDIVEELKRLLEEIEKLSRETKERLKKILEDVKRLAEEGRLDDAEVDRLRKELEDLHRELEERLRELMREMEERLKEANERSKRIKEEIEKDLKELTDRRGRVDELEDIARRVKEELDRLNEELERIARKVKEDLKRLLEDNKRVLDEVKERLDRIRK

SEQ ID NO: 12643 - protein, 179 aa, Artificial Sequence; identical to SEQ ID NO: 12642
  Synthetic

SEQ ID NO: 12644 - protein, 179 aa, Artificial Sequence
  Synthetic
SEIEDIVRRLEELLERWKRRVDKAKERNKRLLEKWAKEVEDIKRELEKLLEDVRRLKEEGRSDKRDVDRLIERIEELLERLHRRSEEIKRDSRRHAKELHRISEEIKERIRRLLKKVTDDKGRVDELEKIVEDVERELDKINEDYNRVLKRVEEELDRLNEDLNRVAKRVKDALRKIEE

SEQ ID NO: 12645 - protein, 179 aa, Artificial Sequence; identical to SEQ ID NO: 12644
  Synthetic

SEQ ID NO: 12646 - protein, 179 aa, Artificial Sequence
  Synthetic
SEIEKVVEEAKKLLKRWEDEVRKHDKELKEVLDRWKKEVDDIKRRLEELLREVRRLKEEGRSDDRKLEELKREIDKLLEDLHRRSKRLVEDLKRTHDEVDDRSKKIKKEIRDRLKDIERRRGPVDELRKIVEDVERELDRLNDENRDSLRRVVEALEEINKDLNRDVKRVKDELDKTRK

SEQ ID NO: 12647 - protein, 179 aa, Artificial Sequence; identical to SEQ ID NO: 12646
  Synthetic

SEQ ID NO: 12648 - protein, 179 aa, Artificial Sequence
  Synthetic
SEVEEIKKELKKLDEENKRVIDRIVREIERLNEENERVARKVIKEIEELLRKLEKLRRDGRSDETVVRKIKKDLEELLKRLEEHIRESKDRLRDLLRRVREHLERSRRRMEELRDRVRRNGKEEEDLRRVLKESEDRNRKLLEDLERKVRDVKRRDDELLKRAREALKRVKDEIEKIRK

SEQ ID NO: 12649 - protein, 179 aa, Artificial Sequence; identical to SEQ ID NO: 12648
  Synthetic

SEQ ID NO: 12650 - protein, 179 aa, Artificial Sequence
  Synthetic
SEVEDIIRRIKELDDRNERKVRELVKTNEKLLRDLHEKSKRIVKEMRELLKEIEDLARRGKSDDRRLEEVRERLKRLLDDYERTVERLKETNERLNRELEKHLEDSKKRLEDLREEVRRRGKDEEELKRVIDESKKRNEKLMRDYEEISKKVHEDVERDAERLRRIAKEVEEELERVRK

SEQ ID NO: 12651 - protein, 179 aa, Artificial Sequence; identical to SEQ ID NO: 12650
  Synthetic

SEQ ID NO: 12652 - protein, 179 aa, Artificial Sequence
  Synthetic
SEVEKIKEDLKRLLDEVRKKAEELKRENRELLRRLHELSKKIIRELEKLLEELADLVRKGRSDDKVVKRIRDELEKLKREYERAVKELRDRNRELNEELKRVLERVKEDMDRLREEVRRRGKEDEDLERTIREVEKELRRLLEDYRRESKKVHEDIDEDRRRLEDAVREVEKEIEKVRR

SEQ ID NO: 12653 - protein, 179 aa, Artificial Sequence; identical to SEQ ID NO: 12652
  Synthetic

SEQ ID NO: 12654 - protein, 182 aa, Artificial Sequence
  Synthetic
SEVERIKEDIKKSNEDIRRTAEEIKERIKKSNKEVEDEVREIKERIKRILDKLKRVKEEGRLDDRLKKEAEKVLEDIKRKLEELEEKHRRDLKRIRDRLREVEKRHRDELRRLREELKRRGSDKSVVDDLERVMKESEERVKRIIDDLERTLRESEKNLKRIIDDLERVMREAREAIDRLKK

SEQ ID NO: 12655 - protein, 182 aa, Artificial Sequence; identical to SEQ ID NO: 12654
  Synthetic

SEQ ID NO: 12656 - protein, 178 aa, Artificial Sequence
  Synthetic
SEDDELRRRLEELKRRIEDLIRKLREVLKRSEDELRKILRELREVDKDLRRRIEELIKDIQDEEVIDRLKKLLKRHTDRSRELEKRLKEILDELRKRHEKVERDLRRILEELKKLSDDRELDEDEAKKRLEEILRRAEELLERLKRTNERVNRKVREDMKRAKEHAKRLLEEAEELAR

SEQ ID NO: 12657 - protein, 178 aa, Artificial Sequence; identical to SEQ ID NO: 12656
  Synthetic

SEQ ID NO: 12658 - protein, 180 aa, Artificial Sequence
  Synthetic
DEVEELIKEVEKVNEDAARESEKRNRELKKMLERVKRENKRLIRELKELLDDARRKNSKDSTLSETLKRVLKESKERVDRLVKRVDDLLRELERRDRELHKKLEERHRRIRDRLREEVREKREVLKKLEEVLRESKKRLKEWNDRNKKTLDDIRREIEKSKKEHEDALRRIEEELKKTET

SEQ ID NO: 12659 - protein, 180 aa, Artificial Sequence; identical to SEQ ID NO: 12658
  Synthetic

SEQ ID NO: 12660 - protein, 180 aa, Artificial Sequence
  Synthetic
SELEKLVKELRDLNEKVARDSKRLNDKLEEVLDRLRRRNEELIKRLEEVLEDVERKNSKDSTLEEELDRLLKKSREDLDRLVDEARKLLDEARKRDKKLHEDLKREHDRVAETVRRDISKDKELLDRLRKMLKESRDSLRKLNKENEETLRRIKKKLDESKRKHEEVLKDIKRRLEELSR

SEQ ID NO: 12661 - protein, 180 aa, Artificial Sequence; identical to SEQ ID NO: 12660
  Synthetic

SEQ ID NO: 12662 - protein, 180 aa, Artificial Sequence
  Synthetic
DEVERIIERLRRVNKRVREENERLIKEIEDLITEIAKRSRDLNRELDKTLKDVRRKNDKDERLKREVEELLKRLEEEDKKLHDDAERALKRSKEEMDKLMRELERLHKEVKDELDRDVREKEEVLRRLEKVLRESRKSLEDSAKKHKDVLDEVKKTLKKLNDENREVLKRIKKELDKTRT

SEQ ID NO: 12663 - protein, 180 aa, Artificial Sequence; identical to SEQ ID NO: 12662
  Synthetic

SEQ ID NO: 12664 - protein, 179 aa, Artificial Sequence
  Synthetic
SEVEKLIEDMKKVAKELADESEEHIKRAEEVIDRLAKEVEKHDRDVEDTIRRLEESDRDKREVEEVLKKIKRSSEELKEKLRRVLEKLRKTSKELEEKLREVLKRLEDRIRKLETEDRSSEEVKKRLREMLEELRRRLERLKDKNKEVLDRLEEKLRKLEKENDDSLKEAEDKLRERER

SEQ ID NO: 12665 - protein, 179 aa, Artificial Sequence; identical to SEQ ID NO: 12664
  Synthetic

SEQ ID NO: 12666 - protein, 179 aa, Artificial Sequence
  Synthetic
SEVEKLIEDIERIIRTLAEEVRRHDEDARRVLEDLARKVRKHNEDVKKVLEDLRESDRDRKFIKEVLERLRKTSEELKRELEEVLRRLRESSKELKRKLREVLKEIKRRAKKLEKDDTSSEEMKERLRRMLKRAEDELRRLEEENDRVVERLERELRRLTEDNKRTLKKIEEDLRRREK

SEQ ID NO: 12667 - protein, 179 aa, Artificial Sequence; identical to SEQ ID NO: 12666
  Synthetic

SEQ ID NO: 12668 - protein, 179 aa, Artificial Sequence
  Synthetic
DEVRDLIRRLEETVKRLADEVREHDKRARDILRELKKEVKETNRRSEKVADDLEKSDRDDKEVDEALDKLRKEYEDLKKRLDDVLEEIRKSSEELEKKLDKVLEEMARLVDKLRRDDTSSEEVKERLKKVLEKLKRDLEKLKEDNRRVLKELEEELRKIKEELDKSLDDLRKRLEDRKK

SEQ ID NO: 12669 - protein, 179 aa, Artificial Sequence; identical to SEQ ID NO: 12668
  Synthetic

SEQ ID NO: 12670 - protein, 180 aa, Artificial Sequence
  Synthetic
SLEEKFRRVLEESKESLERLKRKVEKVLRESEERLKRWLDKVKKVLEEVDDALRRLKDRLDEKLLKRLRDLAREILEEIKRLLDEAKKRHDEVRERVERLLKKVLDDHRRAEERVKREVRTKEIVERLIEELKKLNKELADRLEEIIRRLEEINERLRERIERIITRLRRLLEELEREAE

SEQ ID NO: 12671 - protein, 180 aa, Artificial Sequence; identical to SEQ ID NO: 12670
  Synthetic

SEQ ID NO: 12672 - protein, 184 aa, Artificial Sequence
  Synthetic
SEDEDLKRVLDEAEKRLKDLLDDLRRALKRSEDELRKNNEDLERVLKRVEERLKELLDRVDRDSLKELLDRVREALERLRREVEETTKRVSDEHRRLLEEAERTLEEIRRRLEDLERRVRKKSRRREIVEEIKKRIRDLLRELEKKIEELKTTSERLNREHHKKIEDIKKEIEDLVRELEKKVK

SEQ ID NO: 12673 - protein, 184 aa, Artificial Sequence; identical to SEQ ID NO: 12672
  Synthetic

SEQ ID NO: 12674 - protein, 184 aa, Artificial Sequence
  Synthetic
SLREKLEEVLRRIEEALERIREEVEKVLRDSRDDNRRVLKELKELLERVREALEDLLRKVDRDRVRETLKRVEDRLRELEEEVRRHHKRSEDRHRELEKDLERVLEEVKRRLRKLEKDVEEKSRTDKIVKEIIEELEKLLRDIKKRARELIEESKRINEDNNRRAEEVAEEIRRLLEELERKLR

SEQ ID NO: 12675 - protein, 184 aa, Artificial Sequence; identical to SEQ ID NO: 12674
  Synthetic

SEQ ID NO: 12676 - protein, 184 aa, Artificial Sequence
  Synthetic
SLEEDVKRVLREAEEELKKNNERLRKVIEDSKRDNDRVLDELRKVLEDIEKALRDLLREVDRDRLREDLERVRRRLEELSRRAKEHHKESRKEHEKLRDDARRVTEKVEERLRRIREDLERRSRTDKIVDEVRKEIEKLVRDHHKRIKDLKDDLKRLNDENNKRAKEIIDEMKRLLEEIEKRVR

SEQ ID NO: 12677 - protein, 184 aa, Artificial Sequence; identical to SEQ ID NO: 12676
  Synthetic

SEQ ID NO: 12678 - protein, 182 aa, Artificial Sequence
  Synthetic
KDVEDIKRRIEELNKKLKEKIERIKKRIKELNEEAAKKVEEIKERLKRLLDEIRELVRRDGPREDEIRRLREDLKRLLKEMEDTLKELEDRHERLREEVEKTLRELEKKHKELKEELDRQPVDDSLRKRLEEVLRESKKTAEDLKRDLRRALEESKKNLKRLLDEVRKVIDEIRKALEELER

SEQ ID NO: 12679 - protein, 182 aa, Artificial Sequence; identical to SEQ ID NO: 12678
  Synthetic

SEQ ID NO: 12680 - protein, 182 aa, Artificial Sequence
  Synthetic
SEVEKIKKDIKDLNDDARRRLEEIKRRLEKLLKELEEKHRELKKELKKLLDEVRDLVRREGPREEVLREVKKRLDDVRRENKKLTDEVREILKKLEEEMKRILEELERRHRELKKRLDEEPVDDRLREDAERVLRESKKNLDELEKDVRRVIKRIEDEARRLNEDLKRMLERIKRELEKLEK

SEQ ID NO: 12681 - protein, 182 aa, Artificial Sequence; identical to SEQ ID NO: 12680
  Synthetic

SEQ ID NO: 12682 - protein, 176 aa, Artificial Sequence
  Synthetic
SEEERLEEVLKRVETELRRLKRELEKVLRESEEALREIIKKIEDAVRDNAEKVKKLSRTVDEDLVRELEKLLRDLERKSREAIRRLEELYREVKERVERVTRELEERLKDLERRVKERPVDRRVEKELEDLLRTATKVLEDLKRDLKRLNEETEEVVKTLEDSHRRSNEEVERRVR

SEQ ID NO: 12683 - protein, 176 aa, Artificial Sequence; identical to SEQ ID NO: 12682
  Synthetic

SEQ ID NO: 12684 - protein, 176 aa, Artificial Sequence
  Synthetic
REREELEEVLERSKRELERLVEEIKRALDESRRRLEEIEKRIEEVIRRNKEEIKKLSRRVDEETVRELEKRLRDLERRSKKVLTDLKKKYEEVEREAREVIKELREKYKRLEEEARRRPVDEKLKEELKELNRESRKVVEDLREKLDRLNKDTERVVRELEKEHRKSNEEVRKTVK

SEQ ID NO: 12685 - protein, 176 aa, Artificial Sequence; identical to SEQ ID NO: 12684
  Synthetic

SEQ ID NO: 12686 - protein, 182 aa, Artificial Sequence
  Synthetic
DEEEELKEDIKRILEELRRLAKEHEELNRRINKELEDLVREHKKRLEDALKRLREIVRDRGNDEDVTRRMDEILDELRKHSEDLKRRMDKLLRENEEHSDRLRKRIKELTDRLRRRVEDLVRKRGRVEELEKVLKEAEDDVERIKKRLKRINDESRKHVERLKEELDRADKRIEDEVEKLKK

SEQ ID NO: 12687 - protein, 182 aa, Artificial Sequence; identical to SEQ ID NO: 12686
  Synthetic

SEQ ID NO: 12688 - protein, 182 aa, Artificial Sequence
  Synthetic
RIEERLKRVVDKVDDTLRKSEKHLEDVVRDADRDIDRNRRENEKVVKEAEDILRRLVEEAGRELDDLRRVKKEVDKLLKENEEKLKKVREDIERILRDLKRKHEAVRERLRKLLTDVAREKIPEDKVRELEEEAERLLDELRRKNEEAVRRIKKLLDDLNKHSEETIRRIKKLLKELEDKTR

SEQ ID NO: 12689 - protein, 182 aa, Artificial Sequence; identical to SEQ ID NO: 12688
  Synthetic

SEQ ID NO: 12690 - protein, 178 aa, Artificial Sequence
  Synthetic
STEEKLKELKKEADKLLKELDKELRDNLRRLRKIVEELKKENRDLTRESEEVLKRLNSDDETVERVLRELRERHRKLEEETEEVLRRLERKHDKLREDLKRIVDEIEKKIRDIRRKPVDDKDVKKLIEEIRRILEKAREEVERLSRDSKRVAEELRKRHKELIDRNKRVLEELKRRRD

SEQ ID NO: 12691 - protein, 178 aa, Artificial Sequence; identical to SEQ ID NO: 12690
  Synthetic

SEQ ID NO: 12692 - protein, 178 aa, Artificial Sequence
  Synthetic
SEVEEVARRSRKLNDDLKKIIEELIRRSRKINDELRREIERLIRESRKLNRELEELKRRGELTEEILKKAKEDHERLDRKVKELLKRALDTHRKLTDEARKKLEEVLKRHEDLARKLKDTIEEDKVRRLNEENKESLRRLERELEKLNKENEDSLRTLEELLRELNKENKRSLDELRK

SEQ ID NO: 12693 - protein, 178 aa, Artificial Sequence; identical to SEQ ID NO: 12692
  Synthetic

SEQ ID NO: 12694 - protein, 177 aa, Artificial Sequence
  Synthetic
SLVEEVEERVKKLHDENRELDRKSKRDVEEVHKKNEKLIKDVERTVREMIRKLRELKGTSEETVRRIEEEVRKVRTELEKEMRELSKENEDVARRLREEYKRAEEKNKRAVEEIRKRLLDVEEELRRLEEELRRSIKESREELRRLEDELRRSIEKLEDALRRLAKELDEVIKDLKD

SEQ ID NO: 12695 - protein, 177 aa, Artificial Sequence; identical to SEQ ID NO: 12694
  Synthetic

SEQ ID NO: 12696 - protein, 177 aa, Artificial Sequence
  Synthetic
SLVDEVRRRVDELHKDNKRLDDESEKKVRDAHRENERLDDESRRKVKEAIRKLEELKGTSEETVKEIIKEVEKVVDELRKEYDDLERRNKEVADRLREEYERARKKNEDVLREIRDKLLDVKESLDRLAEKLKKSIKESEDILRELEKRLRDSIRESRKILEDLRRELEEVIKRLED

SEQ ID NO: 12697 - protein, 177 aa, Artificial Sequence; identical to SEQ ID NO: 12696
  Synthetic

SEQ ID NO: 12698 - protein, 177 aa, Artificial Sequence
  Synthetic
SLAEEVEKRVRDLHRKNEELDRESEKKVRDMDRKNKELIKRAEEEVKKVIDKLRKLKGTSEETVRRISEEVKKIVEDLERELRKLEEENRRVVEELRDKYRKLEKENRDMLEDIKRRLLDVEEKLRELARRLKESIRESRERLRRLEKELEDSIRELRRAIDTLTKRLEKAIEELER

SEQ ID NO: 12699 - protein, 177 aa, Artificial Sequence; identical to SEQ ID NO: 12698
  Synthetic

SEQ ID NO: 12700 - protein, 177 aa, Artificial Sequence
  Synthetic
SLVEEVERRVRKLHEENKKLDKESEDKVREANRRNEELIKKVTESVRRMIEKLRRLKGTSEETVRRIKREVEEVVKKLRKEMKDLEEENKRVVEELRKRYKDAKKRNRDALEDIKRRLLDVEEELRRLADELRRSIEESERILKKLEEELRRSIEELRRALEELDEELKRVIRELER

SEQ ID NO: 12701 - protein, 177 aa, Artificial Sequence; identical to SEQ ID NO: 12700
  Synthetic

SEQ ID NO: 12702 - protein, 177 aa, Artificial Sequence
  Synthetic
SLVEEVKKRVDDLHKRNRELDDRSEKMVRKANEENKELDKKSKEDVDRLIERAERLKGTSEETVKEITRDVERVAKRLEDEYRELEKRNREVVRELRKRYDDLEKENRDMLKDIRDRLLDVEEELRRLAEKLKRSIEESREILKELERRLRESIRRSREILKRLKEELERAIERLRR

SEQ ID NO: 12703 - protein, 177 aa, Artificial Sequence; identical to SEQ ID NO: 12702
  Synthetic

SEQ ID NO: 12704 - protein, 177 aa, Artificial Sequence
  Synthetic
SLAEEVEKLVRDLHRKNKELDRRSKKTVEDIEREARELDKRSKEEVERMIKKLRELKGTSKETVDDIEREVREVVEKLRKEYEDLSKKIRDVADKLRDDYRKLEEENRKALEDIRRELLDVEDKLRELEKELRDSIRESREILERLERRLEELIRRSKRILEELERELEEVIRELRR

SEQ ID NO: 12705 - protein, 177 aa, Artificial Sequence; identical to SEQ ID NO: 12704
  Synthetic

SEQ ID NO: 12706 - protein, 177 aa, Artificial Sequence
  Synthetic
SLDDDVEKKVRELDKRNEDLDRKSEKEVEKVHRKNKRLDDESEKEVKRMIEELKKLKGTSEDTVRKIKEEVEEVVRKLRKEYKELEEENEEVVKKLRKEYREAEEENRRMLEEIEKRLLDVEEELRRLAEELRESIERSRERLKELERRLRESIARSREILEELERRLKRAIEDLER

SEQ ID NO: 12707 - protein, 177 aa, Artificial Sequence; identical to SEQ ID NO: 12706
  Synthetic

SEQ ID NO: 12708 - protein, 177 aa, Artificial Sequence
  Synthetic
SLAEDVEEKVKELNRRNKKLDDESKEMVKRAHDRNRELDERSKDRVRRVIEKLRRLKGTSEETVERIDREVKKIVRELKEEYERAKEENKRVVDDLRRRYERLEDENREMLDDIRRRLLDVKEKLEELAERLRKSIEESRDILRRLEKELRDSIKRSEEILKELTDRLRKVIKDLRD

SEQ ID NO: 12709 - protein, 177 aa, Artificial Sequence; identical to SEQ ID NO: 12708
  Synthetic

SEQ ID NO: 12710 - protein, 177 aa, Artificial Sequence
  Synthetic
SLVEEAERRVRELIKELERLDDRSREMVKEMHERNRELIERVEKRVREVIEELRRLKGTSEETVKRISEKVKEILDRLRKLVEDLRRENERVVEELRRRYKEAEDRVKRLLDEIRKRLVRSEDDLRKLAEDLKRVLKRSRDILRKLEEDLRRSIRELEEALRKLEEDLRRAIEELET

SEQ ID NO: 12711 - protein, 177 aa, Artificial Sequence; identical to SEQ ID NO: 12710
  Synthetic

SEQ ID NO: 12712 - protein, 177 aa, Artificial Sequence
  Synthetic
SLKDDVEKKVEDLKKEAKDLDRESDKKVKTAHKRNEELDRKSADDVRKLIRKLEKLKGTSEETVKRIEEEVKEVVRRLREEYKRMEDENREVVRRLEKEYRDLERKIRELLERIKDKLLDVEEELKRLAEELERLIRDSRRILEELKRELKRSIEESRKILEDLERELEKVIRELKR

SEQ ID NO: 12713 - protein, 177 aa, Artificial Sequence; identical to SEQ ID NO: 12712
  Synthetic

SEQ ID NO: 12714 - protein, 177 aa, Artificial Sequence
  Synthetic
SLAEEVERDVKRLDEENKRLDDRSRREVEKMDEENKKLIEDARREVREMIEKLKKLKGTSEETVERIKREVEKVLRELEERVRRLAEKNKEVVERLKKEYEEAAKKNKEVLDDIRRRLLDVDEKLKELAKRLRDSLERSKEELKKLEEELRKSIKELEDALKKLEEDLRDVIRKLEE

SEQ ID NO: 12715 - protein, 177 aa, Artificial Sequence; identical to SEQ ID NO: 12714
  Synthetic

SEQ ID NO: 12716 - protein, 177 aa, Artificial Sequence
  Synthetic
SLVEDVERKVRELDKRNRDLDRKSKRKVEEADKENRKLDEDSERKVRELERKATELKGTSEEAVKRIEDEVREVVRRLRELYKTAEEKNKEVVKTLEKLYRDMERRNKEVLDEIKKRLLDSEESLRRLEEELRKSIKESKEILDELRKELEKSIRESKERLKELEKRLEELIRELKR

SEQ ID NO: 12717 - protein, 177 aa, Artificial Sequence; identical to SEQ ID NO: 12716
  Synthetic

SEQ ID NO: 12718 - protein, 177 aa, Artificial Sequence
  Synthetic
KLVEDAEELVRRLDEENKRLDDDSKRRVEEANRENEKLIKEIEDEVRKMIKKLRDLKGTSEETVKRIEKEVRDVVRDLKRLVDELKRRNEKVVKDLRRKYEEAKRKNEEVLEDIKRRLVRSEEELRKLAKRLKDSIDRSRKILEELERELRRSIDELRRALEELTDELRKVIEELRK

SEQ ID NO: 12719 - protein, 177 aa, Artificial Sequence; identical to SEQ ID NO: 12718
  Synthetic

SEQ ID NO: 12720 - protein, 177 aa, Artificial Sequence
  Synthetic
SLAEEVEKEVKKLDEENRKLDRDSTETVKELNKKNERLDRESKRKVDEVIEKLERLKGTDREIVERIAEEVKEIVKELEEEYRRAKRENEEVVKKLRDEYRRLEERNKKALKDIRDKLLDVKEKLDELADELKKSLDRSRRILERLEEELRRSIRRSEDILRRLKEELERVIRELRR

SEQ ID NO: 12721 - protein, 177 aa, Artificial Sequence; identical to SEQ ID NO: 12720
  Synthetic

SEQ ID NO: 12722 - protein, 178 aa, Artificial Sequence
  Synthetic
SVDEEVEKLLKEHEERIRELIKEVEKLNREHAKRIEELIRKLKETNKRIADKIRDLKRQGRDAKEEVEKELRRLEEEHERVRREVKRSTEELEKRHEDLERRVRKSSEDLKDRLRRLRDGLDEEKLRTIARRIKELNDRFKRAIDESRKHIEELNRRLEKVVEDSRRHLEELADEVRR

SEQ ID NO: 12723 - protein, 178 aa, Artificial Sequence; identical to SEQ ID NO: 12722
  Synthetic

SEQ ID NO: 12724 - protein, 178 aa, Artificial Sequence
  Synthetic
SVLEELKRLLDEHRERLERLIRELRKLNEDHDRRIKELIERLKKLNEDIAKRIEDLKRDGRKVDEEVEEILKRAREEHRRLEEEVRESTERLKRKHDRVKEEVEDSSRELKERLDRLRDGADEDVLRKIEEDIKRLNREVEKAIRESEENIKRTNKRFKDELRKSEKHLEELVKRFRD

SEQ ID NO: 12725 - protein, 178 aa, Artificial Sequence; identical to SEQ ID NO: 12724
  Synthetic

SEQ ID NO: 12726 - protein, 178 aa, Artificial Sequence
  Synthetic
SVLEEVTKLLKDHEDRIREIIKRLRKLNRDIDERIKRLIDEVRKKNDDIRRKIEELKRRGRDRREEVRKDKKDLKKDHDDVRREIDDTLRRAREEHDRVREEIRESSRRIEERLKELKDGLDEERLKRLREELEKLNRDVERVIKESKENLDRTVTEAKRELKRSEDNLERLAREFER

SEQ ID NO: 12727 - protein, 178 aa, Artificial Sequence; identical to SEQ ID NO: 12726
  Synthetic

SEQ ID NO: 12728 - protein, 175 aa, Artificial Sequence
  Synthetic
TEEEILRRVERDLERLNRELERIVREVEKELKKINDDYERVLKKVKDDIDRIREELDRQGVRTEEADERVKELIKKSRDHARRLNEESKKIIDDIRKLLREVHEKSEEIIKEMRRAKLSDKELEELLKRWEEDVKRIVEEVKKLLDEWRERVKRAKDENEKLLRDLEKLVEDLAR

SEQ ID NO: 12729 - protein, 175 aa, Artificial Sequence; identical to SEQ ID NO: 12728
  Synthetic

SEQ ID NO: 12730 - protein, 175 aa, Artificial Sequence
  Synthetic
SKEDVLREVKRELKRLLDDNRRMLEEVEEAARRLNKDYNDVLKEVEEEIEKIIRELEKKGKKDERVDRRIEELKRDSRRHAEKLHDDSRKLREKLKEIHDKLKRDLDELRKRMDDADLSEEDLKRLLDEVRRLSEKTKEDLERILRKWKEDVERAKERNRRELERLEREIKELAR

SEQ ID NO: 12731 - protein, 175 aa, Artificial Sequence; identical to SEQ ID NO: 12730
  Synthetic

SEQ ID NO: 12732 - protein, 178 aa, Artificial Sequence
  Synthetic
ELDKIVEEVRKALREILEDYKRFSKEIHDRDKELADRLREILKDVKRAVDELIKKLSRTKELEETARRLEKRIEELRKEVEDHLKKSEDRNRELKEELRDTLRRVEETIEEIRRRGEPVEDVVRKLRELLERFRKKAEDLKEENKRINEENERKIREIVKTLRKLLDELREKLERTKK

SEQ ID NO: 12733 - protein, 178 aa, Artificial Sequence; identical to SEQ ID NO: 12732
  Synthetic

SEQ ID NO: 12734 - protein, 178 aa, Artificial Sequence
  Synthetic
SLEDTLRKVDKDLKDNMRRLEETAEKVRRDIDRDEERLRRISEELHRRIEELIKRLSRDERVKRKVEELKKRNEDNEREYKDTVRRIKEEIKRLEDEYKKHLEDVARRLEEIRRRGEPVEDVVRDAKRLLDEHHDLARKIVEDLRRLLEDLHRKSKKSVEDNERLLKRMEEILRETER

SEQ ID NO: 12735 - protein, 178 aa, Artificial Sequence; identical to SEQ ID NO: 12734
  Synthetic

SEQ ID NO: 12736 - protein, 171 aa, Artificial Sequence
  Synthetic
SELEEVARRVEKLLEKHKEDLKRLLEKSEEDLRRAEEEVKRLLEEIREELDRLRKRNVDRETVKEMEKKLEEKIKRLEDMLRRLEERDEELNRRSEEHNKELRKEIEDLLRKLPEDEEIKKVRKKVEDVHEESKRLNEENRRRTKEVSDKIREIIKEIRKEIKKASDELEK

SEQ ID NO: 12737 - protein, 171 aa, Artificial Sequence; identical to SEQ ID NO: 12736
  Synthetic

SEQ ID NO: 12738 - protein, 171 aa, Artificial Sequence
  Synthetic
DELERAVEEVEKRLREHLERIKRLLEESRELLKRHEKLLEDVLRRIRELLKRAEDRRIDEETVRRLRKEIEDLERELEKHNRELRKRDEDLNRESEEHNDKLRREIEELERRLRDDELIKRVKERVKEAHKRSRELNERNRRETEKMHKKSRDLLRKIREEVDRMSDKLRK

SEQ ID NO: 12739 - protein, 171 aa, Artificial Sequence; identical to SEQ ID NO: 12738
  Synthetic

SEQ ID NO: 12740 - protein, 170 aa, Artificial Sequence
  Synthetic
SEEELLRELEKKLRELRRKVDETLRDLRRRLKELEEDHRRTLEESERHLREVEKKLSRTRELERLAEELERRHRKASEEVKKRLTDLKRDLDRLKKDIDERLERLRDELRKRRVDEKLDRRVEELIKEIEELLREVEKLVEDLIRTIKKLNDDLREDNKRLAKEMEDRAR

SEQ ID NO: 12741 - protein, 170 aa, Artificial Sequence; identical to SEQ ID NO: 12740
  Synthetic

SEQ ID NO: 12742 - protein, 181 aa, Artificial Sequence
  Synthetic
SAVEDLEREVRKLIRDLEDLIRRLEERNKRIAEEIEKLNEELNRENKRIADEIRRIKDERGTDEEVAERIKRLLDDAARAHRELDREVERLLKEAEDEHKKLADEIRKLLARVDKALKDLRKDVSEEALERLKRELRKLAEELKKVLKRSRDHLKEVKRRHDENIKRSDDHLKRVADEARK

SEQ ID NO: 12743 - protein, 181 aa, Artificial Sequence; identical to SEQ ID NO: 12742
  Synthetic

SEQ ID NO: 12744 - protein, 181 aa, Artificial Sequence
  Synthetic
SVAEELEKDIRRIEEEIKELLERHRELNERIVREIEDLNRKLNEMNKRVVEELRKVKRDRGTDEEVEKRIRDILDKLRRLHRKVDREVEELLRALEEHAKELERRIRELLKRAREKLEELRKDVDDRVLKKLEKRLRELEEEAKKLLKESKEHVDEVRKRHEENIRRSEEHLRRVLEELRR

SEQ ID NO: 12745 - protein, 181 aa, Artificial Sequence; identical to SEQ ID NO: 12744
  Synthetic

SEQ ID NO: 12746 - protein, 181 aa, Artificial Sequence
  Synthetic
SVVEELERRIEEIAREIEELNERHNRKNKEIADRIRDLNRRLNEANKKIVREIEEIKRRDGDDEDVRREIRELLERLKELHRRVDRKVKELLDELEKHLREVDRRVEELLRRARKTLEDVRKDVDSRVLDKLRKELDDLRRRHEENVDRSRKHLEEVRKEHEENIKRSERHLEEVKKEAER

SEQ ID NO: 12747 - protein, 181 aa, Artificial Sequence; identical to SEQ ID NO: 12746
  Synthetic

SEQ ID NO: 12748 - protein, 181 aa, Artificial Sequence
  Synthetic
SVVETLEKRVRELIETLERLIERLDRENKRVAEEIKRLLDEHDKTNKEIVERIRDIKRREGTDERVRTEIEELLRRLEAHVRELKKTIEDLLRKLKEMHDRLREEIRRLLEEARKELEDLRKDIDSRVLRKLEEELRKLEEKLRKLLKDSEDHLREVLERAKRVLDDSRRHVDEVRREAEE

SEQ ID NO: 12749 - protein, 181 aa, Artificial Sequence; identical to SEQ ID NO: 12748
  Synthetic

SEQ ID NO: 12750 - protein, 181 aa, Artificial Sequence
  Synthetic
SVMEDLERRIREIIKEIEKLLEDLKRENRRVAEEIERLNREHNELNKRIAEEIERIKRRRGRDEDVSERIRELLEALKEHLRRLDEEVRRILKRLEDLHRELEKRIRELLKRAEDELEALRKDVDSRVLKKIEDELKKLEDKAREVLKRSRDHLKKVEDDHRENVRRSEEHVKDVLRRFEE

SEQ ID NO: 12751 - protein, 181 aa, Artificial Sequence; identical to SEQ ID NO: 12750
  Synthetic

SEQ ID NO: 12752 - protein, 181 aa, Artificial Sequence
  Synthetic
KVLEDLDRDIKRIIDEIRRLNEELNREIEEIKRRIKRLNEEHNERNKRLAEEARRIKDERGTDEEVLKRIKKLLRELEEHLEKLDEDVKKLLREAEESIRELDERVEKLLREIRKLLEDLRKDVEDEVLKRLEEKLERLREEHERNAREIRKELEKLEKEHRENVERSRRHVERVEREFET

SEQ ID NO: 12753 - protein, 181 aa, Artificial Sequence; identical to SEQ ID NO: 12752
  Synthetic

SEQ ID NO: 12754 - protein, 181 aa, Artificial Sequence
  Synthetic
SVVERLKEIAEEIIRRIEELNKEHNKRNREIAETIERLNREHNELNKTLVREMKEIKRDKGKDEEVTKTIEKLREELERHLDKLDKDVKKLLDDLRRHNRELDREVRRLLEELRKLAEELRKDIESEVLKKIEEDLRRLLRKHEENSKESEKHVEEVEERHRRNAEDSKRHVEKVKEEVDR

SEQ ID NO: 12755 - protein, 181 aa, Artificial Sequence; identical to SEQ ID NO: 12754
  Synthetic

SEQ ID NO: 12756 - protein, 185 aa, Artificial Sequence
  Synthetic
STEEVLKEIRDRLEELKREAKKVNDDTRERLKELEERNRRANEESKRRLEELERRVEERGTSEDMRRELERLRREADKTNEDDKRRTEELSKEVEDTNKRHEEELERLLTEVEKSLRRMEEENSEDERLLRELRRKLKEVEDTIRELNERLRKRIREIEEEVRESNERLRKKLREILEEIKETEK

SEQ ID NO: 12757 - protein, 185 aa, Artificial Sequence; identical to SEQ ID NO: 12756
  Synthetic

SEQ ID NO: 12758 - protein, 178 aa, Artificial Sequence
  Synthetic
SVVEEIDKIIKRIADRVRKIIEDLERLNKEIADLLRRIIEELKRLNDRIREEVDRLRRRGRDEEKKLADLIRTIAEVHKRAKEDIDRIAEKLRRAHTEVEKEVRKLEKELRDILRKVRDDVDEKVLEDVERKLERLKREVRRVLEESRKRLKEWKDRAREVLEESKRSLEEISRRLRE

SEQ ID NO: 12759 - protein, 178 aa, Artificial Sequence; identical to SEQ ID NO: 12758
  Synthetic

SEQ ID NO: 12760 - protein, 178 aa, Artificial Sequence
  Synthetic
SADETLRKVVEEVARKSEKLNKELEKVNKDLARAVEELIEELKDVITKIEERAKRLKDRGEPLEEEVRKLKEEVRKILKELEDRLRELEKRARDIHREVKKTDEDLRRRLEELLRRVKDRVDERVLEEIRERIERLNKRNKEVLDRSEESLRRLAEKLRRVIERVEEKLRKIEEDLKT

SEQ ID NO: 12761 - protein, 178 aa, Artificial Sequence; identical to SEQ ID NO: 12760
  Synthetic

SEQ ID NO: 12762 - protein, 175 aa, Artificial Sequence
  Synthetic
DKEDAIRTAEKRIRDSERENEKVDEDYRRELKRSEDKNEKADKEYKRRIEELVRRLLETRGREDEELRKLTEDSKRLSEENKKIVEDLKRDSEELLKRNEKLLRELKEEVREVKKEGRDEDTLRKLVDDIEERNRRIIEELKRHLDKLREDNERVIEELKRHLEEVAREVERRRK

SEQ ID NO: 12763 - protein, 175 aa, Artificial Sequence; identical to SEQ ID NO: 12762
  Synthetic

SEQ ID NO: 12764 - protein, 172 aa, Artificial Sequence
  Synthetic
SEKEEAEKLLREHHEKIKRLKEESKRINDENRKRIEELKRRSREINKELEEKVRRNDKDRKVIEKTLEEIERKHDELLKDAEDHHRRSEERHRELEDRVRKETRKVEDKLRKDGLREDTVKRIEDELKKNLDDLRRVLEKSKDDNRKLLEDLERELRESKKDARRLLEEVRK

SEQ ID NO: 12765 - protein, 172 aa, Artificial Sequence; identical to SEQ ID NO: 12764
  Synthetic

SEQ ID NO: 12766 - protein, 172 aa, Artificial Sequence
  Synthetic
SKEEELEKLLREHHEKIKRLKEESKRINDRIRRTVEELIKESEKINRDINDTVRKNDRDEKVIRRLLEDVRRKHEELRERLKRELDKVRERHKELLDRARRATERVKERLDRAGLREDSVERIKRELERNLDDLRRVLKESEDDLREILRRLKEVLEESERDLERVEREVRK

SEQ ID NO: 12767 - protein, 172 aa, Artificial Sequence; identical to SEQ ID NO: 12766
  Synthetic

SEQ ID NO: 12768 - protein, 176 aa, Artificial Sequence
  Synthetic
SELEELLERLERLIEENRRELEELIRELKEESDRTREELKRLIDRLKEKIDRVLKLKEDGRSREEEVRKIEEDIKKEIREMEERHEETKKRIEEKKKEADERHEELRERIKKEERDIPVDKDVLKEARERLRKLHEETKEAKKDLDRILDENEKEVKEVKKRLEDLLKELRDRLRK

SEQ ID NO: 12769 - protein, 176 aa, Artificial Sequence; identical to SEQ ID NO: 12768
  Synthetic

SEQ ID NO: 12770 - protein, 171 aa, Artificial Sequence
  Synthetic
SELEEVLKRIREEAERLMRRNEETLRRVKKTIEDLLRRNEKRLEDVKREADEIEKRKLDEDEVRKEDKRIEEEIKKLSDDSRDMERRIEEEIRRLEEDHKKKRRDTRERLKKAKLSERVKEEIERIEKRVREVHEEVNKRIEDLRREYRKEHKRVEDEIRRILREVREKRR

SEQ ID NO: 12771 - protein, 171 aa, Artificial Sequence; identical to SEQ ID NO: 12770
  Synthetic

SEQ ID NO: 12772 - protein, 179 aa, Artificial Sequence
  Synthetic
SEKEEVKKESEKLSRDTKKRSDEVHKEIKRLTDETERELREVEKEIERLAEELRRQNSVDERLAEELEREREKLREDLRRLKERYDRKLEELKERNKKEKKEYEDRVERTRDERDRNDTSEKVLEDELRENKKENKDLKERHDRTLEEVERTNRKVKEELRRVLRRVEESVREVAERAT

SEQ ID NO: 12773 - protein, 179 aa, Artificial Sequence; identical to SEQ ID NO: 12772
  Synthetic

SEQ ID NO: 12774 - protein, 186 aa, Artificial Sequence
  Synthetic
SKEETIEKRVEELKRENDEKVERIKREIEDLIRRNKELLERIKKEVRELLKELKDRAEKKGTSEDERRKLEDMERRIREKERKSEEDHRREEERLREETKRSEDRTRDLKRKIEEDERRLKKKDGKDRELDKALEDIERRIREHNKELDDELRKVREDSRRHLEKLKRELEEIREEARRITEELKK

SEQ ID NO: 12775 - protein, 186 aa, Artificial Sequence; identical to SEQ ID NO: 12774
  Synthetic

SEQ ID NO: 12776 - protein, 182 aa, Artificial Sequence
  Synthetic
EEKELLDKLKEDADRIKKELEDTLRELKKKHDDVNDRNRKHHEEVRRRAEKIKDKLRRDKVDEDEKRRIEEELRRLDEKSKKDEDRLKDEHEEITRELEKKKRDTRERIKKIRKDTEDKLRTKGTTGEEVRKRLDDLEREIKKIIDEIDERHRRLTEENKRSLDRDREELEKLKEEIKRTAD

SEQ ID NO: 12777 - protein, 182 aa, Artificial Sequence; identical to SEQ ID NO: 12776
  Synthetic

SEQ ID NO: 12778 - protein, 175 aa, Artificial Sequence
  Synthetic
DEAEKIKEDAKRLIEENDEIVRRIEEEMKKSHKENREILKKIKEDVDRSHEDLRRRSGDTDELREDKKKNEEDARRTEEDTRRAEKENKEETDKMRRDTEEDRKELKRKLDEVRKKGFREEVLKDLRRRSEEHKKKLEDDLRRHEKKSRDHKEKLKELLERHKRRVEEVRKRETK

SEQ ID NO: 12779 - protein, 175 aa, Artificial Sequence; identical to SEQ ID NO: 12778
  Synthetic

SEQ ID NO: 12780 - protein, 182 aa, Artificial Sequence
  Synthetic
SREELMEELERLLERLIREIEKASRENEERVKELKREIEESTKRNKETAKKLLDELTRSNSDEKVKRDLDRRLKELKDRNRKEEEDTKRRLEKLEKDNRDRERETDEREKEITRKVEEDVRREKKPKDELRKTLEDIRRRVEEAKERHRRILKTIKERSEKLTREHRKVNEDIEEKLRRAKK

SEQ ID NO: 12781 - protein, 182 aa, Artificial Sequence; identical to SEQ ID NO: 12780
  Synthetic

SEQ ID NO: 12782 - protein, 176 aa, Artificial Sequence
  Synthetic
SERETVERVLDRLREELEKIKKELEDVNRESKKEVERLLRRNEELHKKVEKDARDILRKKGETREDVRRELEKERRRSEDESRRLKEEDEREKKKSEERMRELDKDVKRKEDELRKKDLVGEELKKTLDKILEDAKEEVREDRKRNEKLNRELEERSRRNEEDLRRLLKKLKDEAD

SEQ ID NO: 12783 - protein, 176 aa, Artificial Sequence; identical to SEQ ID NO: 12782
  Synthetic

SEQ ID NO: 12784 - protein, 173 aa, Artificial Sequence
  Synthetic
DEKETIEERRKEIEKIIKDLEKNVRDHEKRIEEIIKEIRDNTEKLKKEAEDLLRRIRKEGNRDELRRRKEKRDRDSRRRMEEIKKRTDELAREHEETKRKIKEEEDERKERTKGKPTSRELEETLRRLDERTKKVIKEAEDVHRRLRERLRKIEKEHEDTLRELKKRLDDEAR

SEQ ID NO: 12785 - protein, 173 aa, Artificial Sequence; identical to SEQ ID NO: 12784
  Synthetic

SEQ ID NO: 12786 - protein, 186 aa, Artificial Sequence
  Synthetic
SAEDRLREADERYERELRRLKRELEEVIKEYRKAIEELKKELEDVLRRFREELKRLEEEKGTTSKEMDELKKRVEEEERKKKEEIDRNREENERRLKKVEDDTTRKEEDNRRRRKKVRDDITRRKGSGEEVREIIERLKESLKRNEEDVRRLIRRLKEELKRNKEEVERLKKELEDILRELADRAR

SEQ ID NO: 12787 - protein, 186 aa, Artificial Sequence; identical to SEQ ID NO: 12786
  Synthetic

SEQ ID NO: 12788 - protein, 186 aa, Artificial Sequence
  Synthetic
DAERELKKVEDEYEKRIRDLERDLRRVLEEYERAIEELKKELDDVLREAEKALEDLLRKKGENSEEVKEEEDRVRRKLERVREETKKNKRENDERLKRTREEMDENRKRNEKKRREVRDKIEKDKGSGEEVKEIKKELEESLKRNEDKVRELKRRLEELLKENEKKVRELIRRLEEELRRLAERTR

SEQ ID NO: 12789 - protein, 186 aa, Artificial Sequence; identical to SEQ ID NO: 12788
  Synthetic

SEQ ID NO: 12790 - protein, 186 aa, Artificial Sequence
  Synthetic
SAEEELKKVDDDYEREIRRLEKELEDVLRDVDRDHRRLEEELKKVIRDIEEALKDLLRKKGEETEELKKMAEDVRRRLEEVRRRIEKDKEDNKRKKEEIEKEIRDNREKNKRDRDRTRDKIRKDKGRGEEVREIKERLRKSLEDNERKVKEIIDRIREDLKENRDRVRKLIKDLDDELKELAKKAK

SEQ ID NO: 12791 - protein, 186 aa, Artificial Sequence; identical to SEQ ID NO: 12790
  Synthetic

SEQ ID NO: 12792 - protein, 179 aa, Artificial Sequence
  Synthetic
DEEREIEERIKRILEDLKRNLEDNERKIRKIVKDNRENNKRNEDKIRRILEELKRAKEEGNLTDDKLRRTEEETKRNSERNEEESRRTEDRERRNTERNEKKERDTREETKKDRERLRERGVETERVRKLEKDLEKALEEIRRRYEELLKRLKRENEESKKTYDKLIEELRRAAREIKR

SEQ ID NO: 12793 - protein, 179 aa, Artificial Sequence; identical to SEQ ID NO: 12792
  Synthetic

SEQ ID NO: 12794 - protein, 179 aa, Artificial Sequence
  Synthetic
DEKERIEEEIRRILRELEELTERNEKKIRDIVREIRKNSEENRRKIEKILEELEELKKEGSNTEETAKRKREEVDRNRRRNEEKARRIEEELRRNKEENDKRLEDTERELEKRRRDVRRRGVEDEEVEELLRRLRKRLEDLERRNKELLEELKERLERAEKRNRDLLKELEDALERIRK

SEQ ID NO: 12795 - protein, 179 aa, Artificial Sequence; identical to SEQ ID NO: 12794
  Synthetic

SEQ ID NO: 12796 - protein, 179 aa, Artificial Sequence
  Synthetic
DEEEEIEKKLRKNIRDAEEKTKRNKERAEDNLRKARENSKRNEEDIRRKLKRLKELKEEGNQRDEDDRRTREDSKRNEDDNDRKRRESEKDHKRNREKNKEDKERSRKRHEEETEDLKKKGLRTERVDRLKKELERMHRKLDKENRDIEKRVREEHRRLTERNRKLLEDLEEALERIRT

SEQ ID NO: 12797 - protein, 179 aa, Artificial Sequence; identical to SEQ ID NO: 12796
  Synthetic

SEQ ID NO: 12798 - protein, 179 aa, Artificial Sequence
  Synthetic
SEEEEIERRLRDNIRKAEENTRRNKEKIDRILEEMRENSKENKRRIEEILDELRKLKEEGNLTEEEAKRVREELERNKRRNDEKLERKRKDIDDNERRNREKEEKSRRDHEEETKELEKRGVRTERVDELKEKVERDHERLRKENEDLLRELRKRLDELRRENEKLLRELEEALDRIRK

SEQ ID NO: 12799 - protein, 179 aa, Artificial Sequence; identical to SEQ ID NO: 12798
  Synthetic

SEQ ID NO: 12800 - protein, 184 aa, Artificial Sequence
  Synthetic
SELERVREEIRRLERENEETLREVEEKIRKLLEENREALERVEERVRRVKEELKEVRRRQLDREELKKVEDELRRREEKIRREEDERRRRSEEDRKEEEKRTRRRSEDSERKREKTRRDISRVKDDDVRRDIERLDEEYERRHKDVNRKLKRLDDEYEKATRDVRRRLEELTKELRDEAEKVRK

SEQ ID NO: 12801 - protein, 184 aa, Artificial Sequence; identical to SEQ ID NO: 12800
  Synthetic

SEQ ID NO: 12802 - protein, 175 aa, Artificial Sequence
  Synthetic
SERERVDRLEERYEEESRRVEEELRRLLKRYEDFHRELRKRLEDIVREVRKTLKELEDRIDEEVVRTTEKRLEDLRRDLERRSRETEKRLKEIEDRLREEKEKSERDRERTKKLEDEIDTREIEKRVERLLEENEERLRRVRKEIKKALDENREILKEVEDRARKILEELRRKAK

SEQ ID NO: 12803 - protein, 175 aa, Artificial Sequence; identical to SEQ ID NO: 12802
  Synthetic

SEQ ID NO: 12804 - protein, 185 aa, Artificial Sequence
  Synthetic
SELEEVKRRVEEIKKKLKEDLDDHKRRNEKHIKELEDRLEEHRREIEELVRKLEELKRRNVDEETMKRVKEELEEMARRSKEREKDLRRRSEEAHRKSERDLEEAEKKLEEERKRIRDRARRRNSDEEVRKALKELEDDLRRVLEEIKRAHKKSKEDNKRVLDDLTEKHKRSEEELRDVLRDLER

SEQ ID NO: 12805 - protein, 185 aa, Artificial Sequence; identical to SEQ ID NO: 12804
  Synthetic

SEQ ID NO: 12806 - protein, 185 aa, Artificial Sequence
  Synthetic
SSLEELEKRNRERIEELERTLRELEERSRELNERLKRELDEHKKRIDELLEELRRLKEENVDEETLKRIEEKLRRDLRRSKERLREIKERLEREHKKIDDRKRERDKKSEKDKKDEREEVRRENSDEEVRRALEELEKSHDEVRERIKRRLDESKERNKRALEKIKRDHEESEERLRRALDRTRK

SEQ ID NO: 12807 - protein, 185 aa, Artificial Sequence; identical to SEQ ID NO: 12806
  Synthetic

SEQ ID NO: 12808 - protein, 185 aa, Artificial Sequence
  Synthetic
SSLEEVKKENEKLIKELKEELDKIRKENEEHIEKLERELERVKREAEKIKKKLEELKRENVDEKTLRELEKELRDRARKTKKETDELRRESEERHKRTDERERRLEEKSRRDERRTEDRVRREKSSKEVKDALEELKRSHRKVAKEIKEAVKESRKKNEEVAKKIKKALDELKRELDEALKEAKR

SEQ ID NO: 12809 - protein, 185 aa, Artificial Sequence; identical to SEQ ID NO: 12808
  Synthetic

SEQ ID NO: 12810 - protein, 183 aa, Artificial Sequence
  Synthetic
DEVETLEERVRRLKKELRDELKRNEDKVRKLKRELEESLKENAKKVEEVERDLERVKREGSDREEKRDERRRRTDKNREDNREDERRKEEDTEKNERDNERRTREVKRTADEDEKDLKRSNRETDEVRREIERLKRELERVIREYREAIERLKRDLKRAIDKYREDIKRLEEKLRRVDKELEK

SEQ ID NO: 12811 - protein, 183 aa, Artificial Sequence; identical to SEQ ID NO: 12810
  Synthetic

SEQ ID NO: 12812 - protein, 179 aa, Artificial Sequence
  Synthetic
SEVERVREENKRSEEKLKKLLEDSRRNLEENRKRLEELLRKSEENLERLKRELDELRKQNIKDSRDEKRTKDRLDRHREEVKRAEDRSREEHKRHKERVEREERKEERRNEEEEEDLRRKGVETEDLRRNRETNEELRDRVRRTHEKLEREAEKVHEDVRRRHKELEDEVREVLKELRR

SEQ ID NO: 12813 - protein, 179 aa, Artificial Sequence; identical to SEQ ID NO: 12812
  Synthetic

SEQ ID NO: 12814 - protein, 179 aa, Artificial Sequence
  Synthetic
SDEELIKRIREELERLLKELRDTIKEVEDRNRESLEDLDRVHKRIKEEIERLEKDLDVEEELLKRMREELTELHKENKERKERDEEKNRRVRERLEEEERKEEKEIRDVEREDKDSDRPSEELAKKLKDELRRAKDKVEEIKKRIRDTLEDNRKKAEELKRKNEEDLRRFEKKAEDVRK

SEQ ID NO: 12815 - protein, 179 aa, Artificial Sequence; identical to SEQ ID NO: 12814
  Synthetic

SEQ ID NO: 12816 - protein, 172 aa, Artificial Sequence
  Synthetic
SKEDKAREDVKRTIEELKDRNRKLNDKIRKTIEDLERRNEELNKENKDLVDELRDGDRRDEEIRKRSTEYRKRTEETDEEVERTERELRKELRDEDRKLKRRKDEIERKIREDNLPEEVLRELREEIEKLEKEHRDNVRKLERDLDRLRKKHEDNKERLERHTRRVEEEKRR

SEQ ID NO: 12817 - protein, 172 aa, Artificial Sequence; identical to SEQ ID NO: 12816
  Synthetic

SEQ ID NO: 12818 - protein, 179 aa, Artificial Sequence
  Synthetic
STEEDVRKIVDDARRNLEENKRRIEKIVKELEDKLRENEKKIRKILEDIRRLLEKFKRDDDKREEVEERIRTTKERTEDDTRRNTEENKKTSERKKKEIDDNSRRNEEKRKRIEDKERRDNLPEDIMRDLRRRLERIAREYKRLLDELKKRLDDIKKTYEDLLRRLREEIERAEEKARR

SEQ ID NO: 12819 - protein, 179 aa, Artificial Sequence; identical to SEQ ID NO: 12818
  Synthetic

SEQ ID NO: 12820 - protein, 179 aa, Artificial Sequence
  Synthetic
DEEEEVRKILEEIKKELDDNERRIRKNIRDAEETLRENEKRIRDILKEIEDLLKELKDRDDKREELEERIRREAKKKREELKRNEEDNERRREKSEREHRENSKRNKKRRDDTEERERRANLSEDILEKLRRDIERADEEYKRLEEELRRKHDEIRKTYEKLLKELEEAIERVEREAEK

SEQ ID NO: 12821 - protein, 179 aa, Artificial Sequence; identical to SEQ ID NO: 12820
  Synthetic

SEQ ID NO: 12822 - protein, 175 aa, Artificial Sequence
  Synthetic
SSKDLLEELRRTVEEVRKRSDDLSRESEEATRRVRKEHDRINKEVEDELRRVREDGERPKEAEEEAKEIRKKTEKETRDIREEIKRLRDEYEKTKKRLEDEKKKLEEDTEEIERRGSVSEDIVREMRKRLEELLRENEKRNEELLRRLKELLDRSRERVREIEERLRELLEEVRR

SEQ ID NO: 12823 - protein, 175 aa, Artificial Sequence; identical to SEQ ID NO: 12822
  Synthetic

SEQ ID NO: 12824 - protein, 182 aa, Artificial Sequence
  Synthetic
DAEKLKRDYEEKSRRVKETLDDLVRRYREEHRRVNEELRKLLEDLKKTVEDVEKEEGSSGEKARELEKTKKTLEEELKRIEEEVKEISERSKEKEERIKKEVKEIRDKSERDKKEIDDKRIDSERLEREIRKLEEENKRTLERVKEKIERLLEENEKVLKEVRDKVKTIKDRLRKLVEEIRR

SEQ ID NO: 12825 - protein, 182 aa, Artificial Sequence; identical to SEQ ID NO: 12824
  Synthetic

SEQ ID NO: 12826 - protein, 175 aa, Artificial Sequence
  Synthetic
SVEDEVRKIKRRLEEALERSEKKVRDMVRRNKEFLERAKRRVEEVVKENERALEEVKRRGNGEKELEDLHRKNREDKERERKDARKLHEDNRDEHRKHEEELRKLRRDLERKEKDADIDEEILRRVRKTVKDVEDTLKELNDRLEKIHREVKKELDRLLKELDDRHRKVAEDLKK

SEQ ID NO: 12827 - protein, 175 aa, Artificial Sequence; identical to SEQ ID NO: 12826
  Synthetic

SEQ ID NO: 12828 - protein, 180 aa, Artificial Sequence
  Synthetic
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRESVKKVEEIARDIRRKVDESVKNVEKLLRDVDKKARDRKK

SEQ ID NO: 12829 - protein, 180 aa, Artificial Sequence; identical to SEQ ID NO: 12828
  Synthetic

SEQ ID NO: 12830 - protein, 172 aa, Artificial Sequence
  Synthetic
DEVEKVLEEIKRALDDLRKKVEESKREIKEALKAVEKHTRDSDTANKRTLAEIERGVKSKDTERVRKLVEELSEENERSLREVRRVAEELLEINERVLEEVERVVEALLDLVRRGGSERVVEEVRRVLEELRRRLEKVTEDSRRAIERLAREDARVSKKSIDVNKKLDDDVR

SEQ ID NO: 12831 - protein, 172 aa, Artificial Sequence; identical to SEQ ID NO: 12830
  Synthetic

SEQ ID NO: 12832 - protein, 178 aa, Artificial Sequence
  Synthetic
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERVFREVEKIVRENTKLAEDSVRELKRLVEELKKRAK

SEQ ID NO: 12833 - protein, 178 aa, Artificial Sequence; identical to SEQ ID NO: 12832
  Synthetic

SEQ ID NO: 12834 - protein, 177 aa, Artificial Sequence
  Synthetic
SAADEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRGSGSEDLVREVEKRVRDIVEESRKLAEETRKAVEDIIEKSKRIAEDTLEKNKEMVERLER

SEQ ID NO: 12835 - protein, 177 aa, Artificial Sequence; identical to SEQ ID NO: 12834
  Synthetic

SEQ ID NO: 12836 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 12837 - protein, 174 aa, Artificial Sequence; identical to SEQ ID NO: 12836
  Synthetic

SEQ ID NO: 12838 - protein, 174 aa, Artificial Sequence; identical to SEQ ID NO: 12836
  Synthetic

SEQ ID NO: 12839 - protein, 174 aa, Artificial Sequence; identical to SEQ ID NO: 12836
  Synthetic

SEQ ID NO: 12840 - protein, 174 aa, Artificial Sequence
  Synthetic
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 12841 - protein, 174 aa, Artificial Sequence; identical to SEQ ID NO: 12840
  Synthetic

SEQ ID NO: 12842 - protein, 174 aa, Artificial Sequence; identical to SEQ ID NO: 12840
  Synthetic

SEQ ID NO: 12843 - protein, 174 aa, Artificial Sequence; identical to SEQ ID NO: 12840
  Synthetic

SEQ ID NO: 12844 - protein, 178 aa, Artificial Sequence
  Synthetic
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDSEELREELKKLERKIEKVAKEIHDHDKEVTERLEDLLRRITEHARKSDREIEETAR

SEQ ID NO: 12845 - protein, 178 aa, Artificial Sequence; identical to SEQ ID NO: 12844
  Synthetic

SEQ ID NO: 12846 - protein, 178 aa, Artificial Sequence; identical to SEQ ID NO: 12844
  Synthetic

SEQ ID NO: 12847 - protein, 178 aa, Artificial Sequence; identical to SEQ ID NO: 12844
  Synthetic

SEQ ID NO: 12848 - protein, 181 aa, Artificial Sequence
  Synthetic
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRSKETKDLLDENSKRSNEISREVKKDLERTVRENKKIVDEVAKALEDTVDKNRRIVEEVTT

SEQ ID NO: 12849 - protein, 181 aa, Artificial Sequence; identical to SEQ ID NO: 12848
  Synthetic

SEQ ID NO: 12850 - protein, 185 aa, Artificial Sequence
  Synthetic
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDENAKIVEDARRALEKIVKENEEILRRLKKELRELRK

SEQ ID NO: 12851 - protein, 185 aa, Artificial Sequence; identical to SEQ ID NO: 12850
  Synthetic

SEQ ID NO: 12852 - protein, 172 aa, Artificial Sequence
  Synthetic
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 12853 - protein, 172 aa, Artificial Sequence; identical to SEQ ID NO: 12852
  Synthetic

SEQ ID NO: 12854 - protein, 172 aa, Artificial Sequence; identical to SEQ ID NO: 12852
  Synthetic

SEQ ID NO: 12855 - protein, 172 aa, Artificial Sequence; identical to SEQ ID NO: 12852
  Synthetic

SEQ ID NO: 12856 - protein, 177 aa, Artificial Sequence
  Synthetic
DEVRELLERNRRLLEEIKKTVKDLIRANEELLKRIEDDAKRLIDRNEELLDELEKGLSDDETIREAKERLKASLEDVKRRVEEVKRLLEKSLEEVETIIREAEKRNRDSLREMERRGSSEELEELRRVVEESDETIKRLLEEAKESVDRSLDRIRKLLEDVRRSVERSAKRIDEKRK

SEQ ID NO: 12857 - protein, 177 aa, Artificial Sequence; identical to SEQ ID NO: 12856
  Synthetic

SEQ ID NO: 12858 - protein, 180 aa, Artificial Sequence
  Synthetic
STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRVLEELRKESKRVVDETRKLSEENLEHSERVLRKVEEDLR

SEQ ID NO: 12859 - protein, 180 aa, Artificial Sequence; identical to SEQ ID NO: 12858
  Synthetic

SEQ ID NO: 12860 - protein, 188 aa, Artificial Sequence
  Synthetic
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD

SEQ ID NO: 12861 - protein, 188 aa, Artificial Sequence; identical to SEQ ID NO: 12860
  Synthetic

SEQ ID NO: 12862 - protein, 178 aa, Artificial Sequence
  Synthetic
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 12863 - protein, 178 aa, Artificial Sequence; identical to SEQ ID NO: 12862
  Synthetic

SEQ ID NO: 12864 - protein, 178 aa, Artificial Sequence; identical to SEQ ID NO: 12862
  Synthetic

SEQ ID NO: 12865 - protein, 178 aa, Artificial Sequence; identical to SEQ ID NO: 12862
  Synthetic

SEQ ID NO: 12866 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIEKVLKEIEEKIREVIKEWERVHREVEELLKRLIDENRKVLDEIRKLLEEKSK

SEQ ID NO: 12867 - protein, 179 aa, Artificial Sequence; identical to SEQ ID NO: 12866
  Synthetic

SEQ ID NO: 12868 - protein, 179 aa, Artificial Sequence; identical to SEQ ID NO: 12866
  Synthetic

SEQ ID NO: 12869 - protein, 179 aa, Artificial Sequence; identical to SEQ ID NO: 12866
  Synthetic

SEQ ID NO: 12870 - protein, 182 aa, Artificial Sequence
  Synthetic
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDIKRALDELLKELEKSVRESEERLRRLLEEVKRVIEEVAT

SEQ ID NO: 12871 - protein, 182 aa, Artificial Sequence; identical to SEQ ID NO: 12870
  Synthetic

SEQ ID NO: 12872 - protein, 186 aa, Artificial Sequence
  Synthetic
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDEALEAHRELSRRLEEELERLLREIERLVEEVTR

SEQ ID NO: 12873 - protein, 186 aa, Artificial Sequence; identical to SEQ ID NO: 12872
  Synthetic

SEQ ID NO: 12874 - protein, 176 aa, Artificial Sequence
  Synthetic
SVDEVLKEIEDALRRLKEEVERVLKENEDELRRLEEEVRRVLKEDEELLESLKRGVGESDEVDRVVDEIAKLSAEILEKVKKVVKEIRDSLETVKRRVDDVVRRLKELLDEIKRGSDEKAIRDVAKEIRDRLKELEEEIEEVTRRNLKLLADVEEEIRRVHEKTRRLLETVLRRAT

SEQ ID NO: 12875 - protein, 176 aa, Artificial Sequence; identical to SEQ ID NO: 12874
  Synthetic

SEQ ID NO: 12876 - protein, 184 aa, Artificial Sequence
  Synthetic
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKEELDRIEEELKRLIDTLREKNREVEKRARDSNRDLKRTNDEIAKEVRELIKKLREDLK

SEQ ID NO: 12877 - protein, 184 aa, Artificial Sequence; identical to SEQ ID NO: 12876
  Synthetic

SEQ ID NO: 12878 - protein, 174 aa, Artificial Sequence
  Synthetic
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 12879 - protein, 174 aa, Artificial Sequence; identical to SEQ ID NO: 12878
  Synthetic

SEQ ID NO: 12880 - protein, 174 aa, Artificial Sequence; identical to SEQ ID NO: 12878
  Synthetic

SEQ ID NO: 12881 - protein, 174 aa, Artificial Sequence; identical to SEQ ID NO: 12878
  Synthetic

SEQ ID NO: 12882 - protein, 174 aa, Artificial Sequence
  Synthetic
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 12883 - protein, 174 aa, Artificial Sequence; identical to SEQ ID NO: 12882
  Synthetic

SEQ ID NO: 12884 - protein, 174 aa, Artificial Sequence; identical to SEQ ID NO: 12882
  Synthetic

SEQ ID NO: 12885 - protein, 174 aa, Artificial Sequence; identical to SEQ ID NO: 12882
  Synthetic

SEQ ID NO: 12886 - protein, 178 aa, Artificial Sequence
  Synthetic
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKERLKELLRELKKLSDENKERIKKLLSDAEKIIEDVARRAK

SEQ ID NO: 12887 - protein, 178 aa, Artificial Sequence; identical to SEQ ID NO: 12886
  Synthetic

SEQ ID NO: 12888 - protein, 177 aa, Artificial Sequence
  Synthetic
SSEERLRAVIEDLKRLAEESRKRHKELIDELAKAVERIERRHKKLLDEIKAVVDDIRRGVSEELLKRIEEVLDEIRKELEENIKRIRKVLDELRRTSEENIARIEKVLRELEDLVRKGGSDADTIIEEVKRVLEELARSTEEVEKRVRDAIEELERSSEELARRIKEVLKRLEEETR

SEQ ID NO: 12889 - protein, 177 aa, Artificial Sequence; identical to SEQ ID NO: 12888
  Synthetic

SEQ ID NO: 12890 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRELEERVKELEKEAREILKRSEDETDKLREKAERILEDLERANRRTMDEARR

SEQ ID NO: 12891 - protein, 178 aa, Artificial Sequence; identical to SEQ ID NO: 12890
  Synthetic

SEQ ID NO: 12892 - protein, 178 aa, Artificial Sequence; identical to SEQ ID NO: 12890
  Synthetic

SEQ ID NO: 12893 - protein, 178 aa, Artificial Sequence; identical to SEQ ID NO: 12890
  Synthetic

SEQ ID NO: 12894 - protein, 184 aa, Artificial Sequence
  Synthetic
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 12895 - protein, 184 aa, Artificial Sequence; identical to SEQ ID NO: 12894
  Synthetic

SEQ ID NO: 12896 - protein, 184 aa, Artificial Sequence; identical to SEQ ID NO: 12894
  Synthetic

SEQ ID NO: 12897 - protein, 184 aa, Artificial Sequence; identical to SEQ ID NO: 12894
  Synthetic

SEQ ID NO: 12898 - protein, 176 aa, Artificial Sequence
  Synthetic
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNEETIRRSEELVRRIERVIEEIIKRSEKLLEDVARESK

SEQ ID NO: 12899 - protein, 176 aa, Artificial Sequence; identical to SEQ ID NO: 12898
  Synthetic

SEQ ID NO: 12900 - protein, 176 aa, Artificial Sequence; identical to SEQ ID NO: 12898
  Synthetic

SEQ ID NO: 12901 - protein, 176 aa, Artificial Sequence; identical to SEQ ID NO: 12898
  Synthetic

SEQ ID NO: 12902 - protein, 176 aa, Artificial Sequence
  Synthetic
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIKHSEEVLERVKRLIDELRKHSEEVLEDLRRRAK

SEQ ID NO: 12903 - protein, 176 aa, Artificial Sequence; identical to SEQ ID NO: 12902
  Synthetic

SEQ ID NO: 12904 - protein, 176 aa, Artificial Sequence; identical to SEQ ID NO: 12902
  Synthetic

SEQ ID NO: 12905 - protein, 176 aa, Artificial Sequence; identical to SEQ ID NO: 12902
  Synthetic

SEQ ID NO: 12906 - protein, 182 aa, Artificial Sequence
  Synthetic
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRKTEEAVKRSTETNKRLLEASKEVADRLRERIKEAAK

SEQ ID NO: 12907 - protein, 182 aa, Artificial Sequence; identical to SEQ ID NO: 12906
  Synthetic

SEQ ID NO: 12908 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 12909 - protein, 186 aa, Artificial Sequence; identical to SEQ ID NO: 12908
  Synthetic

SEQ ID NO: 12910 - protein, 186 aa, Artificial Sequence; identical to SEQ ID NO: 12908
  Synthetic

SEQ ID NO: 12911 - protein, 186 aa, Artificial Sequence; identical to SEQ ID NO: 12908
  Synthetic

SEQ ID NO: 12912 - protein, 186 aa, Artificial Sequence
  Synthetic
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 12913 - protein, 186 aa, Artificial Sequence; identical to SEQ ID NO: 12912
  Synthetic

SEQ ID NO: 12914 - protein, 180 aa, Artificial Sequence
  Synthetic
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYTRESIRRAKKEIERLNRETKKVIEEVVKRIEEERK

SEQ ID NO: 12915 - protein, 180 aa, Artificial Sequence; identical to SEQ ID NO: 12914
  Synthetic

SEQ ID NO: 12916 - protein, 180 aa, Artificial Sequence; identical to SEQ ID NO: 12914
  Synthetic

SEQ ID NO: 12917 - protein, 180 aa, Artificial Sequence; identical to SEQ ID NO: 12914
  Synthetic

SEQ ID NO: 12918 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSREIKRLLEESERVMKRSSEDIKRTLDDTRRVVEEVRR

SEQ ID NO: 12919 - protein, 181 aa, Artificial Sequence; identical to SEQ ID NO: 12918
  Synthetic

SEQ ID NO: 12920 - protein, 181 aa, Artificial Sequence; identical to SEQ ID NO: 12918
  Synthetic

SEQ ID NO: 12921 - protein, 181 aa, Artificial Sequence; identical to SEQ ID NO: 12918
  Synthetic

SEQ ID NO: 12922 - protein, 177 aa, Artificial Sequence
  Synthetic
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEEALSKAIKDVRDIVKKVKDELKEWRDRNKELVDRLSEELKEWLKDVERVLKELTDKDR

SEQ ID NO: 12923 - protein, 177 aa, Artificial Sequence; identical to SEQ ID NO: 12922
  Synthetic

SEQ ID NO: 12924 - protein, 175 aa, Artificial Sequence
  Synthetic
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDENDKLLKEIEDSLRRHKEENDRLLEKLKESTR

SEQ ID NO: 12925 - protein, 175 aa, Artificial Sequence; identical to SEQ ID NO: 12924
  Synthetic

SEQ ID NO: 12926 - protein, 175 aa, Artificial Sequence; identical to SEQ ID NO: 12924
  Synthetic

SEQ ID NO: 12927 - protein, 175 aa, Artificial Sequence; identical to SEQ ID NO: 12924
  Synthetic

SEQ ID NO: 12928 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLLEELKRELEKSTRSVKALVDELRERVR

SEQ ID NO: 12929 - protein, 185 aa, Artificial Sequence; identical to SEQ ID NO: 12928
  Synthetic

SEQ ID NO: 12930 - protein, 185 aa, Artificial Sequence; identical to SEQ ID NO: 12928
  Synthetic

SEQ ID NO: 12931 - protein, 185 aa, Artificial Sequence; identical to SEQ ID NO: 12928
  Synthetic

SEQ ID NO: 12932 - protein, 175 aa, Artificial Sequence
  Synthetic
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRELEELLKESEERIKRIEEEIKKIIDKSREDIKRVLEEIERLNAKAADDLRK

SEQ ID NO: 12933 - protein, 175 aa, Artificial Sequence; identical to SEQ ID NO: 12932
  Synthetic

SEQ ID NO: 12934 - protein, 181 aa, Artificial Sequence
  Synthetic
SEVDDVLRRLEELIKTLEDINAKSLEDIKKLIDDLAKILEDALRKHEKLIRELREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 12935 - protein, 181 aa, Artificial Sequence; identical to SEQ ID NO: 12934
  Synthetic

SEQ ID NO: 12936 - protein, 181 aa, Artificial Sequence; identical to SEQ ID NO: 12934
  Synthetic

SEQ ID NO: 12937 - protein, 181 aa, Artificial Sequence; identical to SEQ ID NO: 12934
  Synthetic

SEQ ID NO: 12938 - protein, 178 aa, Artificial Sequence
  Synthetic
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEEEHRKVLETDKKILKEAHKESKEVNDRDRELLERLEESVR

SEQ ID NO: 12939 - protein, 178 aa, Artificial Sequence; identical to SEQ ID NO: 12938
  Synthetic

SEQ ID NO: 12940 - protein, 178 aa, Artificial Sequence
  Synthetic
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRELEAVLKKLTDESERLNREVERVSRDTKKKSKELNEELKAVLDEVKRKAD

SEQ ID NO: 12941 - protein, 178 aa, Artificial Sequence; identical to SEQ ID NO: 12940
  Synthetic

SEQ ID NO: 12942 - protein, 181 aa, Artificial Sequence
  Synthetic
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKDLKELLERYEEIVRRIKELLKDLNREAEEVVRRLKEELR

SEQ ID NO: 12943 - protein, 181 aa, Artificial Sequence; identical to SEQ ID NO: 12942
  Synthetic

SEQ ID NO: 12944 - protein, 174 aa, Artificial Sequence
  Synthetic
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAEEVLRRVKKIVEENRKIASEVLDDVRKLVEDVLARAS

SEQ ID NO: 12945 - protein, 174 aa, Artificial Sequence; identical to SEQ ID NO: 12944
  Synthetic

SEQ ID NO: 12946 - protein, 183 aa, Artificial Sequence
  Synthetic
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 12947 - protein, 183 aa, Artificial Sequence; identical to SEQ ID NO: 12946
  Synthetic

SEQ ID NO: 12948 - protein, 183 aa, Artificial Sequence; identical to SEQ ID NO: 12946
  Synthetic

SEQ ID NO: 12949 - protein, 183 aa, Artificial Sequence; identical to SEQ ID NO: 12946
  Synthetic

SEQ ID NO: 12950 - protein, 173 aa, Artificial Sequence
  Synthetic
SAEEVKEELKRIATKLKEEIKENIRRLEESVEKIAKELAENIKRLEDILRDVKRGLRDERIVKTVEDIARRVVEDNERIMEEDKDVVRRLVERNEEIVRRVDETVKKIVELIDRGEPGEELVERLRRVVEEVRERLKDSSRELRKINEDSRKAVEDSSAEVAKVVEELERRDT

SEQ ID NO: 12951 - protein, 173 aa, Artificial Sequence; identical to SEQ ID NO: 12950
  Synthetic

SEQ ID NO: 12952 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLIREVEELVRAHNKRNKELVDEVKRLVEKVIEEER

SEQ ID NO: 12953 - protein, 175 aa, Artificial Sequence; identical to SEQ ID NO: 12952
  Synthetic

SEQ ID NO: 12954 - protein, 175 aa, Artificial Sequence; identical to SEQ ID NO: 12952
  Synthetic

SEQ ID NO: 12955 - protein, 175 aa, Artificial Sequence; identical to SEQ ID NO: 12952
  Synthetic

SEQ ID NO: 12956 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLRRLNEELDRSLERAERTIRELAK

SEQ ID NO: 12957 - protein, 183 aa, Artificial Sequence; identical to SEQ ID NO: 12956
  Synthetic

SEQ ID NO: 12958 - protein, 183 aa, Artificial Sequence; identical to SEQ ID NO: 12956
  Synthetic

SEQ ID NO: 12959 - protein, 183 aa, Artificial Sequence; identical to SEQ ID NO: 12956
  Synthetic

SEQ ID NO: 12960 - protein, 173 aa, Artificial Sequence
  Synthetic
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLAEESLKRLEDLSRDHKRRAKELNDEIAKVVDELAKRAT

SEQ ID NO: 12961 - protein, 173 aa, Artificial Sequence; identical to SEQ ID NO: 12960
  Synthetic

SEQ ID NO: 12962 - protein, 180 aa, Artificial Sequence
  Synthetic
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGSSEETVKRLLDELRELLERLKRTIEELLKRNRDLLADAEEKARRLLEENRKLLKAARDTAT

SEQ ID NO: 12963 - protein, 180 aa, Artificial Sequence; identical to SEQ ID NO: 12962
  Synthetic

SEQ ID NO: 12964 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKEENRKVNEEVEKRLRELEEENKKVIEDLKSTVEELVERLR

SEQ ID NO: 12965 - protein, 177 aa, Artificial Sequence; identical to SEQ ID NO: 12964
  Synthetic

SEQ ID NO: 12966 - protein, 177 aa, Artificial Sequence; identical to SEQ ID NO: 12964
  Synthetic

SEQ ID NO: 12967 - protein, 177 aa, Artificial Sequence; identical to SEQ ID NO: 12964
  Synthetic

SEQ ID NO: 12968 - protein, 180 aa, Artificial Sequence
  Synthetic
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 12969 - protein, 180 aa, Artificial Sequence; identical to SEQ ID NO: 12968
  Synthetic

SEQ ID NO: 12970 - protein, 177 aa, Artificial Sequence
  Synthetic
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEELLKRVEKLTEDAKRDLERSNREHKELADRIKETAR

SEQ ID NO: 12971 - protein, 177 aa, Artificial Sequence; identical to SEQ ID NO: 12970
  Synthetic

SEQ ID NO: 12972 - protein, 177 aa, Artificial Sequence; identical to SEQ ID NO: 12970
  Synthetic

SEQ ID NO: 12973 - protein, 177 aa, Artificial Sequence; identical to SEQ ID NO: 12970
  Synthetic

SEQ ID NO: 12974 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 12975 - protein, 185 aa, Artificial Sequence; identical to SEQ ID NO: 12974
  Synthetic

SEQ ID NO: 12976 - protein, 185 aa, Artificial Sequence; identical to SEQ ID NO: 12974
  Synthetic

SEQ ID NO: 12977 - protein, 185 aa, Artificial Sequence; identical to SEQ ID NO: 12974
  Synthetic

SEQ ID NO: 12978 - protein, 180 aa, Artificial Sequence
  Synthetic
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEAVRRLKEILERLKEEVRRSLEELRKEVERLKKEVEDSLRELKKSLEEWVKSLEEATR

SEQ ID NO: 12979 - protein, 180 aa, Artificial Sequence; identical to SEQ ID NO: 12978
  Synthetic

SEQ ID NO: 12980 - protein, 180 aa, Artificial Sequence; identical to SEQ ID NO: 12978
  Synthetic

SEQ ID NO: 12981 - protein, 180 aa, Artificial Sequence; identical to SEQ ID NO: 12978
  Synthetic

SEQ ID NO: 12982 - protein, 172 aa, Artificial Sequence
  Synthetic
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLARVLKESEDDLAEILRRLKEVLEESERDLERVEREVRK

SEQ ID NO: 12983 - protein, 172 aa, Artificial Sequence; identical to SEQ ID NO: 12982
  Synthetic

SEQ ID NO: 12984 - protein, 252 aa, Artificial Sequence
  Synthetic
SEAEEAAERAKRAAKEAVERAKRAVERNEEAARRAAEKAREATERAERAARRAADKARKATDRRALRDAAKELEDAARENADALRKAIEDLARATDEAIKAAREAAKRLKDAAKEALDAARRTARDEDAERILRELKEAIERAARRLDRLLREWEKAAERIKRDAERLLEEWERAAEKIRKELEDIDRKAKDIKDAADKLAEAAKRAVDISKKAADDLKRLAKEDNEIAREAARRLAEAAKEAVKLVDDVTR

SEQ ID NO: 12985 - protein, 252 aa, Artificial Sequence; identical to SEQ ID NO: 12984
  Synthetic

SEQ ID NO: 12986 - protein, 233 aa, Artificial Sequence
  Synthetic
SEKEKAAEDLRRAIEEAKKRSEEAAKELEDALRKAEKEARDSAETLKEAAKRAADAGAPEEALRALEEAIKKAIKASKDALDALREAIKESIDSNREALKALKEAVERAEEGGDREIARRAAERAREAAKRAAEKNKRAARKAEEAAKRAVDEHRKAAKEAREAAERAVRKAEDKDAATEAKKAADTIAKLIEDNAKRALEAAREIAKLIEKSAKEALEAAERIARLIEEAAN

SEQ ID NO: 12987 - protein, 233 aa, Artificial Sequence; identical to SEQ ID NO: 12986
  Synthetic

SEQ ID NO: 12988 - protein, 234 aa, Artificial Sequence
  Synthetic
SVEEAARRAAKALKDAAKKLLEANEKAARAWKELAKELIKADEKALKILEEAARKARRDGPDKEIEKELRKAAREYEEIIKDLREKAKKVLEEYRRIVKKLEEDLKRALDKLREDGVKKDALDAARRAAELLAEAAKKAAKAHEEAARLLAKAAEDSARAAKEAAELLRRALEENKRAEEAAKEAIRIAEEALRRSAEAAERAARIAEDAARKSRKAAEDAAKIAKEAADRARK

SEQ ID NO: 12989 - protein, 234 aa, Artificial Sequence; identical to SEQ ID NO: 12988
  Synthetic

SEQ ID NO: 12990 - protein, 239 aa, Artificial Sequence
  Synthetic
SEEDRLRELAERARRLAKRNRELAKEIIDEIRKLIRDAREAAKKSAEKAKRLIDDARRVAGKPTDRKIVETLARRSAKANEENARLIKRLAEEAIRAAKKAADADRKSAKEVIDALKRIAEDLQAREAADAARRAAKIAKEAADEAIKAWEDAARIAERAARKSIEANKRAIKIAREAAERNAIEEAAKANEEAIKASEEAVDEAARALEEAAEASKRANEKADKALEDAVRAAEEATR

SEQ ID NO: 12991 - protein, 239 aa, Artificial Sequence; identical to SEQ ID NO: 12990
  Synthetic

SEQ ID NO: 12992 - protein, 238 aa, Artificial Sequence
  Synthetic
SEKEDVLRRIREAHERNKRLLERVAEEIKRIVEESRKLLEDVRKKAEDAARRAEEALRKEARDDEKAAEELAKILEDLARLLEEAARRNAKLLRDIAELVKRAAEENAKSNEEIARLLKEAGADDTAAKKVKEAADESLKAAEEAAKKIEEAARKSLEAARRAAEKIKRAAEKAREAAREKAKEALLKAAKEALEALEEALRLIAKATEEAARAAKEALDLILEADRKSAKAAEEALR

SEQ ID NO: 12993 - protein, 238 aa, Artificial Sequence; identical to SEQ ID NO: 12992
  Synthetic

SEQ ID NO: 12994 - protein, 238 aa, Artificial Sequence
  Synthetic
SEREEVAKRATDAHEENERLLREVEKRIKEALERNEELLKRVSDKAREAAKKLEDALRRRARDDERAAEELVKALEDLARLIEEAAKRNAESLREIAKLVRRAAEENAKSNKDLAKLLKDAGADDDAARKVKEAAEESLKAAEEAVKKIEDAARKSLKAAKEAAEKIRKAAEEARRAAEERAKEALRRAAKKALDAAEEALELIRKASKEAADAAREALKLILEADKKSLEAAREALR

SEQ ID NO: 12995 - protein, 238 aa, Artificial Sequence; identical to SEQ ID NO: 12994
  Synthetic

SEQ ID NO: 12996 - protein, 244 aa, Artificial Sequence
  Synthetic
SEREEIEEIKKRVDRTLEEYERKVEDIRRKLTELKDESDKKVKDVRRKLKETEDRVREEGSSEVIERIIEDVKKILEDLVRVHRESLDTAVRIAEELVRVARESIKRVKEILRELAEASKTKDEEKLREILERVKEKLKKIIDDNREVLKRVEEKVKEIIKRNKDVNDRVREELKRLAEELERANVEELRELIERLVRIAEEVSEEDERVLRSLEDILRKVVEENERLLERLKRILEELIRRTR

SEQ ID NO: 12997 - protein, 244 aa, Artificial Sequence; identical to SEQ ID NO: 12996
  Synthetic

SEQ ID NO: 12998 - protein, 245 aa, Artificial Sequence
  Synthetic
SEDEELKKELEKLLKELEEKLEKYRDDLRKDKERLKEKLDRYRERLRELMEELKDLLDKRVRAKELLDRIREIIKESADANRELLEEIRKTLEKSKRMNEELLKKIKEIIERIEERLRKRGVPEEVLRTLAEKARRLLEELKKESERIVREAEEILKRIEEELREVHKELEEILRRIKRKLDEETSEDVLRDIVRRVVEVLRKNLKIVEEIIRKIEELLEKNLRLVEEILRRIARLLEEVLEKTR

SEQ ID NO: 12999 - protein, 245 aa, Artificial Sequence; identical to SEQ ID NO: 12998
  Synthetic

SEQ ID NO: 13000 - protein, 242 aa, Artificial Sequence
  Synthetic
SDAEVIEELVRLHRKLLEDILKLLKELVDIHRETLRRIEEIVERIVRLIEALLDKIRKEGKVDEAADEVDRRLKRLAEEIERLVRETERIIREVLKELERTLRETEKRIEDVKKELEERGTDEKLRRLLEMLRKLHEEVAEVVRRVVKLLLDNHKEVIDRVREVLEKLRTVLKELVDVASDSRKEALERLLERLKEIVDRIKEELDRLLKRSEDSIREIEERVKRLLEESKRVVDEIRERLK

SEQ ID NO: 13001 - protein, 242 aa, Artificial Sequence; identical to SEQ ID NO: 13000
  Synthetic

SEQ ID NO: 13002 - protein, 236 aa, Artificial Sequence
  Synthetic
SKEKKILDRLRELLKESRDLNRRVKETLKKLLEDSKRLLDEIRKRLKELLDELEKENKVPEELIRTVREALERLLRRLERHTDELRKALEDLLRRLEEHNDELEDALREILDVKRRRDEDERELRRKIEELKRRSDKLRRELKEEIKRLRDRSRKVKEEIERELKKLKEEIDRVLRETRNDEAVKRLKEVLDEVAELVKTLLEVNRKILEDVDKLIEEVLKLNDDILREVVKLAED

SEQ ID NO: 13003 - protein, 236 aa, Artificial Sequence; identical to SEQ ID NO: 13002
  Synthetic

SEQ ID NO: 13004 - protein, 243 aa, Artificial Sequence
  Synthetic
SEKEKLLEDIADIARKILKLLKEHLDKLRKLLEEIRRLLEEHSRVLRELIERILDALRRKKKLPEEELKRVAERLKELLDRSERRLREITERLKRLLEESERSLEEIKRRIEKLLDDLRKLSKRVDEDELLERLLEVLKRVVDLVREHNELNERILEEVLKLVEELLRFNEEVLKEIADLVRRVVGQDKDLERELKRVKEISRKLEEELKELKERVKRDSEKMNEDLDRLLEDAERRIRKTRE

SEQ ID NO: 13005 - protein, 243 aa, Artificial Sequence; identical to SEQ ID NO: 13004
  Synthetic

SEQ ID NO: 13006 - protein, 237 aa, Artificial Sequence
  Synthetic
SEEDKVLEELKRLLEELLRKHEEVLKEIKELLDKIIKKHEESLRRIKKLAEEIKERAKKPTSDEVLEEIERRLRREEEENEKILRELRREIEEARRRSEEILRRLRDKLRRLEERVRDDELLRRAAEIVDRVLKVHDKVIDDLKKILETILKIHKEVVERLSDIIRELLELIKEGRDGKTLTEELKRIEDKLEELIRRSKDELDKIVREAEKIIEESKRRLEKLLRELERIIEDAKR

SEQ ID NO: 13007 - protein, 237 aa, Artificial Sequence; identical to SEQ ID NO: 13006
  Synthetic

SEQ ID NO: 13008 - protein, 243 aa, Artificial Sequence
  Synthetic
SELEELVKRIEKTLRDLRRKNEELRKEVEEVEREDRERLERAAEDLERVEKKVEDEVRRRRDKSVVDKIIKDLRELLKKLLDIHADLSRKNLELLERLLRISKESVRELERLLRELLEEIRKAGRISEEELKRLKEEIETLSKRIEDIHRRLETELERLRKENREILERLKEELRRLDEEESRRRPIEKTIEDARRLLEKILKLHRENSEESRRLIEDINRVNRELIDEVAELAKKILRRVEE

SEQ ID NO: 13009 - protein, 243 aa, Artificial Sequence; identical to SEQ ID NO: 13008
  Synthetic

SEQ ID NO: 13010 - protein, 239 aa, Artificial Sequence
  Synthetic
RDEELLERVERLLRELLDTNRRKLEEVEKELRRLLETNKKTLDDVRRLLKELLDVLETREVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRALEESDDLRELKKRIEDLLKEDKERLEKIARDIERDLERYRRDLKRLEDELREDIERARR

SEQ ID NO: 13011 - protein, 239 aa, Artificial Sequence; identical to SEQ ID NO: 13010
  Synthetic

SEQ ID NO: 13012 - protein, 244 aa, Artificial Sequence
  Synthetic
REEEVLRRLREIIKRLLDKNRKVNEDLVRLIKRVLDKNREVLKRLRDLIRELLEVVRNKRDDKDVEETVRRLERELEKLERTSEELVKKVKKELKDLLKDSRDVLEEVRKTLDTIVKETQEDEIVKKAKDIAKKLSDAHKKVLDDVRRILEKLVKLHRETLKKIRELLEELVRVVKAVRREKRPDEDLERALKKVKDELERIVRENEDADRKIKEEVDRLSEENEKVNREIKKELDDVVEETKK

SEQ ID NO: 13013 - protein, 244 aa, Artificial Sequence; identical to SEQ ID NO: 13012
  Synthetic

SEQ ID NO: 13014 - protein, 238 aa, Artificial Sequence
  Synthetic
EEDERLTKRVEEIKRENRELLRRLEEEVKELERKSEKIVRDLKEKVDRAKEKLDSNKESTELLVEELEKLIREILKLSEDHNRTLEEVVRKIEDVLRRNLERLKELVDEILKALKERKKRDVEELKRKVEKVARDYERLLRKLREVVKRILDESKRLDEELEERLKEVLKKLEELIKEGRPDKDVLTELKRILDELLKLVEKLIRRNLRLLEELLRLVREILRTSNEILEEILKDARR

SEQ ID NO: 13015 - protein, 238 aa, Artificial Sequence; identical to SEQ ID NO: 13014
  Synthetic

SEQ ID NO: 13016 - protein, 245 aa, Artificial Sequence
  Synthetic
SELDTLVELIKRILEEITRVNKELVDEVRKLLEEIVRINERSVRTIEKILRDIAELIRRGREDDRVKEDVKRRIEELKREHEEVEKKIREAIRRLEEESKRLEEDVRRMIKRLREEVERRRADEKVRRLLEELRRLLEELLELHKRLLELIREILERVLEVDKRSLDRLTEILERVLRMSDAGRPEEELEKELRRLKKELEEVVRKSREDLERLKKELEKIVKESEDELKKVEEKVKKLADDARR

SEQ ID NO: 13017 - protein, 245 aa, Artificial Sequence; identical to SEQ ID NO: 13016
  Synthetic

SEQ ID NO: 13018 - protein, 245 aa, Artificial Sequence
  Synthetic
TEEEVLRKVEKLIKDLLDVLRDLLRASEEVVREALRVLEELIEENKRVIEELSRALSDERRESVERMLRKNEERLKKILEDADRVLDKWRRLLEELSKKAKRVLDEVRKRLEEIKREVPETEKLRTLLTILEEILRRLEKIIRDILRINERLLEKLKRILERLRETNREIDERIRKLVEERRGAEERKLRRDLTETKKELEKRHEDLRRELEKLLRDYKRELEEIERRLEEIEKTLKRRADETRR

SEQ ID NO: 13019 - protein, 245 aa, Artificial Sequence; identical to SEQ ID NO: 13018
  Synthetic

SEQ ID NO: 13020 - protein, 238 aa, Artificial Sequence
  Synthetic
SDLERLEKEIRDLLDELRRLTEELEKRSRDILKRLKEILEELKRRIERLLDELRRRRGDTEVLKEVARVLETVLKLLEDVVRELEKLNKELLEANRRLLEEVERIVREVLRVLKEGRDKEELRRVLEKLREDIREVDERIKKINREYRKRVEEIREKLREAIRRAEELIRRIVEKIGSEDDSVRELIEVLKKALEDVRRVLRAIEEIVRRSVELNEKHSRELRRVLKELLELVAKAAE

SEQ ID NO: 13021 - protein, 238 aa, Artificial Sequence; identical to SEQ ID NO: 13020
  Synthetic

SEQ ID NO: 13022 - protein, 231 aa, Artificial Sequence
  Synthetic
SEEEELRKLAKKIEEVIKTSRDKLDKSRKELEKVIRDIERRLRELRRELEELVRRGLDEESLREILKRLIREVEEIARTLEELADDSLRKNKENIDEIKRLVEEILKKLEDNNVSEEVLEDVKRRIEELEKEAEEIHRRYKTELDKIKKKIRDILEELKKEVKRIDDEIKAGRDREDVLREIEKLLEEILRALRKLLKDLLDLHDEVLKADEKLLKRLREIVKKVLEEVRK

SEQ ID NO: 13023 - protein, 231 aa, Artificial Sequence; identical to SEQ ID NO: 13022
  Synthetic

SEQ ID NO: 13024 - protein, 231 aa, Artificial Sequence
  Synthetic
SEEEKLRELRKRLEDTVRRSKEELEKSTEELKDVIKKSEEKLEELKRRLEEMKRRGISEEAIKEIIRRLLESNRRNLEELRKLLEESLRKNRENLEKIMRLLDEVIRTLEENRVREEVLKEIRDRLREIKERAKEIHKEYKEELERIKERADRIHKEVKEKIEEVERRIEAGTDSEKLLTDAARILDDVVRVDRELLRLVLELHKRLVRADEKLLTDIRELARRVLEETRK

SEQ ID NO: 13025 - protein, 231 aa, Artificial Sequence; identical to SEQ ID NO: 13024
  Synthetic

SEQ ID NO: 13026 - protein, 236 aa, Artificial Sequence
  Synthetic
DEDERLRELRDRVRRSEEEDERRNKRHEERVKELEDEDKERNERHRKRLKEITDRLKERNTDDRVREILDELKRVAEEVNEVNERATKELSDLLKTLNDVNREASKLNVEAIERLLKLVKDGSPREEIEKRYRDIVKEIEERYEELLRRAKKILEDIKRKYDRLLERLEKIIDELRKNDIREDLLKVVRDSLEILKELIRTVLKAIEESLRILEELIERLKRHIETILRLAAETTT

SEQ ID NO: 13027 - protein, 236 aa, Artificial Sequence; identical to SEQ ID NO: 13026
  Synthetic

SEQ ID NO: 13028 - protein, 237 aa, Artificial Sequence
  Synthetic
DEEELEKEIKKLLEEATKKHEDVKREIKERLEKLRRDHEEAEKRVRDELRRLEEELERRNSDERTREAVELLKEIVKEILELVKRHVEKNAEIVERAIRLLEKHHKENKEIIREIIELLKRVTDRDRIREELKRLLDESEDSVRRILEEVEKLIRESEESVERIRRRLEELLKRLKDRAPDAEDLIRVLKKLIEDLERLLTKNRRLLEEIVKILTKLLKDNRDLLRRILRKVEETAK

SEQ ID NO: 13029 - protein, 237 aa, Artificial Sequence; identical to SEQ ID NO: 13028
  Synthetic

SEQ ID NO: 13030 - protein, 239 aa, Artificial Sequence
  Synthetic
DEARRIKEIVDRAVEIWRRLVEEIKRIVKEVLDKWRKLIRELIELVRKALEDLRRTNGAKEDVLRKIEEEAKKIIRDVEDLLKKIADKYKRIIEELEELLRRLTEKYKEIKKELDKGVDKKDVVKRLEELNREVLETVRKVLEDLARLDEDVLRTIAEILKRIAELIKRVLEAVIRDKGKTDELKRLEDDVRKKLKDLEDKLRKLRKELEETHRRLAETIRRIAEELERLHRELKRESK

SEQ ID NO: 13031 - protein, 239 aa, Artificial Sequence; identical to SEQ ID NO: 13030
  Synthetic

SEQ ID NO: 13032 - protein, 239 aa, Artificial Sequence
  Synthetic
SKDERLRKVLEDVERLLREVLKKHRKVIDDLRELLKRVVEIHRRVLEEILKRLEEEGIDETVLKRLDDAIKESEDSIRRVEELLEDVLRRSEEKAKRAEEDIRRVIEKLDRLARAGVPIEELVKELERLIDKLLRILREINRELKELLDRVIEILRRNNERLVRLAEDVLRRLRETGRVSDEVVERIRRTLEEIERRLRKTDKDLEKDLRELKKDLDRTDEELKRKVEKLKRELKETSK

SEQ ID NO: 13033 - protein, 239 aa, Artificial Sequence; identical to SEQ ID NO: 13032
  Synthetic

SEQ ID NO: 13034 - protein, 236 aa, Artificial Sequence
  Synthetic
DEKDRLEEEVRKLLKEAEDELRRLKRENEKLNRELKETLKRVKEESERLLRKLREDVRKDGTREESIKEVADRSIKLLKELLRILEEVIERSERSLEEVIKMLEDLIRRLEEILRRAGLREESLTKLKKKLEDVLKELRDMAKRYRDELRKIKRELEEAEKRYRKKVDELRRELEKGKPLEEVLEELDRLNKEVLKAIEEAAKKLEDLNRRVLEVLEDILRKLKEIVDEALKVLRK

SEQ ID NO: 13035 - protein, 236 aa, Artificial Sequence; identical to SEQ ID NO: 13034
  Synthetic

SEQ ID NO: 13036 - protein, 240 aa, Artificial Sequence
  Synthetic
KEEELLERLREVLKTDLDLLRDLVRTLKEDLDKDARLLEELVERLKKLLDKIKRLLEEEGAVSKDDLKRIEDRLREIKKELEKLLKEYKERLDKIKKELDKLLREYEEALRKLTKEARDLMREGNLREEVLKRISDRNERLIEEMAKKLRDVLRDNKRLVREIVEKLRTVLEDILRLVEEIDIDERVKREIRKDLDKIRREIEKIVKESEESNERSLEKIDRILEESKRRNERLKRELDR

SEQ ID NO: 13037 - protein, 240 aa, Artificial Sequence; identical to SEQ ID NO: 13036
  Synthetic

SEQ ID NO: 13038 - protein, 234 aa, Artificial Sequence
  Synthetic
SKKETIRKLIEENKDIIRKLAEKLKRLLEESERIAEEALRLIKELLERIERALRRVAKDIDEELLKELEKELRRLEEELKEILDRVRDLHRRLKEEIRKILEESKKLNEELEDRLRKDEDVEKLLELLERVHATDVRLLRELLKLLKKVHEDVVRLLERLLELLKRVLDRIVEELDLRDKELEKLLEDLEREIRRLKKRLKELSDRLEEKIRKIKRELDDLSRRLREKIERTRK

SEQ ID NO: 13039 - protein, 234 aa, Artificial Sequence; identical to SEQ ID NO: 13038
  Synthetic

SEQ ID NO: 13040 - protein, 240 aa, Artificial Sequence
  Synthetic
DDEKRLKDRLREALKRNEELLDRLRRRVEEILDRNRKLLERVRRELERVLKELEDLIRRGAPLEDILRRLREVIKELLELARRILEHNLRLNEELLERVERILKHNLDVVKELLDLVKERKGDTEELKKLLKRLKDLHDEVRKRLEEIERELRKLHRDVREELKKIDRRLEDRLRKVEEENSEDETVLRELVEELERVVRRILELLKRLSDASKRVVEEILELLRRLSEKTAKAVDDTRT

SEQ ID NO: 13041 - protein, 240 aa, Artificial Sequence; identical to SEQ ID NO: 13040
  Synthetic

SEQ ID NO: 13042 - protein, 235 aa, Artificial Sequence
  Synthetic
DDERRLETLIRLSRELIERVRKLLRDIIRTSKELIEEVLETVKRILDKIEELAKEVNLPREVLEEIKDELERILKELEDAVRDIERKYERLLTELEKMVREIEKKYKDLLEELEKGLDTKTILEEIKRLHDEVVEAIRRALKALEEIHREVHELIKRILDKLLEVLKKVVKVLEESGLRDEKISRKVEELEKEIRRLIEELKKKNEEVEKKIREIMKELDERSERLRRELDRTRD

SEQ ID NO: 13043 - protein, 235 aa, Artificial Sequence; identical to SEQ ID NO: 13042
  Synthetic

SEQ ID NO: 13044 - protein, 242 aa, Artificial Sequence
  Synthetic
SKEDELRKELEEVVKRIEDALRKLKERSKRVAKRVKKLLDDLKKESEEVVESLREKLEKERVPERIVRTLEELIKTNRDTIDELEKVAKKLIKLHEDTLREIERLLRELIRLLREALEANVEDERFLRELEKRLKEVLDELERLLRESEDRLERVIKEIEDKLRESRRKLEEDIERVEREGTTESVRKLLEELRRLHERIIKIIEEILELLRRVHKEVAKDVRRLARELEELVRRLVETLRR

SEQ ID NO: 13045 - protein, 242 aa, Artificial Sequence; identical to SEQ ID NO: 13044
  Synthetic

SEQ ID NO: 13046 - protein, 240 aa, Artificial Sequence
  Synthetic
SAEEILDTVAELIKTHLKIVREVLKTVRDLNRRSLDLIRRILERMRRLVERLVRLIRNNGRERELRELLKEIEEDARRLMEELRRLHKEVEDTIRKLIEELRRLNERIKREIERLIKDLRDERVIEVLRRLLDKLRRHAEEVEKALRDNLRLNRELIKRLEEIIKETLKRLEELVREVERDGPVEKRLREVEEEVERRLDTVRRELEEVEKESDRLLEELEKKSEDFERDIRRLLKEAKT

SEQ ID NO: 13047 - protein, 240 aa, Artificial Sequence; identical to SEQ ID NO: 13046
  Synthetic

SEQ ID NO: 13048 - protein, 237 aa, Artificial Sequence
  Synthetic
SKREEIEKLLEDLKRDNKRVLDRLREVIKDNEDKNEKAVRDARELLERLKRELEEGNLDERLRDVVRRLLTELEEILKELEETLKRNNDEVRKLVDELRKTSRENLEKLRELVEKVREGTSDKTIRDAKRESEKKLEDIKKRIKEVEDKSRKTVEDIRRRIKEVDDKLRRTLEEVRRRDGDTEALKRLEEVAKELLKLIEEVLKENERSNREILRLIAELVKRNARVNEELLEIARR

SEQ ID NO: 13049 - protein, 237 aa, Artificial Sequence; identical to SEQ ID NO: 13048
  Synthetic

SEQ ID NO: 13050 - protein, 237 aa, Artificial Sequence
  Synthetic
EKDDRIREKVKEIERRNDKALDDIRRRVEEIKRENDEVLDRIRKELEDLKKEVEEVAKRTGRVDVLEDAKRALEELLRLIEEILRRSKEVLKRLLELIERALRESKRVLRELIKVIERRRDDKDLEDILRRHEEIVRKIVRELEKILKEHRDIVKKVVEELRKILEDLERRIREKGVDEELKKLLDKLLEDLRRIVKKLEELLKKNDDELRKIVKEVKDLLKRNHDELERIVREARR

SEQ ID NO: 13051 - protein, 237 aa, Artificial Sequence; identical to SEQ ID NO: 13050
  Synthetic

SEQ ID NO: 13052 - protein, 237 aa, Artificial Sequence
  Synthetic
SKEEKIERDVDEIRKENEEVLRRIRKKVRDIERENDEILRKIEEDLRRIEKDLERVAKERGRRDVLERLRELARELLELIRKVLEDSKKMLRDVIKLIEEILRLSIRVLDELLEVIRRKEDEDRLRKILEDHEREIRRVARELDRLLREHREIVKEAARRMEELLERIKKDIDERGVDEDLRELLRKVLESLRRIVERVDRTLKDNDRKIEEIVRELKELLKKNNDALRKIVEDAKR

SEQ ID NO: 13053 - protein, 237 aa, Artificial Sequence; identical to SEQ ID NO: 13052
  Synthetic

SEQ ID NO: 13054 - protein, 237 aa, Artificial Sequence
  Synthetic
SREEVFELLLDVLRKIVELIKDLAKKNIDVLKKLMELIDELVKINEKSLEDLLRLIREGRDERDIDRLIRENKKKNEEIVERLRRLLKELEERNRKILKEIEELIRELEKELRKKVRGEEVERLLEEIRRVLKELLEKLERESREVLRKAEEILRALERLSERVLKILRDLLDLRRRNERDEKELEDEARRLKKEYRDEVERLKKEIREIIERYKDALRKLEREIEDITRRLKERAD

SEQ ID NO: 13055 - protein, 237 aa, Artificial Sequence; identical to SEQ ID NO: 13054
  Synthetic

SEQ ID NO: 13056 - protein, 238 aa, Artificial Sequence
  Synthetic
SKLEDLLRRAEELLKDIVRANERLLEEIRKLLKEIVKANEDLLRKVKRLLEEAVEMAIRERGDKGEELDKIKEDLKRVIEKSRRDARRIEEKLKEVIRESRERLKALREELKRVEEMVRRGELDEDTVLRELEKIIRKLLRVHEDSLEKLIRLIEELNEVDKESLRTLVKLIERLERDIKLREEIVTRVRKKVEELKEEVKRINDEVRKKVRDLEETSKRILERVEDLVRELKERARR

SEQ ID NO: 13057 - protein, 238 aa, Artificial Sequence; identical to SEQ ID NO: 13056
  Synthetic

SEQ ID NO: 13058 - protein, 238 aa, Artificial Sequence
  Synthetic
SKEDKARELEKRLRDNLKKLEEVVRELAEVLKRNLEKLRRLAEELLRALKRLLDKLRAGGLPKDELEDLRREVEDVLRRLKDLLRKLKKANDESLTRLEELLRRAEEENRRVLTTLRELLRNNGDDRDLARLVARLVEANNRALEELLRLVAKNVEDNNRVLEELLRLVKELAKRLLARIRDEDLVRDIRRELKELEERARKILRDDERDLRALEKRIRDIIREDREELERLKERARK

SEQ ID NO: 13059 - protein, 238 aa, Artificial Sequence; identical to SEQ ID NO: 13058
  Synthetic

SEQ ID NO: 13060 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDAEKVSEEDLVEMLKRLIDELRKVLEDVIRVSKELVERLLRALREHLETNKRLVKELLDALRKTTGDDEEIKRLKEELERRHRRLEEEVERVARELEKRHRDLERDIRRVAEELKKLLKKLRDDRR

SEQ ID NO: 13061 - protein, 243 aa, Artificial Sequence; identical to SEQ ID NO: 13060
  Synthetic

SEQ ID NO: 13062 - protein, 228 aa, Artificial Sequence
  Synthetic
REKEELSEEIRRRLDELRKLLEEYEEEVKRLLTRLRDKLRRYKEEVERLLRKLKEDNKVDEEVLKLLEDLLKTNLDILEEILRLLEEIIRRNLDILRRLLKLLEELIKEVEKRGGGTEEVKRRAEDVKRKIEELDRRSDEEIKRLEKRIRELNTDSKRRAEEVLRRIEKKGVPKEAVDLVRDVLRRVEKVNRELLELIKEVADRVRERNKELVELIDRLLERLKRADK

SEQ ID NO: 13063 - protein, 228 aa, Artificial Sequence; identical to SEQ ID NO: 13062
  Synthetic

SEQ ID NO: 13064 - protein, 236 aa, Artificial Sequence
  Synthetic
SEEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIRLPEEVVEELKEENKRLRDRLDKLVKDLKKTNKEIEDKLRKLAEELKEELERIADRIRKTGTDRKTLLREIEKLLKTLEDILRDLLRLVEKTLKELEEILKDLVDKARENLKRLRERIR

SEQ ID NO: 13065 - protein, 236 aa, Artificial Sequence; identical to SEQ ID NO: 13064
  Synthetic

SEQ ID NO: 13066 - protein, 234 aa, Artificial Sequence
  Synthetic
SKEEEIVKEVEKIVEKLLEVNRRALERIEEIVRKNLKVNRELVEEIERIVEELIRTGDVDERVKRELRRRLEKVKEDSERVLKKLEEDLRRVKRRSEDTLRRLREELKRLKEELRDGDRSGDELEEALKKILKKSEEHVRELEEIVRRLLEKSREHLEELVRIAKRLLDEARKRKNVPEEMLRRVLKKIEEVIRRAREEHEKSTRELEEVIKELKKRHEDVTREAKKVIDDLKR

SEQ ID NO: 13067 - protein, 234 aa, Artificial Sequence; identical to SEQ ID NO: 13066
  Synthetic

SEQ ID NO: 13068 - protein, 239 aa, Artificial Sequence
  Synthetic
SEKEELKRLLDKLLKELKRLSDELKKTIDKILKILKEVSEEVKRTADELLDAIRRGGVDEEVLREIKREIEEIEKKLRKVNKEIEDEIREIKKKLDEVDDKITKEVEKIKKKLDDDRVDRKEVIKALKEILKEHADVFEDVLRRLKEIIKRHRDVVKEVLEELRKILEKVAEVLKRQGRREDELRKVEEDLKRLEDKLKKLLEDYEKKVRELEETLDDLLRKYEETLRRLEKELEEEER

SEQ ID NO: 13069 - protein, 239 aa, Artificial Sequence; identical to SEQ ID NO: 13068
  Synthetic

SEQ ID NO: 13070 - protein, 234 aa, Artificial Sequence
  Synthetic
SRVERLEKLLEEHKRLVEDLIRLLDELAKKHDEDVRRLIERLKELAERLKRLLERSGVEEELLKRVDEAIKRIEDKLRRLEEHIKRVIDDIRRRLEELREHSDRLIEEIRDRLRKRDDEEVLRTIIELLRRNMERVLRLIEEILKLLEENLEVVKRLLEDVLRILKRIAEEIESRLTDKRDVDRIREEIKKLIEDVRREIKRVEDKHKKDIDRVKEKLDRVRDRHEKMAEDSKR

SEQ ID NO: 13071 - protein, 234 aa, Artificial Sequence; identical to SEQ ID NO: 13070
  Synthetic

SEQ ID NO: 13072 - protein, 241 aa, Artificial Sequence
  Synthetic
REKEELLRLLKEIAERILDILRKALELLDRVVELDNRTSKELLELSAELVKRILEAVRDGKPEEEIRKTLERVKKESRKIVEKNKRLNEEVLKELEKLVDELRKLLEDIKRKLDELNVPDEVRKVLEDLARLLKEVIDLLRRLLEENSRVSEEIVKLNEEALKTLEELVKRLVDLERKGTSEEEKKRLLDDLRRILREYEERVKKLNDEHKKLEKEIKDKVKRILDEIRRTLDKILKELRK

SEQ ID NO: 13073 - protein, 241 aa, Artificial Sequence; identical to SEQ ID NO: 13072
  Synthetic

SEQ ID NO: 13074 - protein, 244 aa, Artificial Sequence
  Synthetic
KDEERLVKKIRDSLRKYEDLLRKLVERIRDLLRRYEEELRKLLTEIEKTLEDVRDVLRRKNVDERAKEVAKRLVEAVKRLIEIVKRILEKTKRVVKKLEDLLRRAAELNRDVVEKILEIIKRKGPEDDFRRIVRRLEELHREVEDAVRKLVEDLKRLHREVVEELADIIRKLDKLLKEVERDIDLGDLLEMLRRLVERLKRLIERVLKLNRELVKKLLELLEEALRRNRRLVEDILKIADEARK

SEQ ID NO: 13075 - protein, 244 aa, Artificial Sequence; identical to SEQ ID NO: 13074
  Synthetic

SEQ ID NO: 13076 - protein, 236 aa, Artificial Sequence
  Synthetic
SDEDRKRKKLEDVERRLEKLLREYEEKVRRVLEELRRLLEENKRHVEELEKRLRDRAKKPNDDEVLERAVREVRKHLKDNVETDRKLLEDLKRALEESVRLVEEVLKILKELIDELKSKVPGEEAEKLEDDLRRVVETVRRLLEESKRKLEKVIREVEELNRELKELVDRVADEIRRKRLLEEALERLRRLLEELLRINERIIELIRELLEDNRRILEEILKLIKDLLRRAERIVD

SEQ ID NO: 13077 - protein, 236 aa, Artificial Sequence; identical to SEQ ID NO: 13076
  Synthetic

SEQ ID NO: 13078 - protein, 242 aa, Artificial Sequence
  Synthetic
SEEEDLEREKRRLDKYSEDDRRRAEKVLRELEEEVKKSRKRLEDAKRRLDEEVRRNEKLEEEVLRLLKELVKKVTEIHERSLDLLRRAAEKVIRINERSHRELKRIVEEVIRIKRRNGSEEELDKLIRDLRKSLDDVRKTSEKLVKDILEELKRILDESKTLADKLRRDLEKIVEDIDRRNLPEEVLRILKTLVKELEDILRELLKINEDLVRRLERILRELLKSNDNLVKELEKLLEKARR

SEQ ID NO: 13079 - protein, 242 aa, Artificial Sequence; identical to SEQ ID NO: 13078
  Synthetic

SEQ ID NO: 13080 - protein, 246 aa, Artificial Sequence
  Synthetic
EKKERIREALERAVRTLEKLLEDDKRELDKARREVRELLRRDKEELDKVVERVERELDRARERLDEDIERMVREVLELLKKHLDEVRRAVDTVLRLLKTHLDIIREIIKRLIDKIRDLLRLVARDGTREKDLKKVEDEVRELVEKLRRDSEKVEEDLRRTAKRVRDLNEEVRRRLDKKRKDVERKPTPRKLEEILRLLEEALRRNSETLEEILRKLEEILKRNRKTLEDLLKLVKEILDEIRERLR

SEQ ID NO: 13081 - protein, 246 aa, Artificial Sequence; identical to SEQ ID NO: 13080
  Synthetic

SEQ ID NO: 13082 - protein, 247 aa, Artificial Sequence
  Synthetic
SLTERVLDLARDLIRILLEIHKRALKLIAELVKKLLKIHEDVLKLSEELVEELLEIVARRLPREDLLRALKELLEKIEDVVRDIERRHRDLLREAEEVVEKLKREHEEVKERIERAVKKLAEDGVDKDKLKELVDVLEEILRLSKTTLEELVKALRDVIRKSLEALKENLRILRKIIRELEELERVDEDTLRRVLERIREEVERVKEKHRRLLEELKKLLEELRKRSKDLLEDIKRKVRELEEKTRR

SEQ ID NO: 13083 - protein, 247 aa, Artificial Sequence; identical to SEQ ID NO: 13082
  Synthetic

SEQ ID NO: 13084 - protein, 237 aa, Artificial Sequence
  Synthetic
REDEELTKRVEKILRDAERLVRKLHRENREILKTLKRLVEELEKENRKVLKDAEDLVRKERESKEKLLKLAEDLVKRNEEALRELVRLAEELVKRNVRVLEELLKLLTDLLRELKDALRRAGRRREDLDRRIDEARKRIRRELEELRKRHEELLRELKKRVKELADEHRELLDRLRKRDEDARELLKELKRIVKKSLDELRKLLKKLEDIVRESNERLKEVLKKITDLIRKVLEDIR

SEQ ID NO: 13085 - protein, 237 aa, Artificial Sequence; identical to SEQ ID NO: 13084
  Synthetic

SEQ ID NO: 13086 - protein, 235 aa, Artificial Sequence
  Synthetic
SEEDKIAEELKETLKRYRDRLEEIRKELEDKLREYEKRLEDLARELEKKLRKLEARDVNVRELLKVLRDVVRAIEKLLRENLKVVEDVLRAVRRILEENLKVVEEILRRVLKILREVKDEERARREIEKIVRKLEEVDKKIEEDVRELKRRLEEANKKLREDLKELKRELERVLRDRNVDEDVRRVVRELLRKLEDILRESEETNKETLEKIDEILKESERTNREVIRKLKETTD

SEQ ID NO: 13087 - protein, 235 aa, Artificial Sequence; identical to SEQ ID NO: 13086
  Synthetic

SEQ ID NO: 13088 - protein, 244 aa, Artificial Sequence
  Synthetic
SAEETLRRITEESKRVLEEITKKYEDLERESREVLRKLREDLDRIKRELEDVLTKGKDDKDEVLTVLEKVLDELLKLHRENLRVIKELLRKVLEVDRENLEVLKRLLEKARDLLRRSGRDEKDLKKLEDELRKVKEELEKKHEKSKRDIEDLERELDKVTEEVERLLRKLKEELRRAAENSDEDRERLARLLKKLADKLIRVLEEILKINEELNRKIIKFARENLERNRRVNKKVIEVLREAAR

SEQ ID NO: 13089 - protein, 244 aa, Artificial Sequence; identical to SEQ ID NO: 13088
  Synthetic

SEQ ID NO: 13090 - protein, 238 aa, Artificial Sequence
  Synthetic
SEDEKLKKEVDDVLERAKRLLDRLREANEDVLRKAKEDLDRLLKSNREILEELRKIKGLDEIEKIVRELLRENHEVLKRLVKLVKELLDLNLKALKDLMKLVEELIERLKRALRKKVPEEKLRKLDEEVRRIEEKLKKALEESKRIVDEIRRRLKEIEDKSRKIARDIEKELKDTKRAGPLEERVLERLLKALKEHSDELKKVVEELLKLLEEHLREVEKLVRELLADLKRLLDKTRK

SEQ ID NO: 13091 - protein, 238 aa, Artificial Sequence; identical to SEQ ID NO: 13090
  Synthetic

SEQ ID NO: 13092 - protein, 246 aa, Artificial Sequence
  Synthetic
SKIEELLTKLAELLKEVIDELRKNLKRLEETVDENLKTMEDLLRKLEEVVREVLDIATKKNPSEEAKRKIDALRKKVEDLVKRIKDILEKDKRDLEKVVRDSEELLRELERKVREVLEEVKKIVRDVKDKDELVKRILDLLKELLDDVKRVIKEHLRLVREVLERNKRSLDELVKIIRELLKAIKEVGLVDDEVRKRLDERAERLEKEVEEVKKENDERAKRSAEEVKKLLDKLDEALRRLEEEVR

SEQ ID NO: 13093 - protein, 246 aa, Artificial Sequence; identical to SEQ ID NO: 13092
  Synthetic

SEQ ID NO: 13094 - protein, 240 aa, Artificial Sequence
  Synthetic
SEDDELIKKIKKLAEEIIDEIRKLIEKSKEILKRLLDELRKLIEKSKKLLKETLDKLRKDKREAREDLERVETVIKRAAEEHDRLLKEIDDALKRLEEEHEKLLTDVREVLKEVKKELDELKDKNADRTELLDVLRKALEEAKKVLERLLKLNREAIETLERVLRKLLKLHRDVLARIEEDGLDEEALKELEKKTRDLEDEIRKVKDDVKRRHDELKEEIERVLDELRKVLKRLEDEARK

SEQ ID NO: 13095 - protein, 240 aa, Artificial Sequence; identical to SEQ ID NO: 13094
  Synthetic

SEQ ID NO: 13096 - protein, 250 aa, Artificial Sequence
  Synthetic
KTEEILKRVKEILDELAKELRDIIRESLRTIEELLDELRRILEESERTLEELVKTIKDEVKDKEELLRRLKRLLEDLRRKHEELLKRLKEAVDEHRDRLRKILEELERVLKELRKRIEELRRSLDRIREKDVLRKLEEVLRKALEILERLLKKIRESARELLKIIEEVLDRNIKVMEEALKTIKELLKDGPDEVKRRLEEKERRIRTRYEELRRRLRKRVKDYEDKLREIEKKVRRDAERIEEELERAKK

SEQ ID NO: 13097 - protein, 250 aa, Artificial Sequence; identical to SEQ ID NO: 13096
  Synthetic

SEQ ID NO: 13098 - protein, 239 aa, Artificial Sequence
  Synthetic
EELEDVLRRIEEVLREIIRLLEEHHDMVRRAVERIKRLLEDHHKKVEDILREIKRRIDKEDVKRTLDDILRRNNETLKRLKEELDRLLKENEDRLRKVTKDLKRLLDKAKELVDRIDSEEVLRRLAEIVERILRTVRKVLRDSIRILERLLRVAREALERSIKSLREILDTVEKALKDGPEKVKKELKDLARKAEKLSEDVRRELEETVKDLRRKSKEVEDRLDKLTEEIRRTLEEKRR

SEQ ID NO: 13099 - protein, 239 aa, Artificial Sequence; identical to SEQ ID NO: 13098
  Synthetic

SEQ ID NO: 13100 - protein, 231 aa, Artificial Sequence
  Synthetic
KDEERLTKTAKESLDHNKELLDRIRKKSKEVLDHNKELLDRIREEIKRLLEELDRLKRENRPKERIVEILRKILRTLEELLKRLIESLEENLRVLAKLLEDLIRSLRRNVELIAKDLEEDDELKKLEKEYREIERELRERLKTLEKEYRDLIKKLRESLEKLKRELEKLERDGVEVEEVIKEVKKMLERALEELREVNDRDRRANERALRILEALNEEDKRATKRVLERKK

SEQ ID NO: 13101 - protein, 231 aa, Artificial Sequence; identical to SEQ ID NO: 13100
  Synthetic

SEQ ID NO: 13102 - protein, 247 aa, Artificial Sequence
  Synthetic
REKEELLKLIKRVIELLKRVLEEHLRLVEDVIRRLKELLDSNEKIVREVIEDLKRLLDEVRDDKRRLDRIKEKLEEVLERYKRRLEEIKRDLERMLEDYKRELKRIEEDLRRVLEEVERIATRNEKPMEFLIDKLRKILERALRELDKLSKKLDELLKKVLEELEKSNREIDKLLKDVLRRVEEAGAEEDLLRKAKKVITEVREKLKRNLEDVRRVIEDVKRKSRRILEEARRLIEEVERELEKIRK

SEQ ID NO: 13103 - protein, 247 aa, Artificial Sequence; identical to SEQ ID NO: 13102
  Synthetic

SEQ ID NO: 13104 - protein, 243 aa, Artificial Sequence
  Synthetic
SKVERILRLIEELLRLLREALRKIHRINEELIRTLEEVLREIHRINEDLNRKLREATGRNDDLDRADTESEKLNRDLRRRNEEVLKRLRESNKRLKEENDRVDKKIKKLLEDLERIVKDRPEALEELVKILEEIIRDIERLLRKNREVHEENIRLIEELLKENIEAHERDLKLIEDLIRRENLPEELKDRVREELDRSRKKLRKLEEEMRRKLKRSREELKKLEEDLRRELKKLREELERIRR

SEQ ID NO: 13105 - protein, 243 aa, Artificial Sequence; identical to SEQ ID NO: 13104
  Synthetic

SEQ ID NO: 13106 - protein, 236 aa, Artificial Sequence
  Synthetic
SRKERIKRALEEHIRKLKEITDEVRKTNEELLELTRRILEEAKKANEELVKKIREALDKVKELEEEIRKLIEESERIVEELEERSKELLKRSREEVEEWRRRSEELLRRLEKILRDVKDEKELVERAVKILRDDSRIAKEILRRNLRLIEENLERLKEIIERNLDLLRRLLELLKRAGVDEEALKELEEKLDRYRRKLEDLLRKYAKKLEDYKRKVKKLEEENEELLKRIEKEMEK

SEQ ID NO: 13107 - protein, 236 aa, Artificial Sequence; identical to SEQ ID NO: 13106
  Synthetic

SEQ ID NO: 13108 - protein, 226 aa, Artificial Sequence
  Synthetic
SEKEELEKRLRKKLEEIKELVERYKRRLEELLRRHREELKEIEKRLEDLERKIEELDVPERVKKLLRDLIRVLREWLRRSHDLLRRLLEVSKKALEDILRLLEKLLKEIKDLEDEDRLEERIDKVLKDLKRIDDRVREMVKEVLERDDRLARDVKKKVEEVLRELEEAGVSEEVKKIIEELLRLAEEVLRRNKRLIEALLELHEDEFRKVEEIIKELSEEAKRASK

SEQ ID NO: 13109 - protein, 226 aa, Artificial Sequence; identical to SEQ ID NO: 13108
  Synthetic

SEQ ID NO: 13110 - protein, 238 aa, Artificial Sequence
  Synthetic
REKEKIREALETNLRLLEELIKRLKEILDTHNELLRRVIETLERLLKELLELLEEAGLEEEVLREVKRLVDELRKEARRVLDEHEKLVRKIKKEAEDVKRESEEIIKEVEDKLEKLDREELLERVRRVLKKSDDLIAELVRRALKILEELTRLLAELLKKVVEILRRIVELVERVLTKKGAPKEDLERLRRKVEELEDRLRRLLEKLKRDSDELMRELERILDRYRRESEELDRRLAE

SEQ ID NO: 13111 - protein, 238 aa, Artificial Sequence; identical to SEQ ID NO: 13110
  Synthetic

SEQ ID NO: 13112 - protein, 232 aa, Artificial Sequence
  Synthetic
SELERLRKILDDLRKKVERVAEEHKRANDKLAEEIRRVLKTHREMNERAIEEVKRTVGDDERIREVLKKVLKESEELLREVEELLRRILERSKDLLRELKEILDRVLREVEELLKRNTDSREALKLLEKLLRMLLEVSKRDNRLLEELLKLLRDISKRDHEVLKKLLDEIRRTNTDLREVDKRLRELLEEHKKLVDDLDKRARKVHKEHKDKVDKLREELEKTLRDIKRETD

SEQ ID NO: 13113 - protein, 232 aa, Artificial Sequence; identical to SEQ ID NO: 13112
  Synthetic

SEQ ID NO: 13114 - protein, 246 aa, Artificial Sequence
  Synthetic
DSDEIVKTLLEKLRRILKEVEEIARENHKRDRDANREINKLVEDIARRLEEVAERLREVIDERVLKKLKELLDRLREDLKRVDTENEELARRDEKRLEDVIKKIEELLRDLEKKLEEVKRRGEPREDLLRKALEVLKRIVELIDKLIKDHEKSLRDSVELNLRLLRRILEVVERVVELLERVLQGLDEKDLRRLRKDIERLKEEVKRALDELRKKYKKIEDDNRRLVERIRRELKKILDELDEKRQ

SEQ ID NO: 13115 - protein, 246 aa, Artificial Sequence; identical to SEQ ID NO: 13114
  Synthetic

SEQ ID NO: 13116 - protein, 241 aa, Artificial Sequence
  Synthetic
SEIEKVLEINRRVLKELERIVKKVLDIDKEAAELLRDIIRRVLEIIKKVIDDIIRTRGEQEDVRRVEDELRRTIKKLKELLDEYEEETRKLEEDLRRELEEVKKRSEEVEERAKSGRDKRDIDDLIRELHRLDRELVKRLRDRIDEVVRRNEELVKRLEDEIRRLERDLERLLREVLRRTKDKDLEEKLRRVLEELKRLVDDLRRLIDEIKKRYERMVEELKKEIERVLRENEEAVKDLER

SEQ ID NO: 13117 - protein, 241 aa, Artificial Sequence; identical to SEQ ID NO: 13116
  Synthetic

SEQ ID NO: 13118 - protein, 243 aa, Artificial Sequence
  Synthetic
SEEEELEKIAREVLRELKEILEELDDIYRRVTDRLRKLLERLKKEYEEVKKELEDLKRRKADVKDLLRVLRRLVKVDMEVLDKLLEIVRELSEADKDILRRILEVVEKAVKALKDVLDRAGEPERDVKKKKDDIDKKLEELRRELEDYKRRNDERLKRLEEKIEKYKRDSRKILEDIEREVKRDGPSEELVDRLIKLLDENLKRSEEVIREIIELARKNAEDSRRVIKKIIELLREMLKDARR

SEQ ID NO: 13119 - protein, 243 aa, Artificial Sequence; identical to SEQ ID NO: 13118
  Synthetic

SEQ ID NO: 13120 - protein, 249 aa, Artificial Sequence
  Synthetic
DSERELEKVLKDAKEKLDRSLEEVKKVTRETEKRIEEIDKEVKEVLEEADRRVKKIETDKERGDEERLARELTRVVRDIVRRLKDLARKLLEVVRRNAEMNHRINRKNNKVLRDIVRRLEEVMRRRGLDEKRVRELIERLRRLLKELEKEDRRINEEYKRVLREIERKVREVSKTLDKLLRELEERLKKEGLDERLIREIKRIIERVIEILKDIAKEILDLDRESVRLDTEVLKKLLDIIREVVKEAKK

SEQ ID NO: 13121 - protein, 249 aa, Artificial Sequence; identical to SEQ ID NO: 13120
  Synthetic

SEQ ID NO: 13122 - protein, 249 aa, Artificial Sequence
  Synthetic
DEEREVRKVLRRAEELLRRSLKKAEEVTRETRKRIKELLDELRKVLERAERELRRIRREKERGDEKKLADELEKVVREIVKRLEEILRKLLEVIRTNMRRNHEINRENLEIVREIVEELKRILEERGLPREDLERLVRKLEDLLRRNEKKDKDINRRYKELVDRLEELVKDITRRLRELLERLKKRIDETGLDDRLIEEIKRILEEIIKLIADLARRVLKIDEESVKLDEDNLREVLKILEDVVRDSER

SEQ ID NO: 13123 - protein, 249 aa, Artificial Sequence; identical to SEQ ID NO: 13122
  Synthetic

SEQ ID NO: 13124 - protein, 235 aa, Artificial Sequence
  Synthetic
SEEEEIKKDLERLIDKLRRTSKRLIDDYRRVLEELERTIKRLLEELEELIDELRRRGSLEEKILKVVEDLLRVLKKLLRELLELIERNLELIKRLNEELLRVVEKILKVLAERSTADEDLTRVLKELKEVLDDLVKKHRDSLEELKRVVKRLKDELEKVLRDAKRVLDELKRDGVSEKVERALERILELLKRVIEELERLAEEVLRLSKRVAEENKKLLEEILRILEEIIRRAKK

SEQ ID NO: 13125 - protein, 235 aa, Artificial Sequence; identical to SEQ ID NO: 13124
  Synthetic

SEQ ID NO: 13126 - protein, 248 aa, Artificial Sequence
  Synthetic
SKEEELEKLVRKVEEDLKRLEEESERIKKEIKDTLRKIRKRSEDLKRKVKELLRRLEEEARRVRLEEAIKIIKEILDELAKVNEDIIRIIKELLKRLVDTNRRVIETIDRILKKLVDDLRRANLPEDKLREVERELRELKKELEEIVRESEKMLKELEDKLREIVRESRELLEKLRRDLKRIKDGNLRVDEALEMLKRLLDKALKVHEDVLRKLVELVDEVLKVHEESLRKLLTLAKKVLEVLRKITK

SEQ ID NO: 13127 - protein, 248 aa, Artificial Sequence; identical to SEQ ID NO: 13126
  Synthetic

SEQ ID NO: 13128 - protein, 244 aa, Artificial Sequence
  Synthetic
DDERRKLEDLERMVEELKRKSDKLLKEIREEVERLERETRKLLEELKRKVDELREDLRRNPEDRVLRKLVKLLEDILDKVRKLLKENLDLLKRLLDIIEKLLRDNVRLLEELLRIVRELMKTKDEEKLTRKLEKALKEVRDAARETRERLKEAKKEVKTVADRNRKRLEELEEEVKRVLDEIRKEKGPSEDLEKAERLVKDILRLNEEHTKELEDVVRDLLRKLEKHTRDLEKLVKDALDKVKT

SEQ ID NO: 13129 - protein, 244 aa, Artificial Sequence; identical to SEQ ID NO: 13128
  Synthetic

SEQ ID NO: 13130 - protein, 246 aa, Artificial Sequence
  Synthetic
SEKEELLKRLEDVLRRIKERLDELRRRYKKALDELREESKRLIEKLDKVLREIEELIKRKDRDLKDIVEAIKRLNDEHLETLKEIVKKIMRIDEEVLKKLEDIAREIKEELDRILKTLADEGLPEKKLEDIARLVTEIKEELDRILEKIRKDSTDSNKELKDIIDEVRKLHERLKRELERLAREEKSEEILRLLLELLEESIRVAREVNRLLLRLLEKNKELVEEVLKRLLDLLKKIIDIVREVIT

SEQ ID NO: 13131 - protein, 246 aa, Artificial Sequence; identical to SEQ ID NO: 13130
  Synthetic

SEQ ID NO: 13132 - protein, 244 aa, Artificial Sequence
  Synthetic
SKIDEALKKLRKILEDAIKLNKELNDTTREILKEIIKLNREVLEKIRRILKELVDLILKDLKDDEEAKKELKKVLEEVRRRLEEIKKETDRIVKEVEELNERNDREVKRAAEEVRRLLEEIKRSDRDEKELIKKLKEIVDRIREAHRRSVEELSEVVKRILDALKDTLRKLEDVVRKLLELARRIAGDTEELRRVVEKVRKELEDDKERYKRLEEEVRRLLEEMKRRSEDLERKVEEILRRLTE

SEQ ID NO: 13133 - protein, 244 aa, Artificial Sequence; identical to SEQ ID NO: 13132
  Synthetic

SEQ ID NO: 13134 - protein, 237 aa, Artificial Sequence
  Synthetic
SEKELLEDLRRKAKEVKDRHEELLRDLERTLKKLKDEHDKKLKDLRDELRRVEKKLDDKERTEALERVKEVLRKLLKLVEDLVRRNKEVIDKLLELVRELIERNKKVLEELLKLVEDLSRKRSEDVERVIRELREILRKLHETNKRILDELRRLLEELERENRKILEEAKRLLEELEKKVDDKELLKEVKDLLRKLEKVVRDSLELLKRLLEDIEKRVRDSNRELKRILDDIEKKAK

SEQ ID NO: 13135 - protein, 237 aa, Artificial Sequence; identical to SEQ ID NO: 13134
  Synthetic

SEQ ID NO: 13136 - protein, 235 aa, Artificial Sequence
  Synthetic
DKEEELLKKLEEVLKKAEDLIRESNKALKELLDEAVKIVEDSLRELERTLRDIERKVDKDEVIRRLRELVRELTERNKEALTRLREEFKRLHDENKKILDDLRKLVDELRERVKKTKDSETIIRLISKVLDDLLRLLDELVKRNTEALKKLIKLLEDLVRENKRVLERLVELVKRATGETEDLRETEKDLRRLSEEHKRLLEELRDKARRLTERHEKALKEIEDELRKIKDEARR

SEQ ID NO: 13137 - protein, 235 aa, Artificial Sequence; identical to SEQ ID NO: 13136
  Synthetic

SEQ ID NO: 13138 - protein, 239 aa, Artificial Sequence
  Synthetic
DEEEKIREDLERTLREYERELRRAKEELKETLKRYEEELREVKEDLDRTLEEVDDLLRRGELEDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKKTLLRDLKEALKTLIKLIREILEDNLRVLRRIIELIETLLEDNRRVLEEIIKLIEEATT

SEQ ID NO: 13139 - protein, 239 aa, Artificial Sequence; identical to SEQ ID NO: 13138
  Synthetic

SEQ ID NO: 13140 - protein, 238 aa, Artificial Sequence
  Synthetic
STKEEVERIVEELRRAHEKSLRDVKKILDDLAKIHDDSLEDARRIIEKLDRILEEIKDRDKSREVVETLTRLLEEIEREIRELVRKNRELLRRITERLKELVRRNEDVDRRVREKVERVPISEELLKLIEELSRTNRRVLEALERLARELLKTNERVLEELKKLLDRLLELVKRITDDGVEDDKLLEDVKEEIRKVKERIEDLLRRSRELLERLRKRLDDLLADSERKIDEVTKRTRK

SEQ ID NO: 13141 - protein, 238 aa, Artificial Sequence; identical to SEQ ID NO: 13140
  Synthetic

SEQ ID NO: 13142 - protein, 244 aa, Artificial Sequence
  Synthetic
DELEKVERLLEEIEKIIEDLIRRVEELVRRILEFNKTTLKRNEELVRELEKLVEETTGRTEELKKIVEKLEKLHREVKKKSDDLVKRAEELLKEVKERLKEIVKTIREELRKVKESDRDRKELLKLLAEILDKLLKLLKRIIEELLRILKELIKASKESLDDLKRINEELLRDIEDLIRKKIKEKKEVVRKLEEDLRRVRERSKKLVREHEKFLEDLEETIKEEKRRVDEELKRIKEEIKETRR

SEQ ID NO: 13143 - protein, 244 aa, Artificial Sequence; identical to SEQ ID NO: 13142
  Synthetic

SEQ ID NO: 13144 - protein, 242 aa, Artificial Sequence
  Synthetic
SEKERLMRLLDKLKDLNRRLVERIKELLDKALELHKKLVKELRELLERLKELVERAGVPEELLTRIDELIKKLEDEARKISKEVKRLIDELKKRLEDIHREVDRLIRELKETLKRVTDKDELLRRVKEVLERIARLSEELIREVKEVLEKIVELSRELLKRVLDVLRRIAELLEDALRKENVEEETVRRLREALKKLEDDLRKIERDAEREYKKLKDELEELTERYRREIRKLKEELKKDRK

SEQ ID NO: 13145 - protein, 242 aa, Artificial Sequence; identical to SEQ ID NO: 13144
  Synthetic

SEQ ID NO: 13146 - protein, 243 aa, Artificial Sequence
  Synthetic
SKREELKELLERLLKLDRDTLEELKRLLDELKKTNDDTLEILKRLLEEVLRVIRETGLPEDILRRAEELIRRLKKKLEEIVRRNEELIRRLREDLKRIHDEIRKLIEDLKRDLDRTKDERTILKLVKEVLERISDLNRKILDSVRRAIEKDVKSNEEILDLVREALERLAKLVEDAVREKIREDKDRVREIERRLEELRKRLEKVERDLRDRHRKVKKKLDDVIEKVKRRHDELRKELEDAER

SEQ ID NO: 13147 - protein, 243 aa, Artificial Sequence; identical to SEQ ID NO: 13146
  Synthetic

SEQ ID NO: 13148 - protein, 250 aa, Artificial Sequence
  Synthetic
KDEEEVEKEIRRLLEKVKDVLRRSLEELERLLREIKEVLEKLEREDEENIERIKRELERQLPSEDLLRVVEELIRSNVTLSKRALDEVKRLIRRLVDVSRRALEKAIELIREAVELLERALKRKGLPREEVKRLRDEIKKIEDRLKELLRRYEEEVEKIERRLEELIRRYETEVERIERRLEELRRANLDRETLIREIEKILRRLNELNRRLLREVERILERLLELHKRLLDELLRIAERLMRLVEEVKK

SEQ ID NO: 13149 - protein, 250 aa, Artificial Sequence; identical to SEQ ID NO: 13148
  Synthetic

SEQ ID NO: 13150 - protein, 247 aa, Artificial Sequence
  Synthetic
SEAEDLEELIKELAELLKDVIRKLEKINRRLVKILEDIIRRLKEISKEAEEELRKDTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVRKDKDEAERRRRELKDKLDRLREEHEEVKRRLEEELTRLRETHKKIEKELREALKRVRDRST

SEQ ID NO: 13151 - protein, 247 aa, Artificial Sequence; identical to SEQ ID NO: 13150
  Synthetic

SEQ ID NO: 13152 - protein, 242 aa, Artificial Sequence
  Synthetic
DEVEKLKKLLKELEELNREVVDTVKKLLDELVKLNRDVLREVRELLKKLIDALEKTGIDDTVRRRLEDIERELEKVLEDSERKLRRIKERLDEVVKESKERLERLREELDRLARSNLPREELLDAIARVLRKILKVHEDALRKIEKLLRDLLRIHRTSLREIERLLRELLEVIRDVLDKRNVDEELRRELKKLEEEIERALERIRRRSEETADRIRRTLEKLREKSERKRREIEDTLRKDRK

SEQ ID NO: 13153 - protein, 242 aa, Artificial Sequence; identical to SEQ ID NO: 13152
  Synthetic

SEQ ID NO: 13154 - protein, 249 aa, Artificial Sequence
  Synthetic
SLLEKVKKVIERLLEIHKKLLEELKRLIEKVLRITRENLEEVKRLIKRAVEILRRIAEEKDKDTVEKLIRDLERELEKVLDDSRRLAEELERELEKVLREWEEKSKRAMEELDEVIKRLIKEAGDRSEKLRIVEEIVKDLERADEDVIRKVKELLEEHLRLHRELNRLIKEVLDDLLRALRELAESRTREEEVTRKIEELRKKLTKLIRELEETLKEVKKRNEDALRRLEKESKDLAERVRRLIEELEK

SEQ ID NO: 13155 - protein, 249 aa, Artificial Sequence; identical to SEQ ID NO: 13154
  Synthetic

SEQ ID NO: 13156 - protein, 240 aa, Artificial Sequence
  Synthetic
SDKEEIKRRVEKTARDLETEHDKIKKRLEDTVRDIKRELDELLEKYERVLRKIEKTLREGDKDVTDLVDKLLETVKRLNEEVLRTVKKIADELRRLVEEVLRVLRESNETLARLLEEANVRDEVRERLEEVLRRTEEIIKTLEEIVKRLLDELRRLVEELRRISKKLKDELDKIKEKDKDEKRLIEEVVRLLRENLDVVRRILEALAKLIKELLEALEEVLRRNKELIRELLRVLDEALK

SEQ ID NO: 13157 - protein, 240 aa, Artificial Sequence; identical to SEQ ID NO: 13156
  Synthetic

SEQ ID NO: 13158 - protein, 248 aa, Artificial Sequence
  Synthetic
DEEERVKKLLTDLRRLLRKLHEESKKLLDELRKKLRELRRRSEEKLREVERRLREAEKKLPETRVLKLVADVVKKVLDAIRDLNRKLEEIIDEALKLLEELDDILRRVVEEALRLLKEIKDTKRDRKEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 13159 - protein, 248 aa, Artificial Sequence; identical to SEQ ID NO: 13158
  Synthetic

SEQ ID NO: 13160 - protein, 248 aa, Artificial Sequence
  Synthetic
DEDRIIEEIARLLEELLRELLELIKKLIETNRRLNEEHERAVRELARLLEELLDRLVKKVIEDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIKKEIERELEELRRMIKRLHEDLERKLKESEDELREIERRLEEKIRRLEEKLERKRR

SEQ ID NO: 13161 - protein, 248 aa, Artificial Sequence; identical to SEQ ID NO: 13160
  Synthetic

SEQ ID NO: 13162 - protein, 251 aa, Artificial Sequence
  Synthetic
STEEKLRELVKRLEELLRDLERLLRELEKSNRDLNETALRLVEESDKLLEELLEKLARNNVVDEELLRRARKELKRLIEENKKIAKEINDRTEKLVRELRTLLDRLREELKRLIEELKKLLKDGLPDEDLLRDVKRAVEEVLKILRDLLTKVEELDKRNVDLLRKWLEVNRKIVEDVLRILEELLKRDAREDKDTVKRLKEDLDKARKDHEKKLEDLERLLKRNEERLRKMKKELEDKVERLRRELEKKRK

SEQ ID NO: 13163 - protein, 251 aa, Artificial Sequence; identical to SEQ ID NO: 13162
  Synthetic

SEQ ID NO: 13164 - protein, 251 aa, Artificial Sequence
  Synthetic
DEEEKIRTTLDLLRKLLKVLREILEELIRSNKELNERLLRLVEDSDRLLEELLKKLEDDNVVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKRAREEEEKVRDTEKKLRDLREKHKEIAKELERLLRENRRRLEELKREAKKVLDELRKRLEDERR

SEQ ID NO: 13165 - protein, 251 aa, Artificial Sequence; identical to SEQ ID NO: 13164
  Synthetic

SEQ ID NO: 13166 - protein, 240 aa, Artificial Sequence
  Synthetic
SEKEEVEKRLKDLEEESERLLKEVRDTLKRLEEESKKLIDELRRKLEELRKEVKELVDRGRDVKDLARELLRLLEELLRDLKRVADESARRNEELVKELKRLIDESLKANTDLAEEIKRTDNTDERKLRELERVLEEYRRRIERLKEELDRVLEKWKTEIKKIKKELDDVLRKAEEEVEKNKTVDKALTKVVDDVLRVLERVIERLLRLNKESLKELERILEDLRRLNKKTLDVLREVTR

SEQ ID NO: 13167 - protein, 240 aa, Artificial Sequence; identical to SEQ ID NO: 13166
  Synthetic

SEQ ID NO: 13168 - protein, 240 aa, Artificial Sequence
  Synthetic
KEKEEVEKKLKEAEEEHRRLNREVEEDLKRAKRESERLLEEMEKKLDELEERVERLLREGRDVDDLIRELLKRVRDLVRELKKLIDESAKLVRELVKRLKKLADDNLELVRRLVKEIIDRINTTEDIIRELKKVLEKYEKRVREIKKRLDEVLKKWEDEIRKIKEDLDRVTKKIEDDVRKNRNVREVLEKLVRDALRTLREVLDRLRRLNEELLEVLRRVLRELERLTRELLKVLRDALK

SEQ ID NO: 13169 - protein, 240 aa, Artificial Sequence; identical to SEQ ID NO: 13168
  Synthetic

SEQ ID NO: 13170 - protein, 250 aa, Artificial Sequence
  Synthetic
SEAEEVARRIKELVRELEKLLRDSEETIKRLIDKNRDLLRRIAETIDKLIKDLRDLLRRIKGEDLLEAIKRAIKTAIDVLDKLLKLDKTTLEELIRVLERNLEEIRRVVEELIEVLRELARRRRVSEEIKRRLEEKVKELRERLERARKRHKDAAKRLRDSARKLEEELRRLADELRKELEELERQGDVKDEDVRRALERVEKLLREILERLKRHSEELAELARRLLDENRRIIEEIIKLIEDILRELKR

SEQ ID NO: 13171 - protein, 250 aa, Artificial Sequence; identical to SEQ ID NO: 13170
  Synthetic

SEQ ID NO: 13172 - protein, 249 aa, Artificial Sequence
  Synthetic
DLERLVEELARLLKEALDTLARHSERLIKLAREILETLRRHSERIAELIERILRELMERRGRTEDIERVKKRVEDIIEKNKELLRRIKRRIEELAKKNRKLLDEIRRRLEELIKRLEELLREGRPEEEALRLLAEMVRRALEVLKELLRRDAETVEELLRVLKELLELNERTIRELETILDELVKRAGLPEELKKKLEDISREIKKSLEEVEERLRRISDDVRRSLEELKRILDEIEREIERRLREAKR

SEQ ID NO: 13173 - protein, 249 aa, Artificial Sequence; identical to SEQ ID NO: 13172
  Synthetic

SEQ ID NO: 13174 - protein, 246 aa, Artificial Sequence
  Synthetic
SDEERLRKEIRDRVEELRKRLDDTEEEYDKRIRDLRRKIKEVEDRYREKIKRLEEKLRRGELSTELLLEAIARTSEEVNRILEELLREIADLSREVLEKLRRLAKELEDLVEEILRKLLARRDTERIREIVRKLRELVDEVRKRLEDIIRENEELLKKAEEDLKRIVEENEKLIRDAADRIRKIKDKDTVLRILKELMDRDEEILRRILKLIKELLDESKKTVRRVLELLKELLRKILKLVEEITR

SEQ ID NO: 13175 - protein, 246 aa, Artificial Sequence; identical to SEQ ID NO: 13174
  Synthetic

SEQ ID NO: 13176 - protein, 237 aa, Artificial Sequence
  Synthetic
SKKEILKEVLRRILKLIRELIETIKKVLKRSLDLNKELIDINKEALDRILKLLTDIGLPEDVLEEIKRAVEKLKKRYEELLKKYKEDLERIKRRLEKLKEEIERKVKKLEELVDTISLEEVLERIDKLVEDVLRTVEEVLEELRKLNKESLDTSREMLRRIKELVKRVIEELERAGIDKRRLKKLADELKEILDRLREKNKEIADRAKELHDEVRERLKEIAKRLKDVLRDARERVR

SEQ ID NO: 13177 - protein, 237 aa, Artificial Sequence; identical to SEQ ID NO: 13176
  Synthetic

SEQ ID NO: 13178 - protein, 238 aa, Artificial Sequence
  Synthetic
REMEEVLKRNLDAARRVLETLKRILDRLKELNERSLRSLRDILRELLDIAREVLDLRRAGSSEELKRRTEEKIKKLVKEIDERLEDLLRRYEEEVKKIEETLERLLREYEKLLKKIREEMGDEDEKVKKILEVLERSKKIIKELLEALKKVAKDSLRLNRELVKVIKRVIEEIRRLIREQDDIEKVRKDVEDLAKELEDRLRDVERESRRLLEELRETLERALRRVKELHDELREAIK

SEQ ID NO: 13179 - protein, 238 aa, Artificial Sequence; identical to SEQ ID NO: 13178
  Synthetic

SEQ ID NO: 13180 - protein, 237 aa, Artificial Sequence
  Synthetic
SRKEELLRILRRILEIAEEIIRDLKKWLDDDRELVREILELIKRLNEDNNRLIREAGLREEVLKELEDRSEDLKRKLEKLREDYRRELKRIEDKLEELKERLRKVVEDLERLIEKMDDKEVLDELRRLIEEAVRALEEVLKEILELSKTVIERLKDLLEEDKKIVKKVFDMLRRDDKREDELRRLEEALKESKRLVEEVLKRIEDVLRESKKLADEIRKKIEDLVRELEEELERVAR

SEQ ID NO: 13181 - protein, 237 aa, Artificial Sequence; identical to SEQ ID NO: 13180
  Synthetic

SEQ ID NO: 13182 - protein, 244 aa, Artificial Sequence
  Synthetic
SKEEKKKELEKKAREIKRRLEENKREYKEKVDRLKEELRRLLEEIREKVKRLEERIRRAIDKEEVVRLLKTILEELLKILEEVLEEIDRLVDENAKAHKRLLDVLKKILEDLLRILEDVERRDKSRELEETVERRIKRLEEKIRKVEEEYRRVVETLKREYKKILDKLEKLAEELKRKIEEVRKRNVLKDLVKELEDVLKELLDLLREILKTVKRVNEDSVRSAEKLIEDLERMIRELLKEARK

SEQ ID NO: 13183 - protein, 244 aa, Artificial Sequence; identical to SEQ ID NO: 13182
  Synthetic

SEQ ID NO: 13184 - protein, 234 aa, Artificial Sequence
  Synthetic
DERERIEEDLKRLRDTLDTKEEESRRRIRELEEDLKRKIEESRRRIEKLKRRMEEDGAPGELVEILERAERANERNLKLIAAILDLIKKANEETLREIRRILDEIERVIRELERLDRREDEVRKRLRDILRKIREEIKKIERRNDKVLRDIKELIDRIKTHLKKVLDDVKRLLDEIEPSEILDRLRKVLEELARRDRKILEDLERAVRELDKLDRDILRTLLRVAEELLRRREK

SEQ ID NO: 13185 - protein, 234 aa, Artificial Sequence; identical to SEQ ID NO: 13184
  Synthetic

SEQ ID NO: 13186 - protein, 252 aa, Artificial Sequence
  Synthetic
DKLEEILKLLKEVIKTLLRLSEDLNRLNRELVRTVLELLKRVVELLKRVLEEVRKKVRDANTVPDEVIERVARELDRLLKELEDDIRRVAKELEEVHRENEKLLRDVVRDLERLLERLKRELDRNLPEKDLLKTLEDVLRELLKIIARLVELNKRSNRRSTEIIDRIVKSLERVIEELLKIIDKLAKALDDRRDKVERDVRRIKEKIKRILDDLRRRVEELKKKNKEDLEKYDEDIRRLEEEIKRLLEEARR

SEQ ID NO: 13187 - protein, 252 aa, Artificial Sequence; identical to SEQ ID NO: 13186
  Synthetic

SEQ ID NO: 13188 - protein, 235 aa, Artificial Sequence
  Synthetic
REEKELLDEIRKRVKESEDRLEKLLRDYEKELRRLEKELRDLKRRIEEKLEELRRRNLDFKELLKTLEDLLREVLEVARRVVETLKELNRRVLEVVREDIERNERLLRRVLDTLRRKGVDERRIKDLERLIRESLKKAEEVLREAAEKSREIVDEIREVLKRADEALKRIIKKIRETRGKDALSRLLEELLRVVDDLIRVLKELIDKSRKVIEELLELLKRINEENLKVLAEIIK

SEQ ID NO: 13189 - protein, 235 aa, Artificial Sequence; identical to SEQ ID NO: 13188
  Synthetic

SEQ ID NO: 13190 - protein, 242 aa, Artificial Sequence
  Synthetic
SRKEKLLKESEEEVRRLRRTLEELLRKYREVLERLRKELREIEERVRDVVRRLKEVLDRKELDIDTIIKEVEDLLKTVLDRLRELLDKIRRLTKEAIEVVREIIERIVRHAERVKDELRKEGADKRKLDRVDRLIKENTRHLKEILDRIEDLVRRSEKKLRDIIREVRRLIEELRKKAEEIKKDPDERLVKTLIEDVERVIKRILELITRVAEDNERVLERIIRELTDNLERHLKIVREIVK

SEQ ID NO: 13191 - protein, 242 aa, Artificial Sequence; identical to SEQ ID NO: 13190
  Synthetic

SEQ ID NO: 13192 - protein, 234 aa, Artificial Sequence
  Synthetic
SEKEKLREIIKRHLRSVEEVLRLLAKILKDLTDASEENLRLLKELLRRLLEVIRKLVEDVKLDEKILRELEEDIRRLEEELDRLTKELRRKNREALERLRKLVEELRRKHERLERELKDIDKEDILRILADLSRKLKETVEEVLKYLRDHLKEDEDITRRVLDVLRKIVKKIEERARDEDALRKLKKKLEEIEKTVKDSIDKLRELLEELERRVRKIAEENKRLLEELVREVKK

SEQ ID NO: 13193 - protein, 234 aa, Artificial Sequence; identical to SEQ ID NO: 13192
  Synthetic

SEQ ID NO: 13194 - protein, 235 aa, Artificial Sequence
  Synthetic
KDEERLEDELRELTERMREKLKEHEERVRELSKEVKRKAEDSEEKLKKDLKEVEDTLRKKSEVDERALRLLRDILRKLIKLHRDVLERLKRILEELEKLDREVIEKHERSIKRLIEVTKRVRDRETARELLKRLLEDNRRALEEHKRELDKILKKLEEVLRDARRRHDDLLRELRENPVTEELLERIERIIRTSKKLLTEALEIIREIIKRSKDSNRDLHRDLEAILRRIEEAKK

SEQ ID NO: 13195 - protein, 235 aa, Artificial Sequence; identical to SEQ ID NO: 13194
  Synthetic

SEQ ID NO: 13196 - protein, 243 aa, Artificial Sequence
  Synthetic
SDEERLVAELERLIEISLRILEELLEVLRRLVEESLRLLEELVKVAEEIIERLLRLLEETVKDEDRLREIKEELRKLKEKIKRLVDEVREEHRDLLRKIEDLARRVRKKHKELKDKAKEVTKKVRGRERVLKRLSELVKELEDIHKDVLRELKELIDRLLTINKRVLERIDRLLKELLDLVRRDTGDSERLKKTADEIKKRLDKVRKDSDDLAEEIKRILKRVEDESRDTARKVKKVLEDAKR

SEQ ID NO: 13197 - protein, 243 aa, Artificial Sequence; identical to SEQ ID NO: 13196
  Synthetic

SEQ ID NO: 13198 - protein, 235 aa, Artificial Sequence
  Synthetic
SKEDEVLERLKRAIERSIKIVEEIVKRNVETNERSERILRELAETLRRVLDTIRKLLEDKVDEDTLREILERLRRELKELMDKSREELKRNEETLRKLEDESRKEIKTLRDLIKKRIEELEEVKRVVEELIRVHEKVLEDSKDSNRKSVKVHREALKAAEDLLRELDRVLEVATRGDISEEELKRRLEEIERKLKEVLDRLKKKHDDDNKENKDVLDEVRKRHKELLDKLREKRK

SEQ ID NO: 13199 - protein, 235 aa, Artificial Sequence; identical to SEQ ID NO: 13198
  Synthetic

SEQ ID NO: 13200 - protein, 236 aa, Artificial Sequence
  Synthetic
DEEEKVLRILEELLKEHKRVLEELLELVRRIIERHKEVLKRVLKLVEDLIRRIKEANREGRELVKKLEELLRELEEALKRSEDELRKILKELEDLIRKSLRDLERLLKELEDIIRENRDEKDLRRVITEVLKRVEKIHRRVLKEIKKVLKKLLDNHRKALEEIARVLKRLAEIVREANLPEEAAKEVEKRLEEVKTDLRRLARESEETLRRVEERLEELKERSERELKRVEEEIRR

SEQ ID NO: 13201 - protein, 236 aa, Artificial Sequence; identical to SEQ ID NO: 13200
  Synthetic

SEQ ID NO: 13202 - protein, 231 aa, Artificial Sequence
  Synthetic
SEEEELKRILDENHESLKDLLREIKEILRANHETVKKLLETIKEILDTVLKILRDVGLPEDVLRELEKLVRDIKRKLEEALKRHEEKLRRITKELEDMKRRHEEDLRRIREALKRGEIDKDAIADLLRKSLEIVRAILEKIKKVLEESHKTLRDIVRDIEKVLEDLLDMLREARVPEELLETLKRLIRELVKRLEKILDDDRKLIDRLVRRLEEILKEDKRRIEEALERLR

SEQ ID NO: 13203 - protein, 231 aa, Artificial Sequence; identical to SEQ ID NO: 13202
  Synthetic

SEQ ID NO: 13204 - protein, 244 aa, Artificial Sequence
  Synthetic
SELERAEELIKKLLKLHEDVLRRLTEVDDELLEIHDRVLKRLKEVDDELLKLIRDMLRRANISEDLVREVEERLKTLEKRSRDKKRENEKKLRELKKKSEKLRRESRKLLEELRKKVEELRNVDKKDVEKLIKEIVEVHRRMLEKWLRLNEEIAKVHEDSVRDWLKANEEIARTIEEILRRVLRGDEEAKDIREKLERLLRKSEELVRKSLKELKELLDKSKKLLEDSKRRLEEILKEIKDDSR

SEQ ID NO: 13205 - protein, 244 aa, Artificial Sequence; identical to SEQ ID NO: 13204
  Synthetic

SEQ ID NO: 13206 - protein, 237 aa, Artificial Sequence
  Synthetic
DEEDEVEKLIREAIELNKRILEEIKELIERIVRRNKEILREAKEAIERLIKIARDLTKDKSDEKTIEDVLREIRKRVKDLEDKLREANKRLKDDLDRLTRKLEDLHRRLKEKVDRTVEKDKDGQELKRVLDEILDVDRETIKELEDILREIHRIDKETIDRLLEILERILRALEEIAREKDEEKLERIARELKKLLEEVERRSRKAIEDLKRELKRVMDRSREAERKLRELLKETKR

SEQ ID NO: 13207 - protein, 237 aa, Artificial Sequence; identical to SEQ ID NO: 13206
  Synthetic

SEQ ID NO: 13208 - protein, 243 aa, Artificial Sequence
  Synthetic
SEDEVLKKIEDELREVEKKLEDVLREIKRRHDELKKRLDEKLERLRRRHEELKEALDRGEVDIETVRRVVEENVRTDKRILEEAKKVVEENARTDKKLNDEVRELLKRLVDKLRKTVRSDETKLRDLDRVLEKLKKDLKRVIEETRRVLEEVKEALDRILRESERVLREVEKRLEEIKRSPKREEEVKRDLKRILDRLLEVNTKSIEDLKRILDKLLEVNRRNVDEIRRILDELRKVIERVTK

SEQ ID NO: 13209 - protein, 243 aa, Artificial Sequence; identical to SEQ ID NO: 13208
  Synthetic

SEQ ID NO: 13210 - protein, 235 aa, Artificial Sequence
  Synthetic
DETERVKEVLDRSLKLNEDLLRKIDEILKRLFEINKEVIDIIRELLERLVRIAREVLEKNNVPEDKKRELEKILKDVEDELRKYEEELKKKLEDVERRLREYLKRLKETLDRAREILRDTGARREVVKKLIDDSLELVKRLLEEVADDIRESLKRLEDLLRRARRLAEELERLLRELNVREEVEKRIKKLLDDLEKVAREIRKKHKELLEELEKVAREVMDAHRRLLEDLKRTDD

SEQ ID NO: 13211 - protein, 235 aa, Artificial Sequence; identical to SEQ ID NO: 13210
  Synthetic

SEQ ID NO: 13212 - protein, 244 aa, Artificial Sequence
  Synthetic
SLKEIVKEIIDRASELLKRLLERSEDSLRTASELLRKILEDSRRSLRTIARLLEELLRTDGPEEELERAARRVKEELERLHKEIRDVIEEIKKTLKKLNEDLREAIERVKRELERLLKELEDSGVPRELLELVKRVVELMAELLDRLLKLNEKILRDIMKILDEILDLNREILRLVKEIIELIRRDGPDREIEKEIRRILEELKRKHDEIEKKIRELEREIKRKHEELEDRIRKIERDLDRRTK

SEQ ID NO: 13213 - protein, 244 aa, Artificial Sequence; identical to SEQ ID NO: 13212
  Synthetic

SEQ ID NO: 13214 - protein, 244 aa, Artificial Sequence
  Synthetic
SLRELVEKILRDAAKLIERLLKLSEEVLKRIEELLEELLRLSERSLRELLRLLEELLRSTGPEEELERLADRVRREIDKLNKEVRDALERVKEELKRLHDEVDKVIKEVKETLKELLKRLKEKGIPKDLLKLIEDVLRLVMTILDEIKELNERLLRLIEEIIDRLLELNNRLLEEIKRIIKRIRETGPDKDIKKELDDIVRDVKRKHDKLREELKKIVEDAERAHRDIDRKIREILKELKERTD

SEQ ID NO: 13215 - protein, 244 aa, Artificial Sequence; identical to SEQ ID NO: 13214
  Synthetic

SEQ ID NO: 13216 - protein, 241 aa, Artificial Sequence
  Synthetic
REEELRKKIEDELRDLKRKLEDLLRRYEEKLREAEKKLKDLLRRYEERVREIKKELSRNSDEEVVKEIIERLRRSNKELEEMIRELIKILEEASKELEDLVREILEAIRRILKELRDAGALKEKVERDAKKLLDDLRELLERILRESRRLIEELKELLKEVKRRSEELIRTLKEVLDRVKGEDELLRVLEKVIEDNLRIVEELIRRLEEVLKRHEDLVRTLLDLLKRVLEAVKKLLDEAVT

SEQ ID NO: 13217 - protein, 241 aa, Artificial Sequence; identical to SEQ ID NO: 13216
  Synthetic

SEQ ID NO: 13218 - protein, 242 aa, Artificial Sequence
  Synthetic
SSEELLKRIVDEDERVLEEWRRVLEEIKDLSKRVVDLLDKVLKEIEKIVDEVTRRLERDGTDDKKKIRDLVEEIKDIIRRAREKLRRIVKENEEILEEAKRRLDKIAEDNRRTLEKVRKELEETKEEREVKRILERVLREAEDSHRRAVELLEELLDRSRRTIEEAIRLIKELLDRILELLKRLGLPKDLLETIKKRVEEIRRTLEKIKRDYDKAIEEIRRKLERKLEEYKEVIDDLRRKTK

SEQ ID NO: 13219 - protein, 242 aa, Artificial Sequence; identical to SEQ ID NO: 13218
  Synthetic

SEQ ID NO: 13220 - protein, 234 aa, Artificial Sequence
  Synthetic
SSDELLEEIIKEIARLIEELLEILRENLERSEESLRRVLRAIDDNLRRVERLIEALARGEKREDDVVRDVDDSNKKLEDTLREVVKENEKSNEELKRRLEEVVERVRRLLTELRKREEDEKLEDVLRLVEELLRRLDEILKEHEEDNKRLLDLLRDIVRRHKEEVKRALEVARRKEEPKKAMDEELEKIRRDHERLKKEIEDRLRELKDKHRRAFEELKKMLDDIKRKVDEAKR

SEQ ID NO: 13221 - protein, 234 aa, Artificial Sequence; identical to SEQ ID NO: 13220
  Synthetic

SEQ ID NO: 13222 - protein, 247 aa, Artificial Sequence
  Synthetic
DEEEILREILRVAEELSRLNEEVNKRVLEVLERLSRMNEKLLKEVKDVVDRLIELRRRKDLRERELEEELRKLIEELERRLEELERAHRKLVDELRKLLETLKRRHEELARRLRKLLKDVVDEKKRELEEIKRIVEDIERALEESLRISEEIVRTILKALKESLDRIDRVVKEILRLLKELKDSDRDDKEVKRRIEKALRDIEELIERILRRNEEVKREIERLDEENRRRNKEALERIRRLIEETKR

SEQ ID NO: 13223 - protein, 247 aa, Artificial Sequence; identical to SEQ ID NO: 13222
  Synthetic

SEQ ID NO: 13224 - protein, 247 aa, Artificial Sequence
  Synthetic
KDEEELKRRVEKVIRDLERKLKDLEEDHRRVLEELKRELEETKRRLDKVIEEIERVLRRNEKPEDFALEEIRRLIEESIKTLRDLLRKLIKLNEDIARALKEIADEIRKLIEEIVKELRKKERDEDKLRKLEEDLKRLLDKVEKVLRDVEKELTDHNRDAKRAIRELEERYEEIEKEIERLRREVRGKERLIRVLEEILRLVLRLHEEVVRLVRRLLEESHRILRKIVELLREILEDLKKILDDIRR

SEQ ID NO: 13225 - protein, 247 aa, Artificial Sequence; identical to SEQ ID NO: 13224
  Synthetic

SEQ ID NO: 13226 - protein, 233 aa, Artificial Sequence
  Synthetic
DEEDEIRKRLKELLDDVKRRLDELRRESERLLKEVDDLLRESKKRLEDEKKKLEERGLSEEVKKVLKELERVHDENLKLIRDWLEKHVRINETLLKLIAELLKILEDVMDELTKDRTTKERVERLLRTLEEVLKEVADRIRKLSKKDKEDLDDILRRSKESNERLREVIKRLAEKGVDKEVLERLEKIVRRNEEVNDEVRELVTRLNETSNRAARELLELAKRIIEEIKKAVK

SEQ ID NO: 13227 - protein, 233 aa, Artificial Sequence; identical to SEQ ID NO: 13226
  Synthetic

SEQ ID NO: 13228 - protein, 235 aa, Artificial Sequence
  Synthetic
SKLETIKELLERLHELNERAVRELKKTLEDLHRDNARLIEELIRKNERLLEALREKVRDERLLTELTKLNEESIKRLEDILKKNRDLLERIKEDLDRLLKKNEELLRDIKRRLDETNSREEELIRVAEEVLRRDKKSHEELLKIAAEVIKRDKESHDELLKVHRENLELIERVLKESGLSEDADRDVKRLKEESEELLRRSKKRADDLKREVERLLEESRRRLDELLKELKDRSK

SEQ ID NO: 13229 - protein, 235 aa, Artificial Sequence; identical to SEQ ID NO: 13228
  Synthetic

SEQ ID NO: 13230 - protein, 245 aa, Artificial Sequence
  Synthetic
SRLEEIKKLLEKVMELIRRIAEELLRINEKVLEVLERIVRTILRLNEEHLKDVRDIARKLKLSDEILRRAEEIVKRSKEELKRLLEEAREIVKKSKRKLEELLKRIEEVVRDAKRKLDENKDSDERTLLEILKRILEELRKLIEELLRIHEESLRRIAKILERILRLNDKSLRDLERIVREAVRERNDDSTEIRKRLKELRDKNEELKKKVEEMIRRLEEESKKTKKRVEEILKRIEEEVREKAR

SEQ ID NO: 13231 - protein, 245 aa, Artificial Sequence; identical to SEQ ID NO: 13230
  Synthetic

SEQ ID NO: 13232 - protein, 237 aa, Artificial Sequence
  Synthetic
SREETLRERIERIKRKSEEDVERIKRTLDREREENEETVRRIKETVDRLREEVERELKDDKSLEEIIRRLTELLKKLLEVHEDALRRLDELVERVLRVHEEVLEELKRLLELLEAGLDRKDVRKRLKDILERVRRLHEKLKEELKRILDEYEKKLRELLKELKDILKDAEELLKSQPKSRELDRVEEIIRRIVKKLEEILRDLKRRAEDHIRRLTELIERSLKIVRDLAEDIRRAIE

SEQ ID NO: 13233 - protein, 237 aa, Artificial Sequence; identical to SEQ ID NO: 13232
  Synthetic

SEQ ID NO: 13234 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 13235 - protein, 238 aa, Artificial Sequence; identical to SEQ ID NO: 13234
  Synthetic

SEQ ID NO: 13236 - protein, 238 aa, Artificial Sequence
  Synthetic
TEKELLEELEEDVKRVIEELERLLREWKEELRRVLEESERLLRELRERNKRELEDIRRIKEDEALRERLKRLLETNDEVNKRHLKLIEELLRRIKEVNRRLLEEIRKLLEKLKEVLDRAGLDEEAKERLERILREVEADLRRYEKELEDLLDKVKKELERTREDSKRLVDEAKKLLEKNKLDLEEVTRILERNLKELERNLRDLDRTVKTNERLLRELLKKLRDIVRTILELLERKTK

SEQ ID NO: 13237 - protein, 238 aa, Artificial Sequence; identical to SEQ ID NO: 13236
  Synthetic

SEQ ID NO: 13238 - protein, 236 aa, Artificial Sequence
  Synthetic
SEKEDVRRKLEEDREKHERDLRRIEEELRRTIEESERRLKEVKKRLKELIDDVRRRDSDDRTLLEKIIRDVEKLVRELVEDNRRAIEKVKRLLEEIVKTHRDNIENVRRLLEEKGVPEEVREELRRIVEESERVVRRIEEELEKIVKDSEDAVREIEEDLERVLEKAKRLAEKLKDKEELKKAVETILEELVRIADKLIDIHREILEKLLRVAEKLLEVSRRALDKLKKLIDKTDK

SEQ ID NO: 13239 - protein, 236 aa, Artificial Sequence; identical to SEQ ID NO: 13238
  Synthetic

SEQ ID NO: 13240 - protein, 231 aa, Artificial Sequence
  Synthetic
DKAEVLREALKLLKDLLEELIKIHEESLKRILDLIDTLVKVHEDALRKLKELLERSGLDERELRKVERMATESLRTIRKLKEELRDLARRSLEKLREDLKRVDDTLRKVEEKVRRTGPSEELIEELIRTIEKLLKEIVRINEEVLKAVRELLKTLLKLSEDVVRRIEEILRKRNVPEEIDRELKRVVEELRRLHEEIKERLDDVARRSEEELRRIIKKLKEVVKEIRKKLK

SEQ ID NO: 13241 - protein, 231 aa, Artificial Sequence; identical to SEQ ID NO: 13240
  Synthetic

SEQ ID NO: 13242 - protein, 235 aa, Artificial Sequence
  Synthetic
REKEEIERTLEELKRILDELVKDDKKSLDRLREIMERSVRIAEETLRKLRETLELKARGEVDEDKLRELAKRLRDDLRRVSREHDEVRKRLKEEHDRLEKKIRDAERRLKTRLDELVKEKGRRIRELEEVLTEASRLLKEILDVNKEILDRAEELLRRNEKVIEEILRAVITLIRRDDDKDEVLKRLDDLIKEWRDVLEKLLRDLRELLERSKKRLRKVREDLKRLLEELERRAD

SEQ ID NO: 13243 - protein, 235 aa, Artificial Sequence; identical to SEQ ID NO: 13242
  Synthetic

SEQ ID NO: 13244 - protein, 236 aa, Artificial Sequence
  Synthetic
STREKAKKVLDTLRRDNEDMKRVVEKILRALKRTNERAEKLAREITEEIKRILKEVRVDRELLKEIEDTLKRVLEEIKRLLDESKKLLEDVEREIREILKTSEELLERIEREIETVNRDEKTLKEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 13245 - protein, 236 aa, Artificial Sequence; identical to SEQ ID NO: 13244
  Synthetic

SEQ ID NO: 13246 - protein, 247 aa, Artificial Sequence
  Synthetic
DKERVLEDVKRRAKELEELLKEVEDRYEEDLRRIEETLKDTERRYREKLEKIKEELKRTVRRREVLEVIKELLKKLEDNIRELLDAIREALERLRRINKRILDILRRAIEEIKKILDEISRVDEKRELKKIKEEIDKLVDEIRRRLEELEKESEKVVKELEDKLRESVKRSEEIAKEVTDDLRRKNVDEKIKRIVEKIIKEHRDVLERLKRIIEEITRSDRESLERLKEILKELIRILKELADRERK

SEQ ID NO: 13247 - protein, 247 aa, Artificial Sequence; identical to SEQ ID NO: 13246
  Synthetic

SEQ ID NO: 13248 - protein, 242 aa, Artificial Sequence
  Synthetic
KSEDVVRELIKLHRELNDKARKVIETILERNRELVETAERVIRRLIKLLEDALRILKKSSTDEDEVRRAEELVRTLKEKAKRVLEEIRKLSKELEEKIRKVLEEINKLSEDLERKIEELTRKVRGEERLLEALTELLKDSIDILRTVLDLLRKLLETSLRILERVLELLKELLDDIREILRRLRLEEEELRRLEEEIRDIVRRLRKRVEEYRKELEDLEKELADEVKKYEDEVKRIREELRK

SEQ ID NO: 13249 - protein, 242 aa, Artificial Sequence; identical to SEQ ID NO: 13248
  Synthetic

SEQ ID NO: 13250 - protein, 234 aa, Artificial Sequence
  Synthetic
STEELLREIEEIIRRILEIADKTSKEWADLIKRILELIKRNLEELRKLVREVLEEVRKEGTSDRRVEEDLKRLLERYRRELEKLKEELKKVLDEHKKELKRLKDKLKRLLEELRKRVDDQDKTVLEEVLKEIADVVREITEVNKELARIIEELVKKIAKLSEEVLKTVEELIEELLEDKDTIDKLRKRLKEIKDRTKELLDRIREEIRELRERNKEIVKDIERRLRELKDRIRK

SEQ ID NO: 13251 - protein, 234 aa, Artificial Sequence; identical to SEQ ID NO: 13250
  Synthetic

SEQ ID NO: 13252 - protein, 243 aa, Artificial Sequence
  Synthetic
SKKELVREVVKELHELNKDVLRVLTEIVERVKELDKRVLEVLRRIVEEVERLAKEAGLDEDELRKLIEELRRLLKRIEDEVKRLNDELDKKLEELRKESEDLNRELEKTLRDDERKDSREDRVVRDIARILKTVLERNLRKIEEAARILMEYIERVKDLWRRAAELLKEILRRLLKLLKDKVTDKDRLREIEERVRKILEEIDKLLDDLRKAYDRILERIERLVRELSRKHKEVADKITELVK

SEQ ID NO: 13253 - protein, 243 aa, Artificial Sequence; identical to SEQ ID NO: 13252
  Synthetic

SEQ ID NO: 13254 - protein, 237 aa, Artificial Sequence
  Synthetic
SEDERVTRLKEELERLLDELRKRYEKLREEIRRVLEDLKKKYDELKEELDKMLRDLERRGKVSEEVLKVLRDVAARIEENLRRNLRLVAEIVRKLEELMKRNLDAIRELIEDVKRLLEIARRVKDERELKRIIEEIRKKIEKLLRESDKEVKDVDRDIKRALEESKKTNEKLLRDIERAGIDEELLRELERVSREDERLVKEAADELRRILDTDRKLLKEVVDTLERVLRRILKETR

SEQ ID NO: 13255 - protein, 237 aa, Artificial Sequence; identical to SEQ ID NO: 13254
  Synthetic

SEQ ID NO: 13256 - protein, 243 aa, Artificial Sequence
  Synthetic
SEEERVEELLRRIEKLLKESEEDVERLKKRHEEENRRLKEEVKRLMDELREILRRLEEETGEDRLVDILREIARRLEELLKRILELHDRSARILEELLERDLELLKEIVTEAKRVLEIIKRDGPTEEVKKELERLKKRVDEILKRSKDEVRKWKKAVEDAIRELRKLLKEVKDRVKELIERQRRDKDVDKLVEVLDRVLRRVRELLEELAETNRESIRRYERLSEKNAELVTEIIERLRRTVK

SEQ ID NO: 13257 - protein, 243 aa, Artificial Sequence; identical to SEQ ID NO: 13256
  Synthetic

SEQ ID NO: 13258 - protein, 247 aa, Artificial Sequence
  Synthetic
SKMEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLRERREQPNDEKRVEKIKRDLEKKARRVREENERIKRDLKRTADESRKRLEKLLEDLKRELDRLREDLDRARKDIDERVEELIERLIRIIERLLREVIKSHEKLVRTIERLIEESIRVNEELLEVIERLLDRARK

SEQ ID NO: 13259 - protein, 247 aa, Artificial Sequence; identical to SEQ ID NO: 13258
  Synthetic

SEQ ID NO: 13260 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSQPLDRKKVLEVLDELVTIIAKLLDENIKVLEEVIRVIAELLERLLDSHRRLIDIIAKLLEELRPEDKDLLTELEKKLRKLKRDSEKVVDDLKKELERIKREVKRLIEENRRTLKDIKRAVDEARK

SEQ ID NO: 13261 - protein, 243 aa, Artificial Sequence; identical to SEQ ID NO: 13260
  Synthetic

SEQ ID NO: 13262 - protein, 245 aa, Artificial Sequence
  Synthetic
DEDELVEEIERRLREIEKRLRDVMEESKRRLEEILRELKRIIDESRKRLDDLRRRLKDVSEEILRIVEEIIKINEDNLRNARRILEEIIRNNEDLLRKIEELLKEIIKIVRELLKLLKKDGTLDDRILKEVKERADRLRERLKRIEKKHKEDADKIREDLERDERKHEEDAKRIREELDRLRKDIDERIEKILEEILRLSRESLRKLKKILEELLKVSEDSLRDLIRILEDLLRLLKDLLEKLKK

SEQ ID NO: 13263 - protein, 245 aa, Artificial Sequence; identical to SEQ ID NO: 13262
  Synthetic

SEQ ID NO: 13264 - protein, 235 aa, Artificial Sequence
  Synthetic
SEDEELEDLKRKLRRALERYEDRLREIKRRLDEKLKEIKRDYDRLKKELDDLLREIERRGVKDELLERALELIKRLLDKSLRLIEEVLRELKRLLDTDLDILRRILEEVARLIDEVRSGSRPGEELVREIKKVLDKVKEDSERNVREIERVLEEVEKRSREIVREAEEVLKEVEDRIGRDEVVKELLDLVREIIKRLKEIHEEILRLIETVLEDLERANRRLLDLARKILEDARK

SEQ ID NO: 13265 - protein, 235 aa, Artificial Sequence; identical to SEQ ID NO: 13264
  Synthetic

SEQ ID NO: 13266 - protein, 242 aa, Artificial Sequence
  Synthetic
SKEEKLEDLIRRIKERLEEALRRNKKTADEIRKELKKATDRNRKRAKELRERLREVLRRTKEDKVIKELERVLEEVLRKLERSLEELRKLLDKILKKSEENAKEIKDVLDRILERLRKREEDEESMKRILEDLKRRLEEMAERSRKKIKDLEKEIEDILRRLEELHRKIKRELEELLKRITDETGPSEVVEELLRLLEELLEHNREVIEKLVDLIRELLRHDKEVTEEILRLIEELLKEVEK

SEQ ID NO: 13267 - protein, 242 aa, Artificial Sequence; identical to SEQ ID NO: 13266
  Synthetic

SEQ ID NO: 13268 - protein, 239 aa, Artificial Sequence
  Synthetic
SERELIERWLELHKEILRLIRELVERLLKLHREILDTIKKLIRELLELLEDIARKLNLDKEAKDELREIKKRVEDKLEKLERESRKVEEDLKRKLKELTDESDTVEKRVRDVVRRNTQRREEIAEELLRLDRKLLKAVEELLKEILDLNKKLLDDVRRILEETRRVLEKLLDRVRRRERTDDERRTLTELLKRMEDILEKVERTLKKLLDDSKRMAEEVKKTLKELLERSEKVAEDVRK

SEQ ID NO: 13269 - protein, 239 aa, Artificial Sequence; identical to SEQ ID NO: 13268
  Synthetic

SEQ ID NO: 13270 - protein, 233 aa, Artificial Sequence
  Synthetic
SEDELIRRIREELKRLEKEHEDMVRELEKKHKKLKEELDRAIEEIERRLRELKERVEREGNGLEVLKKVLDALRKLLEDLREILKRLVDANRELIKENHKILKKLVELLERLLKLLKDGVPREEIRKEIKKISDDIRRLHRDLERRSKKLDDDLKKELDEIKKRAEDLLRKLKEDGLDDELVKEIKRLLEELLRLLERLVRSSRRLNEELLRLSEKLIRDAERLARELLEAAR

SEQ ID NO: 13271 - protein, 233 aa, Artificial Sequence; identical to SEQ ID NO: 13270
  Synthetic

SEQ ID NO: 13272 - protein, 241 aa, Artificial Sequence
  Synthetic
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRREDEKALERVVREVEKELKRLDDELKKALKDSEEELKRLEDELRRAKEENEKTLKKLRDDLRREGRDEEVLRVVEELLKLLKEHLEENVRILRRILELLRRHHDTNRKIVKRILELLRRVLESIRK

SEQ ID NO: 13273 - protein, 241 aa, Artificial Sequence; identical to SEQ ID NO: 13272
  Synthetic

SEQ ID NO: 13274 - protein, 241 aa, Artificial Sequence
  Synthetic
SVEEILRELLRVLEEILKRIADINEKLLRVSRKIVEDLKRLLDEALRVLRRAVEEIEKEGRDEKEKEKMRRVLEKLTKEVEDLKKKIEDVLRETEELSRRLKEELKDILRRLAKAVEDIERRRLDKEKVKKLLEDILREIERVIRESLRLAEEDVRKLEEIIKEILDLIERAIRIVEEEAGRDERLREILEELERVLEKVMRDLRRILREYEEVLKEAREEYRKILEELRKVLKEVDDRLR

SEQ ID NO: 13275 - protein, 241 aa, Artificial Sequence; identical to SEQ ID NO: 13274
  Synthetic

SEQ ID NO: 13276 - protein, 243 aa, Artificial Sequence
  Synthetic
SELEKIDRLLEKVLRENKRALDELVRLLEELIKTNRDALEKLREINERNIERLREEVKDVSERVKEELKRVAEESRRLIKKLKEDSEKTVRELRKLIEELRKRSKETIDRLRELIKRVREKGRRDKEAVKRLVDIHRRNLELLEDVVRKLLKLHEENLRLLEEAVRRILELDKKVLDKLRKDLDKKVLEDLERHLEESKKTVERLVRELRKTHRKVEEDVKRLIEELRRLHEELRKRLEDDDR

SEQ ID NO: 13277 - protein, 243 aa, Artificial Sequence; identical to SEQ ID NO: 13276
  Synthetic

SEQ ID NO: 13278 - protein, 243 aa, Artificial Sequence
  Synthetic
REKEELIKLIRDILEKLREHSRTIVELLETILRVVREHSKRIEKLLRELLDILRRQTLRDEELRKMLEDVERDIRESLKRLEELLRDIKRRIDESLRELEERLKELEKRIEELARRANKDITTAKRLLDVLKTLLKLNKESIERLLKVLEKLLKDDAESIKRLLDVIRELLKELKDVEEKRRPEKEVEDLLRKAVEDIEKLIRENEKLLEDVLRTIRKLIRENEELLRDIVEKIKRLADEARK

SEQ ID NO: 13279 - protein, 243 aa, Artificial Sequence; identical to SEQ ID NO: 13278
  Synthetic

SEQ ID NO: 13280 - protein, 247 aa, Artificial Sequence
  Synthetic
SEEEEVKKVVDEIKKVLDELRKANEDSARRLREVLEELRKRNEESKKEVKDLLEELKRVKRDEELRRVAETLLDVNRRNLEINVKVLRELIRISEDNLRINDEVAKRILDLVRELLKELEKAGLSREEIEKRLRDLEKKVKELKERATKLHKELDDALKETKKRVKKMHDDVRKKVKELRELSKDKDTDTKVKELIEIVDELLEIDDRILEEIERTVRKVIDLNRKVLEDIEELVKEAIKVLEEIAK

SEQ ID NO: 13281 - protein, 247 aa, Artificial Sequence; identical to SEQ ID NO: 13280
  Synthetic

SEQ ID NO: 13282 - protein, 233 aa, Artificial Sequence
  Synthetic
DEEEELRELKERIERTIEKLKEDTKKLKKELEDRIRELKRKTKELLDDMKRLIKEVKDKGDRDEALEELAKVSEDNLRINDEVLEELVELAKRLLKLNVDVLDELRRLVEEILKARKDGKDRSDLERVVKELREILDKLRKDNERVVKRLKEVLDELRRRNEESVRRLEEILRDRNLNEDIIRLVRDLIRLNREHLRDLEEAVREIIKLLREHLERLERVVDRMIRELRKAAK

SEQ ID NO: 13283 - protein, 233 aa, Artificial Sequence; identical to SEQ ID NO: 13282
  Synthetic

SEQ ID NO: 13284 - protein, 241 aa, Artificial Sequence
  Synthetic
SEEEELDKLRRELEELAKESTREVKELLRELREMLERHKKRLKEIKDKLDEDIKREDSKKDMVEEAVKVLRDILRRHKEVVEELAKVLEKIAEILERLHRRNLKLNREILKRLRDDPRGERLREELDRLVRRLEESNDEIRKALEDLVRELRELLKRIEDDHRELARRLEELLKRIIDRDGRTDELERLKDLLRTLIKKLEDLLENLRRLVERVIESLRRLVEKDEEINKRTIKELRRAIE

SEQ ID NO: 13285 - protein, 241 aa, Artificial Sequence; identical to SEQ ID NO: 13284
  Synthetic

SEQ ID NO: 13286 - protein, 243 aa, Artificial Sequence
  Synthetic
DEERIVDKILKVIRESAEALRKIVEDVLRVLEELMRRHKKNVEELDTIVEDLLRKVRERVDKDELERLKREKEKDRERVREIVDKYRKVLEELKERLERVLEDYRRKLKEVEKKVKEIRDRKDEKDEKTVVDEIRKLVEELLTLDRKVLEDLRRLAEEALRKDREVSELLRDLLRRIEEKLTSTRVEEEVLREARRRIREVERHNKKVHDDARKRLRDLVEELKRLHRELEEKLRRIIEEIDR

SEQ ID NO: 13287 - protein, 243 aa, Artificial Sequence; identical to SEQ ID NO: 13286
  Synthetic

SEQ ID NO: 13288 - protein, 242 aa, Artificial Sequence
  Synthetic
SEDEKVRKLLRDLAEEIKRLLETYDRKLKEIAKRIEDTLREYRERLEELKRRLEELVRKKNKDMTVIEEIDKLVRETLRRLEEIIDRILKLVKENAKLLEDIARRILDLIKKLLEILEEGRDRKEVRKAVEDVLRDVEKKLKDLLKHTEDSVTRVERLLKELKDRTKKILDDIKRRLDEEAKVEELVREIRRTLETILRLNEELLKRIRDVLREIIELNREVIERLREILERLADLIRRRAE

SEQ ID NO: 13289 - protein, 242 aa, Artificial Sequence; identical to SEQ ID NO: 13288
  Synthetic

SEQ ID NO: 13290 - protein, 245 aa, Artificial Sequence
  Synthetic
SELEKLARLLEEILELLRELHRKTAEALKEILELLDRHLDDLRRAVKEILEDLDKDLEDERRRELEEKVERVKETLKELLERLRKRNEDVKRELERILRENEKRLEDVKKTLEDVLRRLADLVRRGKGEEELKRVLEELLKLVKEVLDVNRRSVERLLELARRLIEENEKVLRELLELVRRVLEELLRDDDKAKKVREKLEELLRRLKEKNDDLRRKLERLARELEKLHEEVKKRLKELEDEARR

SEQ ID NO: 13291 - protein, 245 aa, Artificial Sequence; identical to SEQ ID NO: 13290
  Synthetic

SEQ ID NO: 13292 - protein, 245 aa, Artificial Sequence
  Synthetic
RELEKLAEVLERIVRALETHLKLIADVLREILRLLDEHLKIIKKVVRDILRELDEVLRRRDDETLERTLERMKRRLEEVLDRLEKENERVKKELRERLERLARENEEVIERLKKLLDELRKARENGKDESVLRRVLEEVLRLVKELIDRNREVLEELLKLAETLLRINTDVLRKLLELVEEILRRLVDDSDTLEKLRRRLEDRRRKLKEANDRVREVLDRLRKELEEIDKRLEDVLKKLREDLER

SEQ ID NO: 13293 - protein, 245 aa, Artificial Sequence; identical to SEQ ID NO: 13292
  Synthetic

SEQ ID NO: 13294 - protein, 241 aa, Artificial Sequence
  Synthetic
SKKELLEEVVRRAIELLKRHLEKLKRILEEIVRLLEEHLEKVERVLEAILRLLDDLLRRVTDERLIRTLEDVKRRLREILERLADENRKAIKRLRDLLDKLEKRNKEAIERLEEILEELKRVRRDEELLRVLETLLKIIEDILRENTKVLEDLLRLVEEILERNLRVVEELLRLAREILTEIVTDKDKLKEIEDELRRLLEELRRLDKKIKDRLRELKKDLDEANRRIKETLKKLLREVEK

SEQ ID NO: 13295 - protein, 241 aa, Artificial Sequence; identical to SEQ ID NO: 13294
  Synthetic

SEQ ID NO: 13296 - protein, 238 aa, Artificial Sequence
  Synthetic
SDLEELEKLIRRLLKINEDLIRIIEDLIRKSLTLLKRIVDLIRELIREIEEIIRRTNIPKELVDEAREKIKRILDEVERLLRELKKRHREILEELRKNLERVRRELKKILDRLRDLKRKNAREEEIRKLIEELLKVHKESLDSIRRLIEKLLRVHETALRRLAELIRRLLEVLKEVLDKVPVSEEIRKRVRDLEEKVKKLLRDLEEESRRVAEKVEEDLKRVEEESRRTAREVEEKER

SEQ ID NO: 13297 - protein, 238 aa, Artificial Sequence; identical to SEQ ID NO: 13296
  Synthetic

SEQ ID NO: 13298 - protein, 244 aa, Artificial Sequence
  Synthetic
SKEERADELLKDLERKVDKLRREHEELLKELKRKVDELRKEHKKLLDTLREEVRRIEEKVKEEEELRKVIRELLELLERNVKKNIDVIETLLRLLEDLVRVNVKVLKEIVDELKKIVEAIKRGEDRSEVDRAIKRLEDILEKLARENKRVMDELRKLLRTLREENKRSIRALEELLERLRRRVKSEDVLREITRLLEKAKRIIEESLREITELVKEIEKIIKESLDAARRLLEEIKKILEELAR

SEQ ID NO: 13299 - protein, 244 aa, Artificial Sequence; identical to SEQ ID NO: 13298
  Synthetic

SEQ ID NO: 13300 - protein, 241 aa, Artificial Sequence
  Synthetic
SIEELARKLVKENRRLATEANKILKDIVKTNRDSIRKVREILKELVERLRDLIRKVRRDGDDDERKLEEIVRELEKRLEEIKRKLDKVVKESEDLIKEIEDKIRELDKRSEDKLREIEERLKDSGRESVEKVLTELLKVHEDHLRELIKVLDELLRLNDESVRKLKELVEELLRVAEDVVRKIKVDEDLKRELERAKRELERLLRELDEEHERMKKKVKDEIRRLKKESEEVKKEVKDTED

SEQ ID NO: 13301 - protein, 241 aa, Artificial Sequence; identical to SEQ ID NO: 13300
  Synthetic

SEQ ID NO: 13302 - protein, 239 aa, Artificial Sequence
  Synthetic
DEEEITRKLEETIRRLEEEIDKIIKDLLRMLEENNKEIKKVIEKVLETSRRILSALARNVSEEELDRILKEYKELLDRLRERSEELKKEDERLVRDIRRTLKELLDRLKELVDRLIEERGRTKLVELIDKLLKVLEEALREIKRVIDELNTVNRDANRRILEVLDKNLELVKRIIDLAKERRTEEVLREAEKRIRDSAEEVKRILEEHKERLRELVKKLERVKETVRKKIEELREEAKR

SEQ ID NO: 13303 - protein, 239 aa, Artificial Sequence; identical to SEQ ID NO: 13302
  Synthetic

SEQ ID NO: 13304 - protein, 232 aa, Artificial Sequence
  Synthetic
SELEKDLKDAEEIIKELEEINKRLLEEIRRIVERITKINRDLLETVKRLIEELIKEDSVDEKVVREIEEELRRIKEESKKVEKDIRELLRRITKKSEEVAKRLRELLEELRRANKPKDDLLREILEVLETALRMLEESLKELRRVLEELLKASKRTLEKVKEVLKRLLEKARKGVDEERLKEIEERIRRTEEDVKRKHDDVRRELDEEDDRYKRELDKVRKKLKEKADRIRD

SEQ ID NO: 13305 - protein, 232 aa, Artificial Sequence; identical to SEQ ID NO: 13304
  Synthetic

SEQ ID NO: 13306 - protein, 232 aa, Artificial Sequence
  Synthetic
SKLEDLLRKVEEIIKEIERINEELLKRVAEIVETLLRENKKLLEEIKEILKRLIEDGSVDEEVVRKLEREVTEIEKKSKKVADDIRRKLRKLIEESREVVRDIKRKLEELKRANKPKDDLLRDILRVIKRLLERSAEIVKRVEDVLEELLKLLKETLDELLEVLKRVLDEVRKNVDERKLDKIRKDLERVVREYEEKLKEVRKRLRELVERVKEKHKRIEEELRKTAKEVRD

SEQ ID NO: 13307 - protein, 232 aa, Artificial Sequence; identical to SEQ ID NO: 13306
  Synthetic

SEQ ID NO: 13308 - protein, 242 aa, Artificial Sequence
  Synthetic
SSKELVEKLKELIKDHLRVADEVIKKLEELIRRHLRKVEEIARRLEELIRELADELRRAGIDEKELDKIRKEIEKVLRELKRLLEELRRDHERVLKELEREVKRLRDDHRRILKELDDLLRRGLDKKELLERVRELAERLNKLVEDILRRVEELLRELSKKVKELLKRVERLLREILKLIRDAGGDRRRLDRLEEKVEKDLRKLARELEDVNRRLEEELRRLEKRSEDLNRRIREEIKKDAK

SEQ ID NO: 13309 - protein, 242 aa, Artificial Sequence; identical to SEQ ID NO: 13308
  Synthetic

SEQ ID NO: 13310 - protein, 238 aa, Artificial Sequence
  Synthetic
KDDEILRKLLEILERLLKLSEEVLRELLRLLEELLRLSKESLKRLSRLLEEALKTLVEEEGREDETLERLERELRRVERKYKEDLDDILRKAKRLLEEAERLHREIRDRLRKAAEKKDEGDRDELIRRIIRLVRELTKINDELLKRVEDILRELAKLNEELIRTIKELLDRLVEKLVRRERLKAVVDRIEKAIKKVTEDSRRLVKRIETELRELVKRSKDLAREVEKRLKEVVEEAKR

SEQ ID NO: 13311 - protein, 238 aa, Artificial Sequence; identical to SEQ ID NO: 13310
  Synthetic

SEQ ID NO: 13312 - protein, 242 aa, Artificial Sequence
  Synthetic
SDLERILDKVTKLAEDAKKLAKKSVDLHRDNIRRLKTTLKRILESLRKAIKRLKDALRRGPRSERVDTLIRRIDKLIKELEDEVREIERRIDELSRRLEEKYKEVIKRIDKLVKDLRDLARRGVDRKDLVREILRILREIIETLRRLDEEVLKVNEEILDLIEELVRSILKVLEEILRLLVEETGPSEELEELKRDLDRLFEKIRTDLKRLRDTNRKLFDDLRKEHEAVEDKVRRVAEELTK

SEQ ID NO: 13313 - protein, 242 aa, Artificial Sequence; identical to SEQ ID NO: 13312
  Synthetic

SEQ ID NO: 13314 - protein, 232 aa, Artificial Sequence
  Synthetic
SEEDLVREVLRAIKRILELLTTLSKENLEVVKRIIEDLERVARENLRVIEEIIKKINVDEEMKKELDKELKRLEDEHRKAIRELEELLEEHKRRLEEIRRRVDKELEDIKRANLPIEDLLKVIDDVVRKLLRLVKEDLESLRRIVRKLEELLKKNLKLLRDVLRKLEDIARKKNVDERIIEEIRRTATEVLKRNEAVVKKIRELIKRVTERNRKVLEEIKELVKRIKDELRR

SEQ ID NO: 13315 - protein, 232 aa, Artificial Sequence; identical to SEQ ID NO: 13314
  Synthetic

SEQ ID NO: 13316 - protein, 237 aa, Artificial Sequence
  Synthetic
DKEREIDDIAEKLRRKYKKLREDLDRIEEELRERYERLKRKLDELARRLTKKARDENSDKKAVEELEKMIKELLDRLRKLIEDNLRVVEEIIKLIRELIDRDVEVVEELLDILKKVRTEEMVERIERRIEELLKETERLLKEVLDRAKKLHRDSEELVERVERRIKELTDEIKRLIEENKVDERLEELLKEVVETLRRLLEELKRLSEEVLKKAKEVIDRIRRLSEEVVKSLRDAAK

SEQ ID NO: 13317 - protein, 237 aa, Artificial Sequence; identical to SEQ ID NO: 13316
  Synthetic

SEQ ID NO: 13318 - protein, 242 aa, Artificial Sequence
  Synthetic
SEEEELDKLLKEYERVVREIEEKLDRVKRDIERLVEEITRDLRRVLEEYRKVVEELAKDEGDTSEILDTDMKIVEDLLRLLKEILDKILKLIEDALRVLKEVLKRDTDIVRRIIEILRRGVSEKDLKEILDRWEEENKKLLEEIKKILDKVRDDVRKLVEEVRKALEDWKRTLEDLLRKEGQESDTARRIERLSREVIKKLEKALKELEDLVREVLRRLKEAVEEIHKLSRDVIKMLTDATR

SEQ ID NO: 13319 - protein, 242 aa, Artificial Sequence; identical to SEQ ID NO: 13318
  Synthetic

SEQ ID NO: 13320 - protein, 246 aa, Artificial Sequence
  Synthetic
DDEERLKKVKEEIEEKAKRLKEDLERALKRYEDIIKKLEDDNRKVLERIRRKVEELKKNRVTSKDIEKALREIIEEIKRLNRENVKEIRRLNEEVKELLDRILRALEEIIREITDLLDKSVKDEEKLRKIKEKLEKVLREIEKDVRDLKRKHDELLKRVDDISRKIEEDLDRVAEKIRRILSKPVDDELIRKALEELLRIAEEILRRDLRLLEENRRVVKESLDVLAELLERLLELLERILREVRK

SEQ ID NO: 13321 - protein, 246 aa, Artificial Sequence; identical to SEQ ID NO: 13320
  Synthetic

SEQ ID NO: 13322 - protein, 234 aa, Artificial Sequence
  Synthetic
SERDVLRELLERIKKLLETLIRIVEELVRRSEETIKRLAELNRRLIEEIRRIVEEVKKDVEEEILRDVERLLKELADETEKILREVKKRLDDNLKRLEEIVRDVERLLKELKEEVDRGDKSKEELVREILKVAEEILRKIEELVKHHLDLNRDILRLFTESAEKLEEILREVLRKLRLDEEVKKRVEELRREYRETLKRLRDESEKIAEELKRLLDELRRRLEELARELRERTK

SEQ ID NO: 13323 - protein, 234 aa, Artificial Sequence; identical to SEQ ID NO: 13322
  Synthetic

SEQ ID NO: 13324 - protein, 235 aa, Artificial Sequence
  Synthetic
TEEEIIKEIVKLLRDLARLHEEVDRTNKRLLDELVRLHREVDERLTRLAEDLIRLAEKGASDDEIRELLKRIADELERLKKELEEINKRHRDEVERLKEELRRLNEEIKRRVEELKKDLREEAVRILEEILEMLRRISEKNLRVNDKIHETIERISRTNLKVLDDILRALEELAKAKLDRKDLRKVVEELRRRIEELNRRHDKLAEDLRREIEELNKEHKRMLRELEKKIEDDRR

SEQ ID NO: 13325 - protein, 235 aa, Artificial Sequence; identical to SEQ ID NO: 13324
  Synthetic

SEQ ID NO: 13326 - protein, 240 aa, Artificial Sequence
  Synthetic
DAEEILKEIHEIDKRTIDEIRKILKKLLEADKKSIDDIRRILKKLLEIVKRLIDLLRRVRRDEEVKEVVKEVERRLRELREEVKRVVKDSEDKVKRLREDMDRVVEESERLARELREKLKKKRVPEDVLRLVEEIIKLNREVLKEVRELLEDIVRVNREVLREARELLEELARTLRKLLRDRSDDKTLKKILDELRRKVKETDDRLRKLHEDLKRKVKELIDRLERLNEDIARLLKETRD

SEQ ID NO: 13327 - protein, 240 aa, Artificial Sequence; identical to SEQ ID NO: 13326
  Synthetic

SEQ ID NO: 13328 - protein, 236 aa, Artificial Sequence
  Synthetic
KTEELLRELIKVLKETLDRLKRVLEKLAETNDKSLKELLKLLEELLKAIRDVLRRILDDKDVMRDVERRLREILERLREEIDRYREELKRLLDEVKKTLDEYEKRVREVLEEIKKRGLTDELIRKLAKENEELVREIERIIKENRDANEELLRRALEILKRLLDLLKRVLEEVVARRGRRVDEVVEELEKVARELADKLRRVLKESEDVVKRVKDELREVLDRSKKVLEELKKKRK

SEQ ID NO: 13329 - protein, 236 aa, Artificial Sequence; identical to SEQ ID NO: 13328
  Synthetic

SEQ ID NO: 13330 - protein, 241 aa, Artificial Sequence
  Synthetic
SKEELVKEIDELNKRVNDLLEELLRKSEKLHKEILELLERLLREIIKLLRRILEIVERRLEDETLKRVLEKLEETLRRLKKKVDEELKRLEDENRRLKEEMDRLLRKSREELERLREKVVRDRGREDEVLRRLLELHTEDLKHAREVLDEVLRLNKKALDLIRRILTEVLKLIKELLKLIEAGADEDELRRLLEDIERKIERLLRELKKESEEIRKRIRELLEDNRDKSRKIKKAIEELKK

SEQ ID NO: 13331 - protein, 241 aa, Artificial Sequence; identical to SEQ ID NO: 13330
  Synthetic

SEQ ID NO: 13332 - protein, 235 aa, Artificial Sequence
  Synthetic
KLEDAARIAAKAAEEWAEAHKRAAKINAEASEEWAKAHREAAKIAAEAAKRAADEARGDKDEDAKRAEDLARRAIEILEESAKRAKDAAEDDKRIAKESAERAERLARKAKELLKDLAKKKASADDAARLAKRVAEEAKRLDKEAADLSRDSARRAKELDKRALKLVRDAAREAKKAVDDEDALRVIEKAAEDAERAAKESLDVAERALRESEKAAKESLEVLERALRDAKRAAD

SEQ ID NO: 13333 - protein, 235 aa, Artificial Sequence; identical to SEQ ID NO: 13332
  Synthetic

SEQ ID NO: 13334 - protein, 242 aa, Artificial Sequence
  Synthetic
SALETAAKLAKEAADRWLEASKRAAELAKDAADKWLDASRRAAELAKKAAKEALDADKEDALERAARSLEEAAKEAIKLDEEAARRLAEAAKTAIKLDEDAARDLKRAADEAKRRLTEDRDAAREAEKLAKRAADAAKRHTDELRKLAERALRASKEHTEDLKKLADDALKAAEELKRLDDRDTDLKRRAAKAAEDIKKAADELLKKSEDAAREIKEAADKLLEDSKRAAEEIKRAADEITR

SEQ ID NO: 13335 - protein, 242 aa, Artificial Sequence; identical to SEQ ID NO: 13334
  Synthetic

SEQ ID NO: 13336 - protein, 238 aa, Artificial Sequence
  Synthetic
DEAEKLAKEAREAIKRYADASEKIAKEAREAIKKYLEASKRIAKELREALKELARRLTDRRALEAAKKAAKVVDDAAKKNEDAARRAAEVIDKAAEDNRRAAEEAARVIDEAADRARRISDKDTAAEVAARAAREAARIIEEASRISAEAAEEAAKILEDASRIAAEAAKRAADIAREALRDKDAVREADEAAERAREKLERLSREAKKAAKDAKDKLKRLSDEAKKVARRLIEELKR

SEQ ID NO: 13337 - protein, 238 aa, Artificial Sequence; identical to SEQ ID NO: 13336
  Synthetic

SEQ ID NO: 13338 - protein, 232 aa, Artificial Sequence
  Synthetic
SKDEKAIEALKRAADETRKAAEKSADAARRAAEKSEKAAREAAEALKRAVEEAARALGEENEAAREAKKAAEEAAKTIKEALERSKKAAKELIEENRKIAKRSERAARELARLLREKKEDSKEIVKKAEKAAKELEELWRRTSEEARRAAEELEKIWRELLKRLRDAAREAARRGVPEAVLRAAEKAIKAAEEAARANKKAADEAIRANEEAAEANKRAADKAIKAIRDAAR

SEQ ID NO: 13339 - protein, 232 aa, Artificial Sequence; identical to SEQ ID NO: 13338
  Synthetic

SEQ ID NO: 13340 - protein, 233 aa, Artificial Sequence
  Synthetic
DREDAARRVEKAAREIAEKNKKAARDIKELAKEAIKRTKEAAERVKRAAKRIAEAAEEGADEKTLLEEAKELAERAKRASEDLARKWEKIARDALRALEESARDVRRLAKEAKDALRRDGGIREAAEAIDRAVRKAEKTHKEAAEAIKRALEDARKANEDAARAIDDALRKLAEARDKDAVKRALEELARAAEEAARADAEAAKKLAEAAERAARANIKALRDLAKAAKDAAR

SEQ ID NO: 13341 - protein, 233 aa, Artificial Sequence; identical to SEQ ID NO: 13340
  Synthetic

SEQ ID NO: 13342 - protein, 245 aa, Artificial Sequence
  Synthetic
REEEAAREAAEAARRAAEIAIKANEEAARAAKRAAEISIKASEDAARAAEEAAKEAARSNDKNERAKKAADEVKREAERLAKENRDIARRVEEEARRILDESRRIAEEVKRRAEEILKLLRNGEPLEELAKRLIEILKRALEEDHRLARRAIDILRRALERNARLAREAIEILKKALEDAAREAQDEDALRRAKKAIEDAIKVLKEALDKSAKAIEEAIRVAKEANERSAKAIKDAIEVAERAAR

SEQ ID NO: 13343 - protein, 245 aa, Artificial Sequence; identical to SEQ ID NO: 13342
  Synthetic

SEQ ID NO: 13344 - protein, 243 aa, Artificial Sequence
  Synthetic
SEAETLVERLKRLSERDERAARRLVEELKRLAEEDKRAAEELARRLEELARRAEDVARANKDRDEAKKVVEDLEKEAEEIIRDYRRLLEELDREAEKVIEDYRRILDKLRRDAERVIEDAKRRLKDLEEAARAIKLAREAAKRAIDASKESADAAERAAKEAIKASKRSAELAEEAAREAIKALKDAAEEAAKRLRRAAEEALKINKRANEELERAAREALDLNRRANEDLEKAAEDALRTAK

SEQ ID NO: 13345 - protein, 243 aa, Artificial Sequence; identical to SEQ ID NO: 13344
  Synthetic

SEQ ID NO: 13346 - protein, 243 aa, Artificial Sequence
  Synthetic
REAEELVKRLKELAEKDRRAAKRLVEEAEKIIRRARELSKKTVKKLEDLIERAKRLADANKDRDEAKKAVEDLDKEAKEIADEHRKATDKIERDARELIKKYREILKRLEEEAKRVIDDARRRLKELEEAARAIELAEKAAREAIEASRRSAELLREAAEKAIRADREAAKLAEKAAKDLIRALKDAAEDAARRAEEAARRALKINEDAAREAERAAREALKINDEANKRLEEAARRALETAR

SEQ ID NO: 13347 - protein, 243 aa, Artificial Sequence; identical to SEQ ID NO: 13346
  Synthetic

SEQ ID NO: 13348 - protein, 240 aa, Artificial Sequence
  Synthetic
KELEEILKTVEDLVRRAKELLRRIHEINRESIEDIRRLLKEIHDTNKRSIEKVDELLKRKTSEETLERLVEEHKKLLEDLLRRLRRLVEEHEKKLDKLRKTIEKLVREVEELLRRAAERVDDERARRVLKEVLRVIREVVEILKRALELSLEVLRDVVRRIEEALRLSLEVLKRVVEVAKNKRDETEIRKILKESNDRLTEVIKEVEKVLRESDELLRDALKKIVDVLREVLKRLEDTVR

SEQ ID NO: 13349 - protein, 240 aa, Artificial Sequence; identical to SEQ ID NO: 13348
  Synthetic

SEQ ID NO: 13350 - protein, 247 aa, Artificial Sequence
  Synthetic
EKEKEIKDAEDEARKAAEESKRKIDKADEDAKKALEELERSIREADKDAKRALDEERREDRRAEEAIKKLRDLARRAKKIHRDNLEKIDEIARRLKKLIKEYIEKSEKIARELKKLIEDAARKERGSDALRLAKEALDLVDEAARRNEKAAREALETVDRAARRAKEAIKKSAEDVDRAAREAEKLARERREDAARIAAKAAKDALKANEEAARILARAAKEALKILEDATRILKEAADRALDILRK

SEQ ID NO: 13351 - protein, 247 aa, Artificial Sequence; identical to SEQ ID NO: 13350
  Synthetic

SEQ ID NO: 13352 - protein, 246 aa, Artificial Sequence
  Synthetic
SEVEEIEKVARRNLELIKRLLEKAERVAKKSLDLIKKAADDARRIAEETLKLIREAAEAGVEEKAAREALRAIEEAARRAEEAAKEALKANKEAADRAREAAKRALDATRKALEEARRLAKDRAEEAAEALARALKRTIEAAKEAVEALARAAKRSADAADRAVEALARALEEAIRAAKEASRTKEAEDLLREAAKRAEELIRRAEEAAKRLKEEWERLIRELKRALEEYAKEAKKLIKELEDRTR

SEQ ID NO: 13353 - protein, 246 aa, Artificial Sequence; identical to SEQ ID NO: 13352
  Synthetic

SEQ ID NO: 13354 - protein, 245 aa, Artificial Sequence
  Synthetic
SKREEAEKAARRAEKLAREAREAARRSLERAKDLARRHEKLSRELLEEAKRLAEEVKETAKKPTDERTAEELARKIIEALKKANEENRRSAEELIEALERNLREIEKLIRDAIEALRRAVEEARGEGKRKADELRRAAREAIEALKRALEEARKAHEEAIRAIEEALKKDSKAAKEAIDAVDEAAKRKAIDEALKALKRAADLSADANRRALEALEKAARLSARAAEEALEALRRAAELARRAAE

SEQ ID NO: 13355 - protein, 245 aa, Artificial Sequence; identical to SEQ ID NO: 13354
  Synthetic

SEQ ID NO: 13356 - protein, 237 aa, Artificial Sequence
  Synthetic
SAEDIIRESEKADKDALDEWRRLIKKLEDLIEELLKENERLIRKLEELIKKALEADKEERGSEEAKRLLEKLARAIEELEKEARDLNRRAAEAIKRLADEAKKIVEEYKKIIEEIKKKASDARDLARALDRSAEAHERAAEIAARAAKRALEAHSEAIKIAIRAAKEALDAARAAKRGEARGEEAAERAKRAADEAKKASDEAAKEAREAAERALRAAEEAAKEAEKANRDALRSAK

SEQ ID NO: 13357 - protein, 237 aa, Artificial Sequence; identical to SEQ ID NO: 13356
  Synthetic

SEQ ID NO: 13358 - protein, 251 aa, Artificial Sequence
  Synthetic
SEDEELAKEAKRAVEEAKKRLEDLLRRAEEAHRRAKKELDELARRAEEAHKKAKRDIDRDAKDDEAARALKEALDRHLEAVKKAAKALKEALDRNLDAVREAVEAAKKALDDALKAIEDASRRDRKEDAKRAAEEAAKALEEAAERAERAAEKATRALEEALKRAREASKEAAKALKEALKRARESNVEEEIVRRADELAKRAEELNRRLAEEADKIAKKAKDLNERLLREARDIARRAKELIKRLLDARR

SEQ ID NO: 13359 - protein, 251 aa, Artificial Sequence; identical to SEQ ID NO: 13358
  Synthetic

SEQ ID NO: 13360 - protein, 241 aa, Artificial Sequence
  Synthetic
SKAERVVDEARKTDEEVLREAEKVNRKVEEVIRRVLKRNEDVNREIARAIERVLRGGVEEKLVRELEKLNRDHHEKSKENIRNLEEVNKKHHEELKELADRNRRLNDKVLEDAKRDRREEEVRKLLEELKERSRDSIRKSRELLDRLREYLKRDIDRSEKVLRELEKRLRELIEKVRRKVDKEEVLRTAEEVVREALRLVTDAHRVNEEVIRDVLRLVERVHRVYEEVNRRNDELLKELTD

SEQ ID NO: 13361 - protein, 241 aa, Artificial Sequence; identical to SEQ ID NO: 13360
  Synthetic

SEQ ID NO: 13362 - protein, 232 aa, Artificial Sequence
  Synthetic
KDEERLREILKKYKEDSERILREVREILERYRRAIEEILKRLEDILRKLEEDVRRELKDNEAVKRVVEKALEAVKEVLKAIEDAVRESLKAAEDVLREIKRVSDAIIRVLEALARGERDVDEVLETARRLTEEVEKVVREVLERSERALRKVRTVVKRVLDIIRELLAEVKRAVPDLTKALKTVRDVLELLRKILEEVRRLNEKLLEELKRLLDEVVEKNERLIKLLEKDAE

SEQ ID NO: 13363 - protein, 232 aa, Artificial Sequence; identical to SEQ ID NO: 13362
  Synthetic

SEQ ID NO: 13364 - protein, 240 aa, Artificial Sequence
  Synthetic
DELETLEDVLRKIEDLLRRWLEKLEETLKRIIRLLETSLKLLEESIRRILRILERDVDDDKVVRKLEEVLRRALKEHRRVLEELLKVLRDVLEENRKVVEDLKRVLEEVIEKIARVKRREELLRVVEELLERVREVIKELLRVNDRVLREVEEVVKKLLKVNDELAKRVRTVVKELVDSREDKKVRDVLREIEELLERHKRLLEKLARELRELAKRHREEIKKVLETLKKLAEELTRRVR

SEQ ID NO: 13365 - protein, 240 aa, Artificial Sequence; identical to SEQ ID NO: 13364
  Synthetic

SEQ ID NO: 13366 - protein, 235 aa, Artificial Sequence
  Synthetic
SEKEELRRELEEHAKRSRDTVKRLEDENRRVLESLKRKVDTLRRINEETLREIRRLAREERLSKDVVRRVEEVVKESEDILRRILRRIKEIADESERILREVLKKSEEIIREVERVLREVDSEELLRRLREALKRNIEVLRELLELNKEVLDRLVEVIKELLERNERVLEKLVRETDSRDEKLKRDLEDLKRKHDELRKRLKEELDELRRKHEKIKEELDRHLKELEDKLREARR

SEQ ID NO: 13367 - protein, 235 aa, Artificial Sequence; identical to SEQ ID NO: 13366
  Synthetic

SEQ ID NO: 13368 - protein, 235 aa, Artificial Sequence
  Synthetic
SEKEKLTEILRRHERESERVVKELDEENKRHLKKSREIADTLRKLNEETLERIRELVKRARISEELVEKVERVAEKSKRILDEAVKRSEDIARESEEILRRARERSERIIREIRRVLREVDSDDLLRLLEELLRRNVEVLEDLLRRNLEVLRKNVRVLRELLKKNERVLEELVKTLNDTDETLKRELERLKEEHERLKEELDRHLKALEEKHREIRREIDEHLKELKRRLDEERR

SEQ ID NO: 13369 - protein, 235 aa, Artificial Sequence; identical to SEQ ID NO: 13368
  Synthetic

SEQ ID NO: 13370 - protein, 252 aa, Artificial Sequence
  Synthetic
SEKEKLIEDLRRILKETEERLKRVKERLRELLDEYRRRSEDKLRELKKELEEEEEKIRRSGLSEEAERAVRKLLKVLREVLDKLKKLNEDNLRVLEEVLRLLERLLDELLKVLRELLRELEKLAEDKQDKDEVLEDIKRRIAEVIDRAKKLLDKLRELIEESIKRVRTETDRLRKDIEKVLRDIAEDVKDDRLRKRIKETADRLREMLKRHRELLERSMELLRRALEEAKKVLDETEETARRLLKLAEDEER

SEQ ID NO: 13371 - protein, 252 aa, Artificial Sequence; identical to SEQ ID NO: 13370
  Synthetic

SEQ ID NO: 13372 - protein, 246 aa, Artificial Sequence
  Synthetic
KEIEETLKELEDLNREMVETNRRVLEETRRLNKETVDRVKATLDELRKMLKKLVDDVRKEPTSEELKRLLRELEELLRRVVRRVEELLKKSTDLLERAVKDSKDALRRSHEVLKEVAKRVKRAKDENLPREEVLRLLRELLERHAKVLKDIVRVSEKLLREHLKVLREIVEVLEELLERILKVILDTTGRDKKVEELEKALEEIKRRLKEVIDRYEDELRKLRKEYKEKIDKYERKLEEIERRERT

SEQ ID NO: 13373 - protein, 246 aa, Artificial Sequence; identical to SEQ ID NO: 13372
  Synthetic

SEQ ID NO: 13374 - protein, 237 aa, Artificial Sequence
  Synthetic
SEEEDREREYEERHKKAEEDLRRAEEEYARELRREEERLKEEAKRLEKELRDARTKLDEDEIADKIAKALREIAELLKRLVKVIRDVLRENEKLLRDIAEVLRRISRENAKLLRDAREKQRAGEIVEALRESNKRILDALREVVKALKKTNEDVLRTVKEVVKRIEELLRRLASEGNDEKAKKALDEAVKRVKEDIKRLEDSVKTADDKDRKAIRRAEETVRTHIRTNEEAVRREEK

SEQ ID NO: 13375 - protein, 237 aa, Artificial Sequence; identical to SEQ ID NO: 13374
  Synthetic

SEQ ID NO: 13376 - protein, 235 aa, Artificial Sequence
  Synthetic
SELEETLKRLKETNKRLLKKVKELVDESLRLNEELLRRLREVIRKIKETIKEVLEEGVDEKDIRKAEEILDDVLRKLEKLVRDSVRVNETVLKEVEDIIRRSLTELDKVAERLKEAKSEKVVKDVLKEVIDRNEEIVEELLERIRRVLEDDLRIVKEILDILRKVLKEILKVLEEIVDEDERVDELRKRIRKTEEEIEDIKRRYEKRVRELKETLDRIVKELRDRYKKIREEIDT

SEQ ID NO: 13377 - protein, 235 aa, Artificial Sequence; identical to SEQ ID NO: 13376
  Synthetic

SEQ ID NO: 13378 - protein, 239 aa, Artificial Sequence
  Synthetic
DIEDVLKKVLEKNLRVLREVHEVNKRVLDEIVKLLRELHRVNKRVLEIILRLLEALRRGERDREEVLRELERVVKESKEVNKEVLKRLEDIVRESLREIERVLDETRKAIKEVEKVLRERRVEERVLEMLRRYADRSRDFADKDKKKNKETLDELRKLSEDDKRINDRLVETLRRIIAQGDTSDEDLKRIEDELRRTLEEHRKRLREVERELEKKVEEHERELRKYEEETKRLLREAER

SEQ ID NO: 13379 - protein, 239 aa, Artificial Sequence; identical to SEQ ID NO: 13378
  Synthetic

SEQ ID NO: 13380 - protein, 236 aa, Artificial Sequence
  Synthetic
REEERLRELITDYKRKLDDLKRRSEDLLREYEKTLEDIRRESERTKKELRESLKRDLDREGESEKVKVLKEVEDLLDKVNKRLLEIIKTNLDLLRRVNEELERVLKTNLDLIRKVLELARRGAPEKDVKRVADEVSERAEKLLRDVEKRNREVSKRLEDLLREIKERNDEVVERVKERTDDEKVKRELEKHTKLLKEILDTVRDLNRKHSEEIRRTVEEVRKANRRLLEELKETRK

SEQ ID NO: 13381 - protein, 236 aa, Artificial Sequence; identical to SEQ ID NO: 13380
  Synthetic

SEQ ID NO: 13382 - protein, 241 aa, Artificial Sequence
  Synthetic
SELEETLKKIKELAEISRKLADETRREIKKLIDDSRKLLEDTHRTNEEMVRRVETKAKDKDERIKEVLKRVAKEIKDSNDELRRRVEESAKRLREVLEELKEKIERSIKRLEDILDLLRRGEVREEEVVRELLKVLADNLRAIEEVLRKLLRILEDNLRVTEEVLRTNLRLLKKLLDELKLDEEKLREVRELLERYREDVRRLKKEYEELLREEDKKVKKKKEDYERILRKTKKELDERRK

SEQ ID NO: 13383 - protein, 241 aa, Artificial Sequence; identical to SEQ ID NO: 13382
  Synthetic

SEQ ID NO: 13384 - protein, 234 aa, Artificial Sequence
  Synthetic
SEDEKAAEDLKKLAEESIRELEKALRDAARLHEEALKRLKKALDEAARLAERAIEEARKGLDLRRVADEVAKAAEKAARAIEEVLREVLRASNEAAKAWKRVAKRNAEAAEEAARRRRDKTAEDLLREARKAAEDSKKEADDLNREAEELARRAREEAERLLREAEKAARDAKTKKLVGEELIKLIEDLLRLAAELAKKIAELAERHLRLLEEAARKHIELVERLIELAKRDTD

SEQ ID NO: 13385 - protein, 234 aa, Artificial Sequence; identical to SEQ ID NO: 13384
  Synthetic

SEQ ID NO: 13386 - protein, 234 aa, Artificial Sequence
  Synthetic
SEDEELEKLLEEAKKLIEESSRRLDELLEEDRRVVKRIEEEVEKLLKEVKEEIDKIKKEVRELEKIKRVLDALVDVARKIVEVTKELLRDNVRVAERIVEVIKDVNRKLVDVVDKLRKTKDKRELEEILRELERENRRVSKEVEDLLRELRKRNEDVLRRIEKLLRELKKEVDELLKDLGKVLEIVKEIIDRIRKLLKKTFDISDELLRKWEDLLRRNNDLSRRLLKEAEDKAR

SEQ ID NO: 13387 - protein, 234 aa, Artificial Sequence; identical to SEQ ID NO: 13386
  Synthetic

SEQ ID NO: 13388 - protein, 235 aa, Artificial Sequence
  Synthetic
SEKEDLARKLRKLVEELTREYEELVKKLERLIEEIEKVSEESVRKLEKLLREISEEVRKLGTDSRVLKRLLERLRRIIEEDHELNTELLKRLLDLLKEILDTSRELLKRLLDILREVVRDESVLRDLERTLREVLEENERAIEEAERVLRKVLEDSERAVRDARRVLKEVDKSPTKDELLRKLVELLVEVLRRLIRVNRELVKLLREVLERLLRILRESVKKLKRLIEKVIKDET

SEQ ID NO: 13389 - protein, 235 aa, Artificial Sequence; identical to SEQ ID NO: 13388
  Synthetic

SEQ ID NO: 13390 - protein, 242 aa, Artificial Sequence
  Synthetic
KEEEDLLERVKRVLDELIEIVDRNHELNRRVVETSARLVERLLEEVERALETLEREIPNRKLLDKAIKDLRDVLRRVKEKVKRSIEELKEVLEESRRVLEEVVRKLREVIDRVRRLVEKGVDLRDLIRELKRVLEEAVKLIERLVRLNTRAAEKDNESLRELVRAIKEALKRAVDMVRADGLDSRLVKKLDEIVKEVAKKLEDVVRRNEELWRKLVELNKESVRRLREIVERVARDLEETAR

SEQ ID NO: 13391 - protein, 242 aa, Artificial Sequence; identical to SEQ ID NO: 13390
  Synthetic

SEQ ID NO: 13392 - protein, 232 aa, Artificial Sequence
  Synthetic
RRTEEVIKKIAKLIDELIETLKKIVEDSAKLIKELIDLLEEIIKRSADLIRELEKVSKRGDRDRLKKLIDRMRRETERALEELRRVIEELKERTERALKTIEDLIREIEEAIRRELEDEDLAREILEVIRRILELLREDMELNLRALEEILRLLEEVIKLNKDAIDEILELLKKSEERRIAERIRELLRESKKLVRDVVEEAKRLLKENRDSTRKIIEDIRRLLRKIEDSTR

SEQ ID NO: 13393 - protein, 232 aa, Artificial Sequence; identical to SEQ ID NO: 13392
  Synthetic

SEQ ID NO: 13394 - protein, 242 aa, Artificial Sequence
  Synthetic
DKEDIIRRLARVLERHDEANREVVKEHDEVLEEHLDVHRRVVRSNIEVLRTLLELVEKLDSEDLKRVLDEVRKRLEKSLEELERRLRESDKKSETVIRKNEKAVRESAEALKDVIRKLKEARDDEKVKETAKKVRELLERLIELNRRWVEALRRLNERLNKLNRDAIELSRRLLKELEDLTREGVPEKDIRKVIEDIERLHRESMEEVRKLVEEIKRLNKEVLKRSEELVEEAKRLLKEVAD

SEQ ID NO: 13395 - protein, 242 aa, Artificial Sequence; identical to SEQ ID NO: 13394
  Synthetic

SEQ ID NO: 13396 - protein, 247 aa, Artificial Sequence
  Synthetic
DTKEVIEKLIRVLERAVKLLRELVDRDNRSLKKAVDLHREVVRKIIEVLEEAVRLLATVKEDEKLKRVLEEVVKELERVLKESEELVRTVIRDNREVVKDARELVREVERELKKVIDDARRRTDDEELRKLLEEIKKVLDDLRKLLDTNIKISEKVLRDWERLNRELAKILKDVIRKLEELARKMRDEEKLLREVERLVRELAKRLRESLKTVEDLVRELADTNRRSVKTVEDIVRDLERKAREVTR

SEQ ID NO: 13397 - protein, 247 aa, Artificial Sequence; identical to SEQ ID NO: 13396
  Synthetic

SEQ ID NO: 13398 - protein, 248 aa, Artificial Sequence
  Synthetic
SKRELLERVIREAERVLKEWEDLLRELTETSDRVIRDVERLLRELLRKAEEVIKDILRKSDDEELRKLLKRVRELLKELADILKRLVDEHRRLVEENIRIVRTAIELVKELLKRLADLLESGLPREDLTREVEKVLRELEEIVKKVKRDSERIVEDNRRLSEELRRLVEEILERLRRLVDDLIKKKDKDEDLKRVLERLTRVAEEILELLEEVLKKSNRSLEKAVEANAEALDRLIEVLRELLDDLRK

SEQ ID NO: 13399 - protein, 248 aa, Artificial Sequence; identical to SEQ ID NO: 13398
  Synthetic

SEQ ID NO: 13400 - protein, 248 aa, Artificial Sequence
  Synthetic
SKEELLKKVEDEARKVLEEWKEEVKRLIEESKRVLDDWRRLVDEVSKDIKRVIDEARKDSEDKDLEEVADRVRKLLEDNKRIVDEAIRRHEELLDENRKIVERVIELLEELLDEIAKLTRSGKPEEELIRRAEELVRRLAEIVERVIRESRRIVEDNRRISREVVERSKEIVDRLRKIVTELIKKKDKDEDLKRVLEKLIKVIEKIVRLNEEALRKSNESLERIVKLNEEALRELIRVIERLVELVRK

SEQ ID NO: 13401 - protein, 248 aa, Artificial Sequence; identical to SEQ ID NO: 13400
  Synthetic

SEQ ID NO: 13402 - protein, 230 aa, Artificial Sequence
  Synthetic
KEREEIDELVKELEKELRRLVRENEKLVEDNERTLKRLLEENKRLVEELVKRLRDGLDRDELKKVLDDALDANRKSVRRLEESAEEVLKTNRRSLERAIDLLRRALEEIADKVDKRDLLEEIERLIRELIRRLERVHEEIERLIRRSIEELRRIHEEVEKLIEDVKRVADRVDKDEVVEIVIRVLEEILRLSEEALRIHIRVTREVLRLSKELIDEIRKVLREIADRIRK

SEQ ID NO: 13403 - protein, 230 aa, Artificial Sequence; identical to SEQ ID NO: 13402
  Synthetic

SEQ ID NO: 13404 - protein, 245 aa, Artificial Sequence
  Synthetic
SKEELLKELLDRVRRVLTEIKKLLERLLRRSKEVIDDSERLVREVLKRVEDLAREIKAERSVDDRAVDRMLELVERWVELWKRVLELLEEISRRIVRLIERVLELLLKVVEEVLKRLTEVRTEKELKDVLDTVEELLKRVLDELRKVVEEIRELHREVLEANEEVMDRVEKLLKEVRDTLRRRLKDKDALDKLRRLIDELARLLREVHERDKELIRDHLREVEEIAKEIARLIKRLAEEIREITT

SEQ ID NO: 13405 - protein, 245 aa, Artificial Sequence; identical to SEQ ID NO: 13404
  Synthetic

SEQ ID NO: 13406 - protein, 245 aa, Artificial Sequence
  Synthetic
SERELAKRALERAKEAAEESKRLAKELLDRSRELAKRSKELADEVLKRAKKAAEEIKKKRSADDRAAEEALRAAAEWARLWKEVAELLLEASRRAAELWKEVAEEALRAAEEVARLLEEARTEEELKKAAEDAERLAREVLKANEDALREARRLHREVLEANDRAAEEARRLAEEVRRELDKRAEDKDAAREARKLLKDLLELAERAHKKDRDAIEEHLRLAEEASKRDKELLKELLDLIREIAR

SEQ ID NO: 13407 - protein, 245 aa, Artificial Sequence; identical to SEQ ID NO: 13406
  Synthetic

SEQ ID NO: 13408 - protein, 231 aa, Artificial Sequence
  Synthetic
SKEEEVEKVLRKWEEILRRLIEENKRANDKIRREYEELVKEIRRVLEEIKEVAERLRVSEEVKRILEKLIKLLEDILEYEKENVERLIELNERILRELKKSVEELKKLVTRVRRDKLPESEVRKLVEDVLRKNEELLKEAKKAWRDSIENLKRVLEEVKKLVKTVLREIEEKIDDKDVVRKLIEVIERLLRVAEEVIRRILKVNTELMRVDERSIRESLKAIREVLKVLDT

SEQ ID NO: 13409 - protein, 231 aa, Artificial Sequence; identical to SEQ ID NO: 13408
  Synthetic

SEQ ID NO: 13410 - protein, 245 aa, Artificial Sequence
  Synthetic
SKEELVDTVKKKLEEVLKKIDKLSRDVKEKLRRVIEELRKLSREVHETNREVARRLREEAALEEIVKLLEESAKRATKLLRDVVRRIKEVAKEASELLEELVREIARVLDEVVKLLAEAGVPEELVRDLERLVREAVRELERLVEEHKRLVEEAAKRLEKLVEEHKKISEDVARRLRELLEKISDEETVLRTLEKIIRDHNKAHKRVTDAVAKILEELIKLHDEVSRRLKDILRRLLELLDEVTR

SEQ ID NO: 13411 - protein, 245 aa, Artificial Sequence; identical to SEQ ID NO: 13410
  Synthetic

SEQ ID NO: 13412 - protein, 245 aa, Artificial Sequence
  Synthetic
RKEELVDTVKKDLERVIETVRKLSEDVKEKIRRVLEDIDRLSKEVHETNKRVVEELEDKKSLEEIVKLLEESAKRASRLLKELVRELKEVLKEASDLLREIVERVERVLKKIVDLLRESGTPEELVRTLEELVRRVVERLKKLVDDHEKLVKEIAEKLEKLVEEHERISRRVVEELRELLRKISDEETVLRELVKLIRDHNRMHEEVVRRLKKIIEEALKLHDEVSRRVAELLREVIELLDRVAK

SEQ ID NO: 13413 - protein, 245 aa, Artificial Sequence; identical to SEQ ID NO: 13412
  Synthetic

SEQ ID NO: 13414 - protein, 245 aa, Artificial Sequence
  Synthetic
DKEREVDEILRRVTKLLKELEKRSKEILDRVRELVREYKRKVEEILKRVEDLIRRLIKDKKEVEEIETVLKKILDVVRTIVELLKESLDEAVKVVEDISRVNRESLDRIRKVVEEIVEVIKKVRTKEELKEVIDRIAKKLDEVLKRNEEVIRRVARRLEEVHEKNRRAIEKAVRDLRKVLKELEERGVSLDELRKILKELEELLRTLNKELKEVVKELRELLKELHDRLREILEELKRLLEEIAR

SEQ ID NO: 13415 - protein, 245 aa, Artificial Sequence; identical to SEQ ID NO: 13414
  Synthetic

SEQ ID NO: 13416 - protein, 245 aa, Artificial Sequence
  Synthetic
DEDELIRKLLEDLKDIVRKILELIERDLRDIERVVRRIVKVIRDDLKKIKEVVDDIRRRVPRTEELERVIKRIEELLRTSEEELDRILKEIEELLRESRRRLEEVVKAVEELLRRVEEIVDKGRERKEDVIKLLREVVDDILRLVEEVVRTNLEIIKRILELIERVIRLNLKIIRDILRLLEETVDSELADRIRKLIEDLERHTKKVLEDVKRAITELRKNSKDILEEVRKLIDELRKRIKEVED

SEQ ID NO: 13417 - protein, 245 aa, Artificial Sequence; identical to SEQ ID NO: 13416
  Synthetic

SEQ ID NO: 13418 - protein, 232 aa, Artificial Sequence
  Synthetic
KAEEIAKIAVDAVRKIAELLRRASKINLDAIRKAAKLSKEASKINLDAIRKIAEEVKDAEEIKRDAERIAREDAEAAKRSAELAEEIAKRDEDLARRLEEEAKRLADEIRAEKATEEAAEKALRAIDELLKRAKRASEESARLAEEWIKEDKRLSEESAKLIEDLIRKAEKKNRVDRKALEKARKLAEDALRANKRANDEAKKLADEALKENRKALEDAKRLARKAAEDAKR

SEQ ID NO: 13419 - protein, 232 aa, Artificial Sequence; identical to SEQ ID NO: 13418
  Synthetic

SEQ ID NO: 13420 - protein, 246 aa, Artificial Sequence
  Synthetic
SEEELLRRIRELLKKALEDNKDVLREIEELLRKVTEDNDRVLEEIRKLLEEVDEVVKRAGVDEELLKLIEDILRTEKRVLEDWKRLVEETRKAVEDLLRELERLSREVVERVERLLDELRRRNDEDVVRKIAREVEKIVDTHRKVVDDIRRKVEEIVKKHEELLRDIERKVEEIVRRLKEILERVDKDELRRVVEKIEKVLRDVVRALRELVRINARVLEEILRLIEELVRRNAEVLKRILELVAT

SEQ ID NO: 13421 - protein, 246 aa, Artificial Sequence; identical to SEQ ID NO: 13420
  Synthetic

SEQ ID NO: 13422 - protein, 238 aa, Artificial Sequence
  Synthetic
SKEDELRKAEEDARRVVEEILDLNRESVEKSRRVAERVLRLNEDSVRKSRDVVRRIKEEVNTDDKLLDILEKVLRTNERLSERDLRLIKTILELNERLSERDRRLIKKILEDVRRLVELVRRGTREEELEELVRELIRRIEDILRESEELVRDTIKKIEDILKESEDLVRRTIEEIERKVDDRDVVRKLIEANEDHLRVNKEIVDRLIKANEEHLEVNRRAVEKLIEVLKRLLDVARK

SEQ ID NO: 13423 - protein, 238 aa, Artificial Sequence; identical to SEQ ID NO: 13422
  Synthetic

SEQ ID NO: 13424 - protein, 237 aa, Artificial Sequence
  Synthetic
SEKEDLVRTIEEVVKTIEELVERHERKIDEIVKRSRELVRTHVEKIEEIVRRVEELVRRGGSRDEELRRRILDLVEKLFKHVEEVLKTILKLSEELLKHVTEVLERIRDIIRRLAEKLRRNNVKRESLEKVLEKAKRVLDDVKKKLEDSADENRDVLRRVKEELERSLDKLRKILKSNSDLDTLAEEVKRVLKEHVDLVRKAARLDSETLKKHVDLVRTAAERVSEVMKELVELVRR

SEQ ID NO: 13425 - protein, 237 aa, Artificial Sequence; identical to SEQ ID NO: 13424
  Synthetic

SEQ ID NO: 13426 - protein, 237 aa, Artificial Sequence
  Synthetic
SEIEELVKDIERIVREIKKLIDDHVRKLEKIIEDIERDMRRHEETVREVVRKIEDEVRRGGSRAEEIKRRILEEIERLVEHVKDLLRRILELIERLAENIRRLLRRIEEIVTELVERLRRLNVKRESLEKVKKKAEDIIRRVKKELEDSLEELKDILRDAKRRLDESLKEIREILKSNSDLDSLAKKVSDVARKHLDLARRVIKLISEALKKHIRLVEKAMEDISRILEDLVRLVRK

SEQ ID NO: 13427 - protein, 237 aa, Artificial Sequence; identical to SEQ ID NO: 13426
  Synthetic

SEQ ID NO: 13428 - protein, 236 aa, Artificial Sequence
  Synthetic
SKLEDAVRRIEEILRHIVRSLEEVVKDIEKILRDHVRMLREVVKRIEDVLRRVVELLRRAGDQRELVRELEELVRELVERLRRIVKRNEDLVRDLLDKLRKIVKRNEKVARELVERLRRRGESKEEAVELLREALRLNKKSVEDIERLLKELLDLAEESVEEIERLLRDILKKIADVITDKDVLREVAERIRKVIERLKELLDRSRERAEDVIKKLRDLLKENERLIEEVRRRLEK

SEQ ID NO: 13429 - protein, 236 aa, Artificial Sequence; identical to SEQ ID NO: 13428
  Synthetic

SEQ ID NO: 13430 - protein, 228 aa, Artificial Sequence
  Synthetic
SREEAVADVIRRLEEILEKNLRLLEEIIRRLLRILEHNLRLNEKAVEIIEDLIRKLLRDEKVIREAKKTVEEILRESKRVLDEVKKKLEKILRDLERVHEKVMRDIREILKRNKGKERALETLRRVVEELVRVTEEVAERLKEVVKEVVEANRRVLEKLKKLIEELAEKVVKSRLADDLRRVVKKIVEDLEENLERIKDIIRRLVEELERSLEEIRRLIDRLVKEIRR

SEQ ID NO: 13431 - protein, 228 aa, Artificial Sequence; identical to SEQ ID NO: 13430
  Synthetic

SEQ ID NO: 13432 - protein, 234 aa, Artificial Sequence
  Synthetic
SEEEAAREAERLLEEAARVAERIVRDSERLLDEAAEVARKAVEDSKKLLEDALRAAREGQPRDAIREAAKELEKESKRLAEEIKDAARRLKEETDRLLEEAKRAAEELKKEADRLATEGAAAEDAARALKEAADLLVKVAEDLARANKEAADLLVEVAEKLNRANKEAAELLKKLADDREAAERVARRAERANEEALKEAEEVIKRAKEANKRALEEAKRVIDRADKALKEARK

SEQ ID NO: 13433 - protein, 234 aa, Artificial Sequence; identical to SEQ ID NO: 13432
  Synthetic

SEQ ID NO: 13434 - protein, 247 aa, Artificial Sequence
  Synthetic
RDRDVLRKVKREIEELVRRIEKVSRDALKEVKRLLDENRKIAEDVLRLIERLLRKIRDTRNDDRVVKETEEVLRDNHRLLEELIRRLIKVLEEWLRRHKKLLDEIRELLKEILRLVKESGVSEDLLRRLKRVIEELDKKLKESEEKLRRVVEKAKEDLKRVLEEHRKVLEDLKRALEEVREKLRERDREEVVEELLRMLKRVAEEMKRVHDDLSRAVEKVVRDVVRVDKELLDELRRILRRLEEVIT

SEQ ID NO: 13435 - protein, 247 aa, Artificial Sequence; identical to SEQ ID NO: 13434
  Synthetic

SEQ ID NO: 13436 - protein, 231 aa, Artificial Sequence
  Synthetic
SKDEELMRLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGADERVTEAIKKVLDTSEDLIRRVIKVNEDILREIAKLVEEVLREAERILTEIKKEVDREEIRRILEELKRIVDDVLRIIARILKLLRDLTRRLAEVAKKVHKLLEELLRKLKEDTR

SEQ ID NO: 13437 - protein, 231 aa, Artificial Sequence; identical to SEQ ID NO: 13436
  Synthetic

SEQ ID NO: 13438 - protein, 234 aa, Artificial Sequence
  Synthetic
KDAETLEKVLRDVLERADEIIKRLEDIYREIKKRLEAIIKEAEDINRKILEEIRRLAEDRKALADVVRKVAEDNLRLNRRIAEVLRELVKRALDVNEELARVLEELLKRLLEIVESANVDELRDIVDKVLKTVKKLLDESRRVAERLKREVERLLKESEDIVKEILERVEELARKITDVKRALEELKDLIDRNLKVLKDLLDATRKLIEENIRVLREILKRIKDIARELLEATK

SEQ ID NO: 13439 - protein, 234 aa, Artificial Sequence; identical to SEQ ID NO: 13438
  Synthetic

SEQ ID NO: 13440 - protein, 242 aa, Artificial Sequence
  Synthetic
SSKEEVLELIKELVRSSKEVLERVVRLNEKSLRISVEVLDRIVELIEEIVRIVVRELEKKVDERLVRKLKKVLEEAKERVERLVKENRDLIREVEEKSKRLVDENKKVLDEVVKEIDEVAKGELDSEEAVRRLLKILDETLRRHKEIVERLLKVNKDLLDRHREILERLKRLLEETLKRVKDTVPEIRELLKEIKRIIEEIDRLVKESLKRHKDINDEIRELAKRTLDEIKEVIDRIRERLR

SEQ ID NO: 13441 - protein, 242 aa, Artificial Sequence; identical to SEQ ID NO: 13440
  Synthetic

SEQ ID NO: 13442 - protein, 234 aa, Artificial Sequence
  Synthetic
SEEEDVIRDVKRRLEEILKTNADVIRDIEEILKEVKERNKRVVEELKDILRKVLEELRKKGVEERVLRLIEELVKKIEEILKRHLKLVEELLRLLREVLKRHLTLLEELVKLAKEVLDARLPKDELKKLLDRLLEEVRRVSDEVRRILEELLKRVEEVVRESKELLKRLLEEVEKLGVGKEVVDLIREIVERLARAVEESLKLLKEIIDLLTESSKELVKLLEEILRTLKEAAR

SEQ ID NO: 13443 - protein, 234 aa, Artificial Sequence; identical to SEQ ID NO: 13442
  Synthetic

SEQ ID NO: 13444 - protein, 235 aa, Artificial Sequence
  Synthetic
SDEERLEKVVKDVIEKVRRILEKWKKDIDKVVKELRRILEEWEKIIREVLDKVRRLKDEVDMLVKVLEEILRLAKELSKRVEEVLREILKLAKRLSDELVKVLREIVKRARDITRDDKLRKIVEDVKRELEDLARKDRKILDDVRELLERIAKEDKDILREAEETLRRLADEMRRTTVDERLLKRVVDILKRLLELNATTIERLLRILEELLKLNKELAERVIRVLEKLLEEIKR

SEQ ID NO: 13445 - protein, 235 aa, Artificial Sequence; identical to SEQ ID NO: 13444
  Synthetic

SEQ ID NO: 13446 - protein, 235 aa, Artificial Sequence
  Synthetic
KDMERVLTEHKKAVKELIELLERLLEEHERASRELIKLLRELLERHKRATDELIKLLRENKRRDEEIVRRVEEITKRVRKIVTEIVERAREITEKIKRIVEEIAKRVREVTKRLEDELKSEKAKKVVDLSREVVKIIEKVLDELVKLSKEVVDIITRVLEELVRLSEEVVRIITELLRRVEEVVKRLEDVNRTLEEIIRKVEEEAKRVNEDLRKRIEDVVRTLEEVNKRLKEITK

SEQ ID NO: 13447 - protein, 235 aa, Artificial Sequence; identical to SEQ ID NO: 13446
  Synthetic

SEQ ID NO: 13448 - protein, 240 aa, Artificial Sequence
  Synthetic
SELEEVAELLKRSKELIDEVEERIRRLATESLRFLDEVVRRIRELLTRLLKEVRDSGVPDELIELIERVIRLIEKVLEDIKRLIEKNIELAERVLEAIKRLVEEDIKLLIEVLRRKEEGRPEKDVKELLKRVEESVKRSLTEIRKLLEEVRKSVERTLEEVKKLAEDVLRLVEEVLKRAKDRGVDERLLKKTEDVVREILRLIEEVLRTHAEIIREILELIERLLELHKTLVDRLLERIE

SEQ ID NO: 13449 - protein, 240 aa, Artificial Sequence; identical to SEQ ID NO: 13448
  Synthetic

SEQ ID NO: 13450 - protein, 235 aa, Artificial Sequence
  Synthetic
SVLETVKRLAEESSERIRKIVEDDKRVADDSSRKIKELIEEIKRRVKELLDRIKDLDSTEDLEKLLDELLKEVKRLLEELLDAHRKWSDDSRRLLERVLRTHKELIDRLIKLLRDAGKPEEVVRRLEKVLRESLRRVKEVIKELIDLNKETLDRLKKIVEDLERVLREVLTELRRKRDKKEVVIRLIEELVKLLEDVLRRLLEVNETLVELNKRVWDRLVRINEELAEVALRVAT

SEQ ID NO: 13451 - protein, 235 aa, Artificial Sequence; identical to SEQ ID NO: 13450
  Synthetic

SEQ ID NO: 13452 - protein, 235 aa, Artificial Sequence
  Synthetic
SVLETVKKLLEDSSEKIERIVEEDERVAKESSDRIRRLVEEDKRVADEILDLIEKITDTDTLLKLVEEWSRTSKKLLDDVLKLHKDWSDDSRRLLEEILRVHEELIRRVKEILDREGKPEEVVRELEKVLKESLDTLEEIIRRLDEANRRTVKRVKDVIRELEDINRKVLEEIERKRDDKDAVIKVIEKLIRANKRVWDALLKINEDLVRVNKTVWKELLRVNEKLARDLERVVK

SEQ ID NO: 13453 - protein, 235 aa, Artificial Sequence; identical to SEQ ID NO: 13452
  Synthetic

SEQ ID NO: 13454 - protein, 251 aa, Artificial Sequence
  Synthetic
SIRELLKELEDVVREIIRDIRRLLEESRRVVERIERETKRLLDEIRDVARRIEETIRRLPLPEEVVKDVLDMIRRLVKEIEEVVRLHLELVREVLESHEKSVRDVEELIRRLVEVVREVVRKLEESRDKDTLKKLVEDIKRILEKILRDIERLNKENARLIERVTEELRRAADRVRKIAEDILRRIEKAGLKKEAVDELRRLLEELKKIVEDILRTLEKLNRELLEIDKRVADRLRELLRTLKKLIEEAAT

SEQ ID NO: 13455 - protein, 251 aa, Artificial Sequence; identical to SEQ ID NO: 13454
  Synthetic

SEQ ID NO: 13456 - protein, 230 aa, Artificial Sequence
  Synthetic
SKEEAIKELLKKHKRITEDIIRMARELDREHEEITREIAERLRRLLKKLLDDVRREVKDERLLREVKKILDEIEKILREALRRTKEILDETKKILDRALKETDEVLERIKELVERGEPKEEVLDAVRRLVELDKKAVDDWNRVNRDLVRVDKEVLKTLLDVIRELIKVLKARTDDERAKRVLDKILDDVRRLVEEAAKLLDESVKKSTDIVRRVRKLLDDSLKEVAELAK

SEQ ID NO: 13457 - protein, 230 aa, Artificial Sequence; identical to SEQ ID NO: 13456
  Synthetic

SEQ ID NO: 13458 - protein, 230 aa, Artificial Sequence
  Synthetic
KKEDDVRRLLKEHEDITREIIKLIRDLARKHLELNKRVIRALEKVLKDLEDEVRKDVRDKDLLRKIKELIKKVEKILRKALKDSKDLLKRLEDILRRALEETKKVLEEIERLLKEGRPREEILEVVKKLVELDKRALDEILEVVTDIVRVDAEAIETALRLIEEIIRELKANTTDERVRRVLDRVVERVAELVREWKELLKRSLDEVREVVKRARDMLRRSVKTVKELVD

SEQ ID NO: 13459 - protein, 230 aa, Artificial Sequence; identical to SEQ ID NO: 13458
  Synthetic

SEQ ID NO: 13460 - protein, 241 aa, Artificial Sequence
  Synthetic
DEVEDARKKLEDLERENRKVIKEIEDALRELVKDHDRVVEELRRRLRRLLEELKKLVDDRKRREETEERLRRLLEALKKLLKELIDKHREIAERMLELARRAIKISREIIEKVREILRRAGVPEDVVREIDKVVRDSLKRLEEVLKRIEEELRRSLKRLKEVLEEIKRKAEELEDILKKIKDEEMLKRVVDVLEDLVRTIEKVLRELSETLRELVRRLLELLRENNESVRRLIRILEEALR

SEQ ID NO: 13461 - protein, 241 aa, Artificial Sequence; identical to SEQ ID NO: 13460
  Synthetic

SEQ ID NO: 13462 - protein, 240 aa, Artificial Sequence
  Synthetic
SEDEAAERLLREAKKILKRLEDAARESLKSAERILEELEKAARDSLRKAEKIIRDAKRKGLDEKALKRAKEALEKAERDHRRALKRAREAIEEAAKRHKEALEEAERAIKRAEEEARKAKKESDERTAAKRLLDAVKELADAAKKAADRALKANEDLARAAKEAADEALEANKRLAKALRDDTTDKEAEKLATKLVEDSERAAREAKKLADENVKRSKEAAEEAKRLADRLVKEAEDDAR

SEQ ID NO: 13463 - protein, 240 aa, Artificial Sequence; identical to SEQ ID NO: 13462
  Synthetic

SEQ ID NO: 13464 - protein, 244 aa, Artificial Sequence
  Synthetic
SEDEELLKRLDELLKEILKVIEELIRRLEKAHKENMDKIRDSARRLRELLRKLAEDEREPTSEETKKRLVDELKELVRRSVEELRRSVEDLKRLVDEVRELLERLLRKLEKLVREIARELEKRSRSDELEKKVEELIRVAETVVKLVADVVRLLIEVAERAVELNREVVKEHEEILETVVELLARGGREELVKEILERVDRLLRKSLERLREVLEESRRRLEEVLRALEEVIKRVRDLLRKLRE

SEQ ID NO: 13465 - protein, 244 aa, Artificial Sequence; identical to SEQ ID NO: 13464
  Synthetic

SEQ ID NO: 13466 - protein, 238 aa, Artificial Sequence
  Synthetic
RKKEELARVLEESLEVNRKLVRDLAEVLRKDLEIIRELVKRLVEILKKILKVLADVIRKEELRRALKEAEEVLRKLIRTLEEVVRRHEEILRKLIEDLKRVVKRWEEVVDRLIKEIEDLEDVLRKLLEVVRRSVRELEKILERLKRSVEEVIKRITEVLEELEKLVRDLIDVLRRAGLDEETLRKVVEDLERLLREARRVVKEAVEKSRRSLEDLRRIIEEAIRRNEKILRKLKEIVK

SEQ ID NO: 13467 - protein, 238 aa, Artificial Sequence; identical to SEQ ID NO: 13466
  Synthetic

SEQ ID NO: 13468 - protein, 244 aa, Artificial Sequence
  Synthetic
KEDELLRRIKEVIDKTLEDMKRLLKKHKELLDEILRLLAELVEENKKLIDEILKLVEDSGIDEKALDELRRVVEEVKEEHKRILEEVARAIKRNKEKVDRVKERVEKVAKEVKDKLDELKRDSDKDKVVREIDRVLKELVDVIRELVKELIDSAKESVDVLRKVVEDSERVLRKLVDVLRRVLDSEEAKELVRRLKRAVEESKKKLDELVKDVKRLADDSARDLRELVKRIAELVKKIRDELRD

SEQ ID NO: 13469 - protein, 244 aa, Artificial Sequence; identical to SEQ ID NO: 13468
  Synthetic

SEQ ID NO: 13470 - protein, 244 aa, Artificial Sequence
  Synthetic
DAEEALKRAREVLKEAADLNRKAVEDARKILKDAADDNKRALEEAERVLRKALEDAKDARARNEDERKALKLLADAAKRIAKLIEDASRATADALRKIAEVIKRASELLARAAKEIARLAREAAERADDEDLRRIAEELAKRLEKLAKEHKDIADRIAEELKRLAREHNEIAKELARRAEELAKKARNAEKAAEDAKRLLEEAEEASKKLIKAAEELLRELAKASKRALDEARKLIEEAEKAAR

SEQ ID NO: 13471 - protein, 244 aa, Artificial Sequence; identical to SEQ ID NO: 13470
  Synthetic

SEQ ID NO: 13472 - protein, 244 aa, Artificial Sequence
  Synthetic
SEREDLLRLIEEVIRELIKLLETNLRLNEETIRTLIRLIKKDLDLNRRSVEELVKLLKERVRDEEKLRKVLEDLERILRKIEKVNRDVIEKLKEILKELRKIHERVIRELERILEELARVVEKLDSEDLARVILDILRKAADVLREVLERSERVTDKIAEVVEEVLRLNREMVREIIEVLKKVLDSEAADEVRKKLAEDERLNDKSLEELKRILDKDREINRRVAEKLTRILETLRKIIEDVAR

SEQ ID NO: 13473 - protein, 244 aa, Artificial Sequence; identical to SEQ ID NO: 13472
  Synthetic

SEQ ID NO: 13474 - protein, 241 aa, Artificial Sequence
  Synthetic
DDLERVLDELRRIIEEIKRRIDKILEDYERVLRDAKRLIDDVLREYRRIIEELKDLLDKVRSEEAVRRIIEVLKKLNEVSRKLVEAIIKVLRELSEISERMVRLAEELLERLVEVLAKGGLPEEVIKTLKKVVEELVRRLREVVKRDRELVRKVEKVLREAVERDKRIVDRIARLLERDGVDKDVLERIKRLLDELRRANEEVVRRVKKILDESLKENRDVVRELKKILDELLEIVAEAAR

SEQ ID NO: 13475 - protein, 241 aa, Artificial Sequence; identical to SEQ ID NO: 13474
  Synthetic

SEQ ID NO: 13476 - protein, 238 aa, Artificial Sequence
  Synthetic
SKKERLKKLIKEHLDLLRRLLKELEDLIRKHLELLRRLLRRLKELLRELLKLIEELVSDEKVLRDIRRVVERVLEELDRVVDRSEKVVREVIERLRDALRKNTEVVKTVIEKLDKIEDEDTALKVLEEVVKESVRLVEEALDIAVTVVKESVDLVRRLLDSLLAVAKELVDLLREVLRKADLRDRVEKEVRRALEKVERLIREIKRLVERSLEEVEKLIREIKKRVRDSLRKVKKESE

SEQ ID NO: 13477 - protein, 238 aa, Artificial Sequence; identical to SEQ ID NO: 13476
  Synthetic

SEQ ID NO: 13478 - protein, 242 aa, Artificial Sequence
  Synthetic
DEIETVLKRLAELIKESLDLLRETLDELRKIIEESKKSLEDVLRRLKELIDRLRRLAEEKTGEELLRLLIEVIERLLKVVEDLLRESNRVVERLIRVNREALRLSNRVVADLLKVLKDAAPDVEELRKLAEDVLRENRELSRESVKIAEKMLEENRDLTRRLKELAKKVLEEIRDLVRRVRDKDELLRRVEEILKRLLELIRRIIEEHRKILERLLETHEDLIRKHEEILRRLLKAADEERQ

SEQ ID NO: 13479 - protein, 242 aa, Artificial Sequence; identical to SEQ ID NO: 13478
  Synthetic

SEQ ID NO: 13480 - protein, 238 aa, Artificial Sequence
  Synthetic
SEKEDVLRRVEEIARRVRDILRRNLEKVERIAEELKKINDDLLKEIERIIKELKEVLRDVKDKDLVERLLRVLAELVDVLREVVKRSVEVLEKLIRVNEEVIERLREVLRELVEVLARGGVPREIIETLRRLVERLVKILEKNKEDLKRLVDENRDLAKKVLEILKELIKRLRDVLRERKEAIEEVLEILDRILKTARDVSKENLESLKRALELDRRTNERLEDLLREILELLRKDIQ

SEQ ID NO: 13481 - protein, 238 aa, Artificial Sequence; identical to SEQ ID NO: 13480
  Synthetic

SEQ ID NO: 13482 - protein, 246 aa, Artificial Sequence
  Synthetic
SELEELRKLAEEAIEAAKRALDRLHKLSRELIEAAKEILKRLKKLSEDLIRAAEEAARRSESEKALEDAKRAIDELRRATERVEKRVREAIKELEEANKRVAERARKAIEELKEAVRRVEERARRGETKEAAEEALKAVRDAAKAAREAAEDHLRALKKAAKAAEEAAEEHLRALERAARAAEEALRGEDAKRAKEIAKEAIERSKKIADEAREIAKRAIDKSKKIAEEAKKIADEVLKRAEDIAR

SEQ ID NO: 13483 - protein, 246 aa, Artificial Sequence; identical to SEQ ID NO: 13482
  Synthetic

SEQ ID NO: 13484 - protein, 250 aa, Artificial Sequence
  Synthetic
RESEELIRLLRKIIELLEELVERIRDLLRKHLKLLEEVVELLKRNLDEILRLLEEVLREANVEDAKKVLTDVADLARKSLERIKKVLEDSRRLAEEVERAVEEVLERVKRLVEELEETVERLKDGRKEEVLKVAKDILDKIVELVERLLRVVIEVVKKSIDLLERLLEEHERVVTEIIKLVKRLLEKAVKDTEKAKKLEELLRDLLRTVREIVKEVRELLEESLRTAEKLVEDIKRELDELRKRLKELVD

SEQ ID NO: 13485 - protein, 250 aa, Artificial Sequence; identical to SEQ ID NO: 13484
  Synthetic

SEQ ID NO: 13486 - protein, 239 aa, Artificial Sequence
  Synthetic
DEERLVEEIIRTIKRVIELNEESLREIERVLEEVIKMDKRSLEEIKRVLDEILKLARDGDVSERLVERVERLVRRLIRKNEEIVRRVREKVERLIRKNRTLVDDVRRKVKELIEKLRRTGLKEDLERVLRKILELLERLSEDTARVLEELLRLLEELSRRTAEVLKRLLDILRELAKLRGEELERVLRELKKVLEELIKDNERVNDELRRVLEKLKERNRKVLEDIKRVLEELRDEVER

SEQ ID NO: 13487 - protein, 239 aa, Artificial Sequence; identical to SEQ ID NO: 13486
  Synthetic

SEQ ID NO: 13488 - protein, 241 aa, Artificial Sequence
  Synthetic
SSEEIIRTLEKAIRESEEKLERLVRRDEEVVKDLRTKLRENLDRVRRMVEELVRMLESGKPAEDILREAERLSKENIETLEEILKKAERVSEESIRVLEEILKENEEVVRKIIKDLPKTEKADEVVERLKELLKRSEDVIRKVVEDSERLLDRLRRVIEDVVRRSRELLTKLREVVKRVRDKDTLVKVLKEVLERHVEADEKAVRELAKVLEENVRLLEELVRVNKEVLRRILELVKELAK

SEQ ID NO: 13489 - protein, 241 aa, Artificial Sequence; identical to SEQ ID NO: 13488
  Synthetic

SEQ ID NO: 13490 - protein, 233 aa, Artificial Sequence
  Synthetic
SKEEKLKDDVRRVLEDLDRVLKELEKLSEDNLRELKRVLDRITDLHRRILDELRKKITEEELLRRVEKVLKDNLDLLRKLVEEHKESSERDLKRVEDLVREIKEVLRKLLELEDRDTDIRKIEEEIERLLRKIRKAVEESKDLNRRNSERIEEVMRRSEELARRLLKEIRERIDSKVAEDILRVLEKLVKVSREAIKLILELSEHHVRVSTRIARLLLDVARKLFEVIKEAER

SEQ ID NO: 13491 - protein, 233 aa, Artificial Sequence; identical to SEQ ID NO: 13490
  Synthetic

SEQ ID NO: 13492 - protein, 233 aa, Artificial Sequence
  Synthetic
KKEDELEKMVRDVLEDLDRILREAEELSRKNNDDLRRVLDRLRRLAEEVIKRLEEKVTIRELLEELKRVIRELLRRVKELVEEHHRSSREDNRLLKELVERIKKVLEELLRLVRNDTDRREIKKLLDELKRLIEEVARESRELNKKNSERIREVVERLERLVEKLLEDVARTIDSEVARVILEILKRLLKALKEAAEELKKISEHHLRVSEKVVRDLDRVVKKIVDVARRVAT

SEQ ID NO: 13493 - protein, 233 aa, Artificial Sequence; identical to SEQ ID NO: 13492
  Synthetic

SEQ ID NO: 13494 - protein, 242 aa, Artificial Sequence
  Synthetic
SEKEKLLRDLEEVVRDVIRLSKESVDKLKETVDRLVEESRRTVEELRRIVDRVAKEVKSKEVLDKTRDIVRKVEELNERIIRAIEDLVRKVEKLNEEVIRAIEEVVRRMAELIRDKREDKERVDRVVKELADELRRVLEKYEKILRDLARELKKLVDEHRRVVRELAEELRKILKELKDKRGDDEIVKLLEDVVRELVEVLRKSTEVIERAVKKLVDILRESLKLIEDVVRRLVEIMEEIVR

SEQ ID NO: 13495 - protein, 242 aa, Artificial Sequence; identical to SEQ ID NO: 13494
  Synthetic

SEQ ID NO: 13496 - protein, 238 aa, Artificial Sequence
  Synthetic
SEIEDVIRRLRKILEDLERVSEKLLREIKKILDEARRLNEEVIKEIKRVLEDAVRVFRDIRERKEELRKLVEELIRELRKLAKEVDEIHKRIVERLKKLVEDAERIHRKIVETLEEIVRRVPREELKRVVEAIVEVIKEHLKVLKDVIRRIIKAIEENAETIKRVLEDIVRVLELVLRGEKRIEDLVREVERLIKRIEDSLRELEKTVRELLKRIKEASDKVREDVDRLIKELKEAAD

SEQ ID NO: 13497 - protein, 238 aa, Artificial Sequence; identical to SEQ ID NO: 13496
  Synthetic

SEQ ID NO: 13498 - protein, 246 aa, Artificial Sequence
  Synthetic
SREEIVATLEDLARKILEVVKKLAKEIEDAWREIERKVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLEELELERELVKELVELLEEILERNTRVIKEIIDLLRTVIRIHEKIVEDLIKLLEELLRRLEEATR

SEQ ID NO: 13499 - protein, 246 aa, Artificial Sequence; identical to SEQ ID NO: 13498
  Synthetic

SEQ ID NO: 13500 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKDIEEELAREVERVIKELLDKSKEILERIERAIDELLKVSEEILKLSEDASEELLKILREFAK

SEQ ID NO: 13501 - protein, 237 aa, Artificial Sequence; identical to SEQ ID NO: 13500
  Synthetic

SEQ ID NO: 13502 - protein, 237 aa, Artificial Sequence
  Synthetic
DEKEEALKTVERIIRDIVRRLRELLKEHEDIVREIERELKEVHEKHKRLVEKALEELGTEDDILRKVEELLRRHNEILEEVIRRVRELLRRHHEVLERIVERLRELMKRLLDVIRRGEPEDELRKILRELLETVKRIAEELRRLSKRLLDEIRRLAKELEDVSRDLERRVRELLKDLEDRLADLIRRAVDRLRDISREILKRLVEVIERLLEVSEKILKLVEEVIRELLRVVEEAAK

SEQ ID NO: 13503 - protein, 237 aa, Artificial Sequence; identical to SEQ ID NO: 13502
  Synthetic

SEQ ID NO: 13504 - protein, 251 aa, Artificial Sequence
  Synthetic
SVVEILAEVLKRLLDILRKLVDAIRDVVKKHVEVVEKLVRLHEEVLRRLVDILRKIAEVREGEAVKRLLEEARRVLEDILRKSKKINEESERIIEEVIERIEEILRRIEEKLKEILDEIRRAGIPESKKRIVDELVKLVREILKELKKVVDDWAEIVRRLDEESKRLNEEALKIVEDLLRKLEDLERKPVDEEILRRLVEEAKRLVAESIKKLRDLVRKIREAHKEAIKRLEEIVRKVEEIVRKVIDELRK

SEQ ID NO: 13505 - protein, 251 aa, Artificial Sequence; identical to SEQ ID NO: 13504
  Synthetic

SEQ ID NO: 13506 - protein, 248 aa, Artificial Sequence
  Synthetic
SDEEKLRRLLEEVRRLAKRVIDELERVLRESKRLAEENIEELDKALEEVKRLIDDVIKKLRDGARIEEVVEEIRRVLKRVVELLRRVSDDTRRILERNVELLERIVEKLERVLRRVVRVLEDVTREERLKELVRRVEELLKEVLRRVREIVKRLADLHRKVLKESEDLVRKVEEIAKDIVDKLRTTTDSETIERLLRELLKVLKEIVDRHRRIIERLLKASEDAVRELKKLIEETLRVLTDVVRRTET

SEQ ID NO: 13507 - protein, 248 aa, Artificial Sequence; identical to SEQ ID NO: 13506
  Synthetic

SEQ ID NO: 13508 - protein, 235 aa, Artificial Sequence
  Synthetic
SLVDELRKSLERNVRVSEEVARRLKEALKRWVDVVRKVVEDLIRLNEDVVRVVEKVTVDESAIERVRRIIEELNRKLDAVLKKNEDLVRRLTELLDKLLEENRRLVEELDEDLKRRGGTEEVIDTILELIERSIERLKRLLDELLRIVREALKDNKRVADENLKKLKEILDELRKDGVEDEELKRVLEKAADLHRRLKDRHRKLLEDLERIIRELKKKLDEVVEENKRSVDELKR

SEQ ID NO: 13509 - protein, 235 aa, Artificial Sequence; identical to SEQ ID NO: 13508
  Synthetic

SEQ ID NO: 13510 - protein, 229 aa, Artificial Sequence
  Synthetic
SKEERLREVAEKHKKDLEDIVKRVDEAAKETKRRLEEILKRLEEVLKKILDDLEKGPDDEKLKKVKKILKDIMDRLRELIKKILKLLKENLEKIKELLRRNLEISEELLKLAKDLRDRDVLETVRRVLEKLDEEWDRVLEDSRRIIETILRELDTLLREVEKLIKEIKDEIKDLKEVLDILERAVEVVRRVIKALKEVLERHVDATREVIERVKRVNKRLLEAVREVVT

SEQ ID NO: 13511 - protein, 229 aa, Artificial Sequence; identical to SEQ ID NO: 13510
  Synthetic

SEQ ID NO: 13512 - protein, 232 aa, Artificial Sequence
  Synthetic
SREEKLEELIKELERRLKDVLDRSRELNREIRKTTEEVIREVDRLLREIEKIVRDVRLPREIVELIDRLIKRLREILKEHKELVDEVIRRNEKSNRELVKLLEEALREARREGADEKLIRVAEELLKRIEEIIRRNEEIIKDLKRRSKRLLEEARRVVKDLLRRLEELLRRLDEDTARLVREVAELIEKVVREIVKLIDEDLKKLERVVRENARLLREVVELLLKVVRDVAK

SEQ ID NO: 13513 - protein, 232 aa, Artificial Sequence; identical to SEQ ID NO: 13512
  Synthetic

SEQ ID NO: 13514 - protein, 244 aa, Artificial Sequence
  Synthetic
DEKELLEEIIKKVEDLLRESRELWERLIKRVKELLKRSKETVDEILKRIKELLDELRKVAAEGAPEEELVKKIKEILETVKRLIEEHIRTNEEVLKEILELLKRIIERNRKVLEDVLKDVTDTGVPEEVLKELKKVIDDLERLNEEVLKEATEVLKRLLDINARVLEELDRVVRELEDLLRRLTDKRLLDVIKEIVEKLIEVVRKLLEADKRIIEELIRVLEKIAEVDETIVKRLIEVLKKIAD

SEQ ID NO: 13515 - protein, 244 aa, Artificial Sequence; identical to SEQ ID NO: 13514
  Synthetic

SEQ ID NO: 13516 - protein, 244 aa, Artificial Sequence
  Synthetic
SEEEDIERVLRELKKLHKDHLDLLREVVKRAEELLRRHLEILREVLKREKKLLKDVLRDARRREEAEEVVRRVEKELDRVLEDSERVLRELLERLKKVLEEIKRVHERVTRDLERVLRELRDVRSEEVAKLLTELLERSIRVIEESVRLSRRALEVLIRVIKESVDRLEELLRDLIRVLKELRDKGVITDELLEEAKKLVKEVRELAEETLRRLARLVEDVKRLNDEAVKRLRELVRRIKEEVR

SEQ ID NO: 13517 - protein, 244 aa, Artificial Sequence; identical to SEQ ID NO: 13516
  Synthetic

SEQ ID NO: 13518 - protein, 237 aa, Artificial Sequence
  Synthetic
RTEEILREIVDLLRRVAEENLRTLEELVELLDRVARRNLESLRELVRILEEVLKKLLKKDKDEELKRVIDEIKKVLEELIETLKRVIDESREVLKEIRKTLEKVIRETKKELERLIELLRRGVPVERLMEELKRLLDRHKDVIRKLNELLKRLLERHVKVVRDLNRALKALAEKIREDIRDEDVLRELDEVVRRVIERDREILRELKRLVEEVIRKNEDIVRKLEEAVERVLRKLKD

SEQ ID NO: 13519 - protein, 237 aa, Artificial Sequence; identical to SEQ ID NO: 13518
  Synthetic

SEQ ID NO: 13520 - protein, 239 aa, Artificial Sequence
  Synthetic
SEKEEVIKDLRKVLEEVLRRHEELVERLKEVLRKVLEDHKKLVEDLKRVLDEVRRKLENNADLETVIKELLEVIRRVLEDSNRVVEELVRAVEEVLKESIRVVKRLIDTVDELLRRLTRTEDVKEIVDRIRKKLKELLDTNRELVERVRKLLEELVETNRRLTEEVKRKVEEILKLARNGLDREELLRRLERIVEDIIRLLEESLKLAAEVIKTIIRLLEESLERLKRLVDDIVEKLRK

SEQ ID NO: 13521 - protein, 239 aa, Artificial Sequence; identical to SEQ ID NO: 13520
  Synthetic

SEQ ID NO: 13522 - protein, 243 aa, Artificial Sequence
  Synthetic
SEKELLERLEEVERRLLEIVRRLLKRNRDVHEELLRIVEANLRRNKKVHEDLLEKVRKSVRKEEVKKVIDEVDKKSKESLEELKRVIEEVKRLSEETLKKVEKVIKEVEEELRRVLDEARRNPDKDVLKKAIEVARRIIEELARVLKDDIDRLRELIKTLADVLKKDIDELRRLIKRLMEEERVDKVVKELEDIVEELMEENKDSLRRLKEIVEELLEENRRVLEKLRKIVEDVARELEETAT

SEQ ID NO: 13523 - protein, 243 aa, Artificial Sequence; identical to SEQ ID NO: 13522
  Synthetic

SEQ ID NO: 13524 - protein, 234 aa, Artificial Sequence
  Synthetic
SIEEVLREIVKLLREVLERLIRVDERLVEALKRVAEKNIEVLRRAVDALRKVLELLRRGQDKRDVDRELRRVLDEVKKEIERSIEELKRVLEEHRRRIRKIIEELKRVLEEARRKLKSERLLEKLTRLVEKTIRAIEKLHREWERILREHIRLLEELLKRLKELLDELRKLIEDGEDEETVIRRVEDVLRDLLRRLEEVVRRSTEEAKRLLKESRDVVRDVEKTLRELLEELRR

SEQ ID NO: 13525 - protein, 234 aa, Artificial Sequence; identical to SEQ ID NO: 13524
  Synthetic

SEQ ID NO: 13526 - protein, 234 aa, Artificial Sequence
  Synthetic
SVEEVIRKAVTDLDRVLKTNIRVDERLIEMLKRVADENREVLEKIVRLLKEVLDLLRNGRDERDVAKRLREVLEEARRDIERSIRKLEEVLRRHREAIKRSIDELREVLERLERKLRSEDVLRKLEEILREHEDMLRKLHEEWERILRRHIELLKRLLEKIKRLLEELLRLATEGEDEKEVVDKVKRVLDELRRDLERVVEESEKLARDLLRKSRDVVRRTRELLKKLLEEVET

SEQ ID NO: 13527 - protein, 234 aa, Artificial Sequence; identical to SEQ ID NO: 13526
  Synthetic

SEQ ID NO: 13528 - protein, 247 aa, Artificial Sequence
  Synthetic
SRRETLEKLLKEIEDLIRESLERLEKLLEENRTLIDDDERRVRELARDIKELIKEIEERLRRENVEEALKVVREVLRIADEAIKLHIEASRRVLELSRRLVEDHKRATKEVLELLRELIRRLIEVEERKEDKREVKKDVERILREIEERLEEVLRRNREIHEEIKEDLKRVSKEVRDLLREIKKTLEDGKVSEEILKIIEELIKRLEKLNEDSNELMKELVKRNERLARENLKLVEELLRRIEETTR

SEQ ID NO: 13529 - protein, 247 aa, Artificial Sequence; identical to SEQ ID NO: 13528
  Synthetic

SEQ ID NO: 13530 - protein, 234 aa, Artificial Sequence
  Synthetic
SEVERLRELVERWREELKKLLDELRKVVEEIARELKKINDELRKLVEDIAREARRETKKRELLKELLTRLIKLLEEANERVRDLLRRLLEIIDEILRRLRELSKRLIEEARRETREERVKRALEEVVRTSEEILRELKEILDRVREELKRINDDSRRIIKEVVDRLREILEKADKDDDERVIEELIRVLRKVVEDHADVTRRLVEVLRKVVKLIEEVLKKDEKVLRDIVDRLKT

SEQ ID NO: 13531 - protein, 234 aa, Artificial Sequence; identical to SEQ ID NO: 13530
  Synthetic

SEQ ID NO: 13532 - protein, 237 aa, Artificial Sequence
  Synthetic
SEVEEVVRVLEKVLRLLRRLVEELHRLSERVLELITRLLKELKDLSREVIKRLEDANIDDRVREKLKRVHEKLERVVEEVLRRIRTVNEDLKRVVKKLEEKIKKVIDELRRENASEEALRKVAKVIRDVVEEAKDVVRRHVEVVRDVIRLLEEAIESHVRVVRRLIEELLRKLAEERKKEKIDELRRVLERVEREHRRVIKKIRDVVEKVKRDHERVLREVEKVVREVRTELEKLRE

SEQ ID NO: 13533 - protein, 237 aa, Artificial Sequence; identical to SEQ ID NO: 13532
  Synthetic

SEQ ID NO: 13534 - protein, 253 aa, Artificial Sequence
  Synthetic
SVEEELRELVKRVEKLVERLRRIVKEIIERSRDLVRKSREVVDRLKKELDELVKEVVREEGEDSEVVEVIEKLVRLATRALELHIKSLEKHVKLNEEALRRLIEVIEELVKLIREVVKELLRITRRGEPEEELKRIVDRAKEEVKRVLKKLREILEEWKKKIRESLKENKTIVDKVKRDIERVLEELEEAKVASDEVIRRIAEVVKRLIDKLKELSDDNRKAVEDHERLVRKAIEELVREVEDILRRIDETAR

SEQ ID NO: 13535 - protein, 253 aa, Artificial Sequence; identical to SEQ ID NO: 13534
  Synthetic

SEQ ID NO: 13536 - protein, 241 aa, Artificial Sequence
  Synthetic
SEKELLKEILDRIRELLEDDNRLLKRIVDEIRKLLEEWLRVHKEILERIKELLDRINAPEDVIRELTRALKETEEDVDRVIRTLEKLLKEVLDRHEEVVRKLDRLLKEVERLVEERDAEEVVRDLLRVVKEILDESKRVIDELARVVDEILKLLEEVDRKLAKVVKEILEDVLRAKKDDEDMVRKIRKIIEELKRLLEDLRRDTRRVIEEAKRLLKEWRDRNKEVADTLKKLLEDLIRKIR

SEQ ID NO: 13537 - protein, 241 aa, Artificial Sequence; identical to SEQ ID NO: 13536
  Synthetic

SEQ ID NO: 13538 - protein, 242 aa, Artificial Sequence
  Synthetic
REDEIVEDWRRLLEEAKRRSEEVAKEIRDRAREVTKESKRVADEWRRLLEEVKKRAENIDERVLKLIDDNIRDVERIIRRHEEIVKTLIRLLEEILDRHRRLVERNIESVDRLLKAVKNGEPIEELVRRIEDLSRKLVETNRKLSEELKRMAKKLLDENRKLSEELVKRSRDVVKEIEDGGLGEELVRVARDLVRLNEEVLRKSNRSVEELLKALARVLDRSNKSLEDLVELNKRVLDKLRT

SEQ ID NO: 13539 - protein, 242 aa, Artificial Sequence; identical to SEQ ID NO: 13538
  Synthetic

SEQ ID NO: 13540 - protein, 242 aa, Artificial Sequence
  Synthetic
RKEDLVREWRELLRKILEDLEDLVRKWRKLLKKILDDLRELVRRVREELDKALRTVEKGELDAEEVLKELERLVEEIIRAVRELLKRLSDLNKKVLDELRRLVERLSKLNKEVLDKIREEERSRKIEEILRELEELNRRSLKKLEKILKELDEADKRSLKEVEDVLEELKRRIREILELMKAGKDLRDLVRKIIEIIEDILRLLEEVLRKNVKAVEEVLRLAIRVLEENIEAVEKVLEDVRR

SEQ ID NO: 13541 - protein, 242 aa, Artificial Sequence; identical to SEQ ID NO: 13540
  Synthetic

SEQ ID NO: 13542 - protein, 243 aa, Artificial Sequence
  Synthetic
SEEELLREIEKILDEVRKLVEKLLEDNRRLADELIKLIKELLDRNLRLIERLLELLERGTDADELVKEARRMLEESKRLVTELVKTVEDVLRKSERLVEELERRVRELLKRLKDLVRETGGDKLKKVIEDLERVLKELLDALREVVKRSVKVWRDLLRALDDVVRRSVEVVEELLRVVKETGPGEELREVLERALRKAKKIHEDLKRIVEDVRRRNDEILKDLERVLKEVEDKIRKILDELRK

SEQ ID NO: 13543 - protein, 243 aa, Artificial Sequence; identical to SEQ ID NO: 13542
  Synthetic

SEQ ID NO: 13544 - protein, 235 aa, Artificial Sequence
  Synthetic
RDEDIKRELVRLVEEILRTSARLLDESIKSNKKTLDDIERVAREIVREIEELLKRIADGNKLDEEVLRRLVEKIRRAIEEVERLLERLKEKIKRSIDDLKRVLEETARRLEDVLDKVRKDEDKDRVVERLIKVIREVLELDKRLSEENLKVLKEVLDLVETVAKRLIDVLKEVADDIKDADELKKDIRDVLERVKRIAEELRELVERDIREDKRLLDELAKLWRDLLKMIEDLRR

SEQ ID NO: 13545 - protein, 235 aa, Artificial Sequence; identical to SEQ ID NO: 13544
  Synthetic

SEQ ID NO: 13546 - protein, 248 aa, Artificial Sequence
  Synthetic
SEDELLEKIVRKLREAVKRIEEELRKSKREIERLVKEIKEKLEDSLRRVKETLDRIRETRKKPQDEEVLERLVRTLEELLRRHLKLIEDIARELKKLLKEHLDRIETIVRDLKRLLKEILDELERTGLPREVLEKVRELVKTVARLLDEVLKNNKKLLDDLKKELDDVLKNNKRIVDELRRLLERVRRRKEDLEELLRLLKEVIERSIESLERLLELILRVLEYSVRSLEELLRRLLEVIKRIVDTTK

SEQ ID NO: 13547 - protein, 248 aa, Artificial Sequence; identical to SEQ ID NO: 13546
  Synthetic

SEQ ID NO: 13548 - protein, 237 aa, Artificial Sequence
  Synthetic
DEDEIAEELKRLLREVEEKSKEIVRRMRELAREANKKSEDILRTLEKLLEELRRRVEENRRSSKAVLDKIREVLETLKELLDRHHETVRDLVRRLKELLDRHNETVKKLVEDIKRLLDESGGRREIKKRLEDALREHNRIIKEIKKLLDKVLKDHKDILDDIKKKLDDVLREVTEILKRNRIDEVVRRIERVIREVIKILARANKRLHDVVEEIIRLLEEVTDELRRVVEEVIRRTK

SEQ ID NO: 13549 - protein, 237 aa, Artificial Sequence; identical to SEQ ID NO: 13548
  Synthetic

SEQ ID NO: 13550 - protein, 238 aa, Artificial Sequence
  Synthetic
DKEEEVRRLIEENLKKIEEVIRELEKIIRDNLRKLEEVVREIEEELETTLRLIETDGVSEEVLREVLKRVEDIMRKLRDVLREVRELHEDVLRKVEEVLKDVKRLHEEVLKKLEDGLDLTKVLEELRRINDKLLKKVKRVLELLEEINRRALELVREVVERLLRVIERLIDLLRRSGVDEDLLRKLKELLETLKRRIDEIEKKLEEILKETKDLIRRLLEKLKRIDEELRKTLEDLRR

SEQ ID NO: 13551 - protein, 238 aa, Artificial Sequence; identical to SEQ ID NO: 13550
  Synthetic

SEQ ID NO: 13552 - protein, 242 aa, Artificial Sequence
  Synthetic
DDIDEILRRLREEIEDARRKLEKILRELRERIKDYKRKTDELLKESRKRIREAEDRVRRDGARDELMRKLSKEDEELTERLVRTHEKALEDLTRAVERLLRLLKELLERLKRILEEIRKRGRVPEELVKRLREVLKEVERRVEEALKRVKDVLDKSKRDLEEAVKRNREVNKKLRDEVEKRRDDKVLEALLEKLLRSNEELVKIDRDLLRDLLRVLEELIKTVRDLLRELLRVLEEVAREIK

SEQ ID NO: 13553 - protein, 242 aa, Artificial Sequence; identical to SEQ ID NO: 13552
  Synthetic

SEQ ID NO: 13554 - protein, 242 aa, Artificial Sequence
  Synthetic
REEETLRDIERLLRKLLEELKRTADELIDSHRKLIKKLKEILDRLRRSHEKLIETLRRRLTDEEVLKEIIEVNKKVLDDVTRILEEIERLNKRAIDRVKEILKRIEDTLRKVLDDVRKDKDKDRVLDKILDVLRKVVELLKRVLDESARVVEEVLTLVKEVLERSLEAVEESLRIVERRLSDKEDVKRELREVVKEHKEDLDRIKKELKELLDRHTETLKRIVKKLRDLLEEIRKALEDLKK

SEQ ID NO: 13555 - protein, 242 aa, Artificial Sequence; identical to SEQ ID NO: 13554
  Synthetic

SEQ ID NO: 13556 - protein, 232 aa, Artificial Sequence
  Synthetic
DEERVVEEAIRVLKEVLDLHRELIKRSIDVLKESLKVHERAVESLERVLKEILDLVRRGKREELDRVIRRVMEDLKRVHEELREIHEEVIRRLDEVHRRLKKVIDRLKTRLREELRIEKRLRDAEEILDRLYRENERVLRTLKKLHRDHYETNRRALETLLRLLEETEKLDKSGTKEEEVAERVKRIIEEVRKLAEDSRRKTEELIRRVKELAERTDETVRRVIEELRRRTK

SEQ ID NO: 13557 - protein, 232 aa, Artificial Sequence; identical to SEQ ID NO: 13556
  Synthetic

SEQ ID NO: 13558 - protein, 232 aa, Artificial Sequence
  Synthetic
DEEDVARKLIEVLKELLKLVEDLIRTNIRVLEESLELHRRLIEEIEKVLKRILELLEEGRREELERVARELLKELDRVHEELKRVHEEVIRDTDRVLKEIEEVVRRVLKELREEVRIEEKLRDMERILRKILEDIRRLVKRLKKLHEDHYRTNEEVLRETKKILKRTLELVRSGTDREELAKEVKRVIEELKKLARESAEESKRIIRTIEELLREARKRAREVIEELKERTR

SEQ ID NO: 13559 - protein, 232 aa, Artificial Sequence; identical to SEQ ID NO: 13558
  Synthetic

SEQ ID NO: 13560 - protein, 237 aa, Artificial Sequence
  Synthetic
DAEEVLRLLAEVLERIIELIKKVNEILIRVLREVIRLIEEVNELVREVLKRIIELIRRDIDDEDVRRLVERIKTVAEELHKEVRKLVKEIEDLARKSNEDVRKLVKDIRRVVEELKRANLRKDRLAEAVEDLLRRILEAIKRHLRKAEEIIKRILEAIREHLKKLRELAKEIKDAARKAGVDERILEEIERLVREVEEIHERVLRRLKELLKKVREVHEEVLRRIERLAERVREALK

SEQ ID NO: 13561 - protein, 237 aa, Artificial Sequence; identical to SEQ ID NO: 13560
  Synthetic

SEQ ID NO: 13562 - protein, 239 aa, Artificial Sequence
  Synthetic
SVREELEKVIREVIEEVERVLERIRDELRKSLERLKEVIKRIEDVHRDLIRRIREIKDLEKVLRLVLDVLKKVSDLTRELLRENLEVLEKIAKLLEDLARSLLKVIRRLLEILIREFKDDEELLRRLKELVDKIRKILRDLLERVKEVVDRHRKKLEELLKRDEDLLEEVKRRLDDIRRENVPIEEVLKTVEDISRRHRELLKRILDTSKRSIEETLKLAREILETLKRLLKELLDAAK

SEQ ID NO: 13563 - protein, 239 aa, Artificial Sequence; identical to SEQ ID NO: 13562
  Synthetic

SEQ ID NO: 13564 - protein, 240 aa, Artificial Sequence
  Synthetic
DAEDEARRVIDEAVDRLRKAVEEIAEVARRHLEEVEEVVRKLEEIIRESLERVRRASEAREDRALEKIATELRKLNEDVRRELERAAEESRRKLEELRRRLDKVVKDLRELLKRLRDSGDVAGEVLEALKRVIDTVVRLLEEVLRRLAEISEEVLKLLREVLEKHHDVTRKVVDLLRKVRRDKEAEEVVRRVERLHEDVLRRLKEVVKRVKELHEEILDRLREILDRVRELARKVREDLR

SEQ ID NO: 13565 - protein, 240 aa, Artificial Sequence; identical to SEQ ID NO: 13564
  Synthetic

SEQ ID NO: 13566 - protein, 233 aa, Artificial Sequence
  Synthetic
SEKERLSKIAEDLIRRLEEELERVERTHERLLRKLEELLKKIEKEYRDAMRKLETLTGVSERTLEELVKELIDISRKIVKRLEETVTELREINDRLVKRIEDLIRKLIEDLTREVEKKEVLERISRELEEVIKRLRKVVDESRRKIEEVLEELRRAAEESTRALEEVLKELKRGKDIKEVLDDLKRVLERDLRAIKKIVKELKRILKENLDVLREIVERIKRVLEKILREVEK

SEQ ID NO: 13567 - protein, 233 aa, Artificial Sequence; identical to SEQ ID NO: 13566
  Synthetic

SEQ ID NO: 13568 - protein, 248 aa, Artificial Sequence
  Synthetic
SREERLERVLERVKRAIDRYRDMLRRLLKTVEDLIRKYEEDLKRLLKEAKELIDKVKEENKDVEEVKRVLEKLLKVLEDLVRKVRKSAEDLREIVKKLVTDVERSLELLLKIVTELVEAAKRTETKEALDKVLTEAKKKVDEVLERSRKVLEDVRKELEEVLKHSEKVLREAKKELEKIIKEVEDAGTDEEIKKIIDRLREEIERILDELRRLNEELVETLRRVLETLRELNERLVKLLRDLLREEKK

SEQ ID NO: 13569 - protein, 248 aa, Artificial Sequence; identical to SEQ ID NO: 13568
  Synthetic

SEQ ID NO: 13570 - protein, 246 aa, Artificial Sequence
  Synthetic
DEEEKMKKIEDVARRYKEEVKRVLDDLERLLRESEEEVERIVRKLEKLARDLEERVRELTKKEVVERLVRELLKAIKELIDVLRDVVRLSAEVIKELLDVLRELVELNLRAIKEIIEVLKKLKSEEVKKRLDEILEKIEKVNTDVNRRLKEIIRKLREIHEEVLRELDKILRDIERVVRDVERRIDDKEVIDALKELLKVLEDLLREIKEALTRNLEKIDELLKLLHELSRRVIEELRKLLEDLKR

SEQ ID NO: 13571 - protein, 246 aa, Artificial Sequence; identical to SEQ ID NO: 13570
  Synthetic

SEQ ID NO: 13572 - protein, 241 aa, Artificial Sequence
  Synthetic
REDEELARKAKEVLKETEDLLRKLEEEVKRVLEEIKRMNREVREKVKEVIKELRKRLKDLREVLKELEELLEELLRSDTEVSRLLEEIVTRVLRVLEKVVRESKKAVDKILEVLKKVKGKDVVKLLKDILREIEKVHREVLKELDDLVREVEKILRDNIETLRRILEKIRRILERVAREKDDKRLLDLLRDLLRLLKELLETLEKLNERTLKLLRDLLRKLKEALRRNLKLLRELVDEAAT

SEQ ID NO: 13573 - protein, 241 aa, Artificial Sequence; identical to SEQ ID NO: 13572
  Synthetic

SEQ ID NO: 13574 - protein, 237 aa, Artificial Sequence
  Synthetic
SKDEIIKRIKDELEKLVRDVERLLRESERRIADLVRRVREILEESKRRVDELVKRVKETGNTEELIKTIKDLLRRNLEKLRRIIEEIKEVLRENNELVDRTLKRIKDLLRELLEMIRRAEIDEERLRELEEILRRVLDTLRRLAEELHETSKRVLEELDRALREIEEIHRRVLKELDDTGDVETILRVATEVVKESATVLKRILETLEEALKRNVRIIEEMLEILREVIERIARKLK

SEQ ID NO: 13575 - protein, 237 aa, Artificial Sequence; identical to SEQ ID NO: 13574
  Synthetic

SEQ ID NO: 13576 - protein, 230 aa, Artificial Sequence
  Synthetic
SEEEILREIKRLLEEHLELNERILREIKKDNKRTLKELRDIVRELKEILERIKRRIRIKSEKAKEVDKIIREVERRIDEVLKEIERLIREDNKKLDDVHEESEREIRRVIKDADRTDDLKTVVDEVRKVVDRDLKLLEELSESNIRVLEEVLRLLEELLRILEEVLKEILKASESEELRKLLEDARRALERILRRLAKIVKEIKEKHEEVLRRLEKSVREIDERLRRARE

SEQ ID NO: 13577 - protein, 230 aa, Artificial Sequence; identical to SEQ ID NO: 13576
  Synthetic

SEQ ID NO: 13578 - protein, 247 aa, Artificial Sequence
  Synthetic
SELERLERLLKEIVEVNRKALEDLRRVLEETVRRDREVLDRTRRKLEEIAEEILRELKNVKEVRDAVKELEETLREVVRRSEELLERLREIVDRVVKEVEDSNRETEKKLRDVVDAVRRGRDDKTLVAEVIEVILRDLKRNLDLLERLIRVTVEVLERSLELIKRVIEVLRRVLKRVLDIVRERRKERREDLKRLEDLVKRIEEELRRKLEKYERELRDLKRKLEELLKRYEEKVKELKRKLDEALK

SEQ ID NO: 13579 - protein, 247 aa, Artificial Sequence; identical to SEQ ID NO: 13578
  Synthetic

SEQ ID NO: 13580 - protein, 238 aa, Artificial Sequence
  Synthetic
SEEEILRRIAEEIKRLIDEDLRLIEELVRKIKTVAKRDLELIARLVEKIEEVIRRSIRVEEVVRELKKKLDEILKRVEDVVRESKKRLEDVRRKVEEAVKKSKEEIERILRRAEEGTDKKKIVEDLERVLKDHLDMNTEVVKDLKKILDDHLDANREVVKRLKEVLDDAVRVLRERIEDEEELKTAEKIIEDIKKEIDDVHREVRRLLEEIKEDIDRVNEEVKKRLEDIIEKIRRAAK

SEQ ID NO: 13581 - protein, 238 aa, Artificial Sequence; identical to SEQ ID NO: 13580
  Synthetic

SEQ ID NO: 13582 - protein, 245 aa, Artificial Sequence
  Synthetic
SIEELAEDIKKILDDALELLERLAKRAKEINDEILDELRKLVEKNKRDLDRALEKLRREGIPKEVLDELEKAVEDLKRDHDRVLKDLKKVADENKKTIKKVLDDLKRIIDEVKRMIEDLLKRLEDSKRVLTEILKVLKRLVEEIAKLLERLLESDKRVIEEIIKLLEDLNRALEELIRIIAEKIEDTERVRKLIRELEEELKDNRRLIEELVRRARKVNKRLRELVEEVIDRLRELLERIEEKIR

SEQ ID NO: 13583 - protein, 245 aa, Artificial Sequence; identical to SEQ ID NO: 13582
  Synthetic

SEQ ID NO: 13584 - protein, 234 aa, Artificial Sequence
  Synthetic
SKEETLRKEAEDLLRRLEELTRRLEKKARELLERAKKLSRDLAEELKRLLKELREKDVPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRLDDERLKRLVEELLKAVTDLSRKNKRILEELLKAIETLSDENKKILTEILDALRRLVEKIEK

SEQ ID NO: 13585 - protein, 234 aa, Artificial Sequence; identical to SEQ ID NO: 13584
  Synthetic

SEQ ID NO: 13586 - protein, 241 aa, Artificial Sequence
  Synthetic
DEERKIVETLHRTSREVIKTLEKIVRDLKEVLKKNLELTERLIKRVHEVSREILRLTRENKVDEKDLERIHRELEKEIREVLEKSERDARDLLRKVERAIEELRERHKRVLEDLRRKGVPEELIRIFADLVRANTRVLETLLRILKELVDRSRDVLRKLIEIVEELARMNKEVLRKLKERDDDRVKKELEDANREVNKKLEEVLREIRELHKRVLDRLDEVLRRVEEINKRVNERLDRTAK

SEQ ID NO: 13587 - protein, 241 aa, Artificial Sequence; identical to SEQ ID NO: 13586
  Synthetic

SEQ ID NO: 13588 - protein, 242 aa, Artificial Sequence
  Synthetic
SEVEDLKRKLEEDLERHKKDVKRLKDEAERRLEEHKRLVEELERRIKKLLDELKDRNPEVKELLRVVKEIVELIRRVLEKHLKLLEEIIRLLATVLDKHLDVLREIIRLIARVLDLKEAGLDEEDLKREAEDIARKAEELLRDSARTAEDIARRAEEALKESKDDLKRILDRARELLDDIRRKKVVPKDVLRDLERILTELAKALKDLIDNSRRTLEKLLKALRDLIRESKETLEEVLRRTD

SEQ ID NO: 13589 - protein, 242 aa, Artificial Sequence; identical to SEQ ID NO: 13588
  Synthetic

SEQ ID NO: 13590 - protein, 240 aa, Artificial Sequence
  Synthetic
KEREEVKEKLDRLLEEVEKTVRELKREHDELLKEVEKLVRDLKKEHDELLKKVKDDGVPKEILDVIREHVRTNKEILDRVLEVVEEHLRRNKEILDKLLDDIRKVVEDAKRILEIDDDETLRRAVRRILEELRKLVEDIRKKVKDSLETLERALEEAEERIRRSLEDLKRVLKEAKDKTKDKDRLDKVEELVKKLLEDTKRTVDRVRELVRKILKKSRETLEELERLIEKILRELEKDAR

SEQ ID NO: 13591 - protein, 240 aa, Artificial Sequence; identical to SEQ ID NO: 13590
  Synthetic

SEQ ID NO: 13592 - protein, 240 aa, Artificial Sequence
  Synthetic
SERETVKRRLEELLKEVKRTLDKLKEEHDRLLEDVRRVVEELKREHDKLLKEVKDSGVPEELLRVIAKVLETNKRILDDLLRVVKKHVDLNKEILDRILEMIKEIVERVKRVLEDDDEKTLRDKIRDIIRRLEDAAREAEERVRRSLEELKKAVEKIRKKIEDSLRELEEALKRVRDKEEDDKRLEDISRLVKRLLDESRRVLRELEETIRKRAEESKRVLEEVKRLVEKLIRELRKEAE

SEQ ID NO: 13593 - protein, 240 aa, Artificial Sequence; identical to SEQ ID NO: 13592
  Synthetic

SEQ ID NO: 13594 - protein, 239 aa, Artificial Sequence
  Synthetic
SEDEIIKKIIEDLRRVLKEVEEIHKEVEERLDKVLKEAEEMHKEVLKELDRVLDEVKRIEDVETVLRLAIEAVRRALEIVRKVTEDLIRVVRKLLEIVDRVNKRVKKAVEDVLKLLRDTLKGSKDVERVLDEARRLLEKLHRDSRRILKRIKELLDELKELSERILERIKRLLEEVERRNSDDERLLEELIEELKDLIRRHIELLRRLIERLKELLKKHIEDLRRLLEEIEKLLEEARK

SEQ ID NO: 13595 - protein, 239 aa, Artificial Sequence; identical to SEQ ID NO: 13594
  Synthetic

SEQ ID NO: 13596 - protein, 241 aa, Artificial Sequence
  Synthetic
SREDEVRKVVEKVLRDSKRSMKELRDVVTEVLKKSKEVLRELKEAVDRVLKKLKDISRDVKSSDVVRELLRVLEELLERLARVLEKNLRINEELLRRLERVAEKNLKINKDLLKALADAERSEEAEKLLREYKKLVEDLARKLRRLLDEYRKLVEELEKRARELLEEIKRLIEDIKRKLERDGPSEELVKELLEFLKRVLEKAERLVRKNLEDNKELLERLERLIEENLKLLEDLLRRTEK

SEQ ID NO: 13597 - protein, 241 aa, Artificial Sequence; identical to SEQ ID NO: 13596
  Synthetic

SEQ ID NO: 13598 - protein, 251 aa, Artificial Sequence
  Synthetic
SEEEKLRELKEILDRTLKKIEDLIEESKRLNEEHVRLTREILDEIRRLLEELLRKLREAGIRDEEIETVFKEIKELLEEVLRRNEDSVRRIRKAHEEILRKLEEIAKRIRKLLDDVLRLLRGGRDRKDVLTDLLRVIKEALDALKKVLDDLHRVNEENVRLDKESLDRLLEVIDRAIKKIKKILKKAEERLSEEILKRIEDTLKRLKEELKRLVDEVRKHIEELLERSERLIRELRRTLEEILKRLKEKTD

SEQ ID NO: 13599 - protein, 251 aa, Artificial Sequence; identical to SEQ ID NO: 13598
  Synthetic

SEQ ID NO: 13600 - protein, 245 aa, Artificial Sequence
  Synthetic
SAAELVLELLARVVKLLEEVLKRLIDLHRDVLKKIKDVLDRDHELHERVLRELVKVLREAERRDEETVRRLLEEVRKAIERVLEESKKRLDEVVKDSRRVLEEVKELLRRVEEDIERVLREVKRSNNVEERILRDLEELLRRLIELLRRLLEEVRKINEEIIRLLEKLLRRNAEILRTLLRLAERDIDKREELEKRLRETLDEHRDLLRKLKEFLDRSLEDLERRVDEVRKELERVLEELKRKLK

SEQ ID NO: 13601 - protein, 245 aa, Artificial Sequence; identical to SEQ ID NO: 13600
  Synthetic

SEQ ID NO: 13602 - protein, 239 aa, Artificial Sequence
  Synthetic
KEVEDIERVLRKALELSKKVSDDLERVLRELLKLSKEVIEKLVRVLEEILELLKRENIGEDELLRRLEKRVRKIIRDAERTLEETKRELDRIIEESRRLNKRTAEDLKKLIDDVKRTRNDEEAIERLVRLIEKNLRLLEELVRRLSRLLEENLRKLEDIVRRIKELIKETLKLLEDAGVPEEDLRRVRELIKKVLKDLERVLKEAEDLHREVLEKLKDVVRRAAEMHEEVIRALKEVSR

SEQ ID NO: 13603 - protein, 239 aa, Artificial Sequence; identical to SEQ ID NO: 13602
  Synthetic

SEQ ID NO: 13604 - protein, 240 aa, Artificial Sequence
  Synthetic
DEEELLREIKTILDESLKALEELIRKIMRILDKSLKDLEEIVREIKKTIDELLEKVRRSGLPEEVLKKVKRVAEKVKEDIDRLLEDVERSHREVKKKLDELLKEVKRSHEEVKKELDSLRRDSDRDTVAREILRVLKKNLDVLREVVEKIVKVLEDNLKSLKRVLETLVDLLRKLIKVLREAGLREEALDDLRRLVKELKDKLRKLLKDYKDLLKELKDEAKKLLDDYRRLIEELEKKAR

SEQ ID NO: 13605 - protein, 240 aa, Artificial Sequence; identical to SEQ ID NO: 13604
  Synthetic

SEQ ID NO: 13606 - protein, 236 aa, Artificial Sequence
  Synthetic
SEKEKLDELRKLIEEIERELDRLLEDNKRAVEKVLRDLDRLLKKSEDDVRRVEEELDKDRVPEDVKRIIRRLLEVHREVLELVKTVIRRNLKVSEDLIRKVKEAVRELLEVIEKLKSREVLKRIREIIEKIKEILERALEESKRSIEEIKRIIETVDRRVKEIIKEVRDVIRRDVKDKDLAERIRKILDDLLEVHERVARAIEELLRELLEKNEEIVRTIKKLLKRLLDTLRKAAE

SEQ ID NO: 13607 - protein, 236 aa, Artificial Sequence; identical to SEQ ID NO: 13606
  Synthetic

SEQ ID NO: 13608 - protein, 235 aa, Artificial Sequence
  Synthetic
SKLETVIRILEELVKVHEELLRIVKKILEELVRVHRRVSEENLRLWKELLDALREDKGREDERVERIIEKAERLLREVAKRHEESIREIDRLLEEIARRAEESLKKIRDLLRKVKELAERGDSEKSIEDLVRTLIELHRRSVEEIRRLLEELVRIHRESIKEVEKLNEDESRELRKAGISEELLKRVEDVNRESRKVLEESLRRVEEALEKIERALRKSEEDIRRLMEDIKRVLK

SEQ ID NO: 13609 - protein, 235 aa, Artificial Sequence; identical to SEQ ID NO: 13608
  Synthetic

SEQ ID NO: 13610 - protein, 236 aa, Artificial Sequence
  Synthetic
SREEKIEKLIRLVEELLERLRELLERNAELIKRLLDRLRELLKELERLNEELLKKLLEKVDDEDLRRVLEEVKKSLEEVREKLERAVKEVKRLVDESRESAREVVKTIRDLLRKVRESEDKRDVVRVIEDIARLLDEILKENRRVNEEIVRLIRDVLRVIREVVKTNADLLREILRRAGGVRELEELIKKVERDHERVIKEVEKLVKELLDRSEEIHKRAKELIKEVLDRVREAAR

SEQ ID NO: 13611 - protein, 236 aa, Artificial Sequence; identical to SEQ ID NO: 13610
  Synthetic

SEQ ID NO: 13612 - protein, 237 aa, Artificial Sequence
  Synthetic
SREELLDRILEAIAKILEDLKRLIDENLRRLEEVVRELERIIDRNLKLIREILDELKKRGAREEILEKIKKVDKELEDLIRRLLKKLEDLIRETERRLREILKRIRDLLKEVKDRDKDLERLLEVLEEVLRVIKELAKELLDSLRKVLKVVEEVLRLLNEVNKEVLDVIRELAKDGEGDEIIRKLDELLKEVEKVHKEVKDRIRKLLEDHKRSLDEVKKKLERLLERAKEVVEREKK

SEQ ID NO: 13613 - protein, 237 aa, Artificial Sequence; identical to SEQ ID NO: 13612
  Synthetic

SEQ ID NO: 13614 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEKVKRKIEELLKELERSLDELRRALERIRKEIKDSETAVRAIIRVLEKHLEAVRRVLEELLKVLAEHLETVRELIERLKRVLEEAIEVVERVAR

SEQ ID NO: 13615 - protein, 246 aa, Artificial Sequence; identical to SEQ ID NO: 13614
  Synthetic

SEQ ID NO: 13616 - protein, 240 aa, Artificial Sequence
  Synthetic
DEERKLKELLDRLRENIRALRELIKDNLRLLKTLVDALEELLKDNLRLLRELAEEAARRLSEDALRDLKRVLDELKKVHDRVRRELERVLKELDEVHKEVKERLDRSLEELEDVIRKVKDERALLEALKKHVDVVRTVLKLLLDANKRALDVVRALLELILTVNKKAVDVLREILKRVVKNEKDVRELIKRVETALRESEEKLRRVAEELKKALDRSRKDLEEVVRRTEDLLRRLEEKLR

SEQ ID NO: 13617 - protein, 240 aa, Artificial Sequence; identical to SEQ ID NO: 13616
  Synthetic

SEQ ID NO: 13618 - protein, 240 aa, Artificial Sequence
  Synthetic
SEEETVRRLLELLKENIEELRELLKRNLDLLRKLAEELKKLIEELARITERLAEKLAKDLSEEVLKELEDVLRELKRVVEEVKRRLKKVLDELREVHKELKKELDKSLEELRKKLEEVSRKEDLTRALADHVRVVKEVLDKILEVNRKFLEDVKDLLRLLLEALEKALKELERLLRRVVDKEEEVRKLVEELRRAVKRVRDLLDELRRRLEEALRKSKRELETIEERTRRLLEDIKRDLD

SEQ ID NO: 13619 - protein, 240 aa, Artificial Sequence; identical to SEQ ID NO: 13618
  Synthetic

SEQ ID NO: 13620 - protein, 242 aa, Artificial Sequence
  Synthetic
SEEEEIVKRLKELIKRNLELLDKTLKELKKTLEDIIRTLTELVKRAKEINKELIDRLREKGVREEAEKKLRRSDEKLEEVVRRVKEKLKRALERLEEAIKRAKEKIKRSIEKLDKLVKDLRSEEMKRALKEVIDEHIKILRDIIRLLEEVVETIIRVLREAIKLLEELVERNIRVLRDIVRADKLEREDIRRYEEKLRKLVEEVKKKLRDLEERLRRLVEKIRKLLEDSERRLRTMLDEIRR

SEQ ID NO: 13621 - protein, 242 aa, Artificial Sequence; identical to SEQ ID NO: 13620
  Synthetic

SEQ ID NO: 13622 - protein, 246 aa, Artificial Sequence
  Synthetic
REKEEKVKKVREVVTELKRELDDMLRRVKEAHERLKKKHDDLLKEVREVHKRLKDRLDERGGDEAIKEVLDRHLKLVEEVVRANKEVLDRHLKLVEDVLRALKEVLDKVLKLVEELVRRRDEERAEDLVRRVVKEIDKLVKEIRKRLEDVSRDVRRLLDELRKINKRVSDEVKRLIEELRKRLSGGDEEIKKTIEEIIKVLRELNDKLRRLSEDTIRVLEELNKEIARLLEKLVRDTKRLLDELTK

SEQ ID NO: 13623 - protein, 246 aa, Artificial Sequence; identical to SEQ ID NO: 13622
  Synthetic

SEQ ID NO: 13624 - protein, 247 aa, Artificial Sequence
  Synthetic
SVKEVIKEVLDRVVKLIKDVIDALKTVLDRHLRLNRENIRALLEVLERILELLEELVRKSTDDRAEEVLRRVVTKIRELLERIKRESDKVSEKVRRLVEEIRRILKEAVDRIKKLVEELRKALEGIREEIADKLRKIEKKIKRILEELRKMLEELARTIEKLNKDDEDTVRKTVETIERILEEETRSTDDLEKLLRKVRKIAKELADELRKLHREVKETHEDLKRKLDKLLKDIRKVVEDIKREVDR

SEQ ID NO: 13625 - protein, 247 aa, Artificial Sequence; identical to SEQ ID NO: 13624
  Synthetic

SEQ ID NO: 13626 - protein, 233 aa, Artificial Sequence
  Synthetic
EKEELVEEILRRLKKMSERFSRVVEEILKLLEDSSRKVEEAIRRTIRELEKTLKRVEKDGKTDELLRDLKRVVEDIKRKLEELLRDHRRILEEIRRKLEELHREHKKILEEISRRLGTEDELARLIIEVLRKNNKALRDAAERIREVLKENHDALKKVVEDIVRVLEEALEVLTKLDSRELREAVKKVIADLEKILKDLRKLDKESLDKLREILKTLRDLDRKSLEELEEIRR

SEQ ID NO: 13627 - protein, 233 aa, Artificial Sequence; identical to SEQ ID NO: 13626
  Synthetic

SEQ ID NO: 13628 - protein, 245 aa, Artificial Sequence
  Synthetic
SREEKLREDLDRVFRKNEEELKRVEKEVKKLLDDSKRKLDEVKKELEDLLEKIKRLLDRPGTAELVERLIKELKDTLEKLADLVRDANRLIKELLDRLRELAERVNDDTRKTLETLERTLDKDDVIRKLREDVTRVNDENRRVVEKLDELVRDVNRRNEEVLREAKKRIDEVIRELEEIKRDRKDDEELLRALKEVVRKVIEIVRRLLELHRETVKELARVIKEILRLHLESIKKLLDVVREVLR

SEQ ID NO: 13629 - protein, 245 aa, Artificial Sequence; identical to SEQ ID NO: 13628
  Synthetic

SEQ ID NO: 13630 - protein, 237 aa, Artificial Sequence
  Synthetic
DEEEKVRRLKELLDRTLKKLKELVEEHDKILDELLKKLEELVRRHNKLLDDLLRRVEERGLDEEVLRRLREVVERVKRENRKVLEDIRRVVEEVKKKNRDVLKKAEDVIRKVKEDADRSRDKRMLVRLIEEVAEVLKDLLRLLKESDEEVIDALRKALERLERSSEKLAKVVRDVIREENLEEELEDTVRKLLETSKKLLDEAREVLERLHRRSEELLRRVEETLRRLEDEVRKITK

SEQ ID NO: 13631 - protein, 237 aa, Artificial Sequence; identical to SEQ ID NO: 13630
  Synthetic

SEQ ID NO: 13632 - protein, 237 aa, Artificial Sequence
  Synthetic
DKEDKLRKIKELIRKLLETIKRLVEEHDKELDETLKKLEDLVREHDRLLDETLKRLEERGLPEDVLRELKKAVEDVKRKNKRVLEEAERVIRDVKRENKEVLRTLKRVVEEVEDALDRTRDDKAVEDLIRKLIEALKEALDRLRRSDEKVVEVVRRLLKLLKDSSKDLADVLREVIRKTNEEEELERDLERLEKTSEDLLRRVKEEIDRLHERSKKLLDEARKKLEELLKTVKDIAK

SEQ ID NO: 13633 - protein, 237 aa, Artificial Sequence; identical to SEQ ID NO: 13632
  Synthetic

SEQ ID NO: 13634 - protein, 238 aa, Artificial Sequence
  Synthetic
SEREELARDLDDLRRRLREAAEELKKKHEKLRRELEELAKELRKRHEELKKELDDAARRGEPSEDLVRRIEEVIDDLHEKVRKIIEEIKRALDKLNEDVERLIREIKRVLDELLDKVRRRGLPKDVLKRLEDVLREIKEELDRVLKEHKETIKKVKDALDEILREHEEVVKKLKKELRDSKEEEVLKRILDKLMKVSEDVLRKLEDLLREVIELTKKVLDLLDELLKRVKKVLEEVMK

SEQ ID NO: 13635 - protein, 238 aa, Artificial Sequence; identical to SEQ ID NO: 13634
  Synthetic

SEQ ID NO: 13636 - protein, 240 aa, Artificial Sequence
  Synthetic
DREKKVRDIEEDLKRVLDKLRRRVETSKEELKKVLKRDKENADELEKTLRDVVRELDRKIDSEVLRAVREIVKRLVEVVRRYNELSEKIIRDLVRVNDRVLELLKRIVKRLIDVVRELEEIEDKEKALRRLEEVVKEVKRRIEELLKELEDVHRELVKILEEVNEDLKRVATEVKEIIKTIIKISEVAKELDEVIKRLLDNLKENTDRLKEVIDRNLKDLRDLAEELRRVIERLLEDARR

SEQ ID NO: 13637 - protein, 240 aa, Artificial Sequence; identical to SEQ ID NO: 13636
  Synthetic

SEQ ID NO: 13638 - protein, 238 aa, Artificial Sequence
  Synthetic
DKEEVLKDIKRKLDDHRRRTDEIVERLERLLKEHEEKTRRLLEDVRKKLEELKEIIKRKEQSEELLIKSVEELLRETKKILEDLIRHLDELVKRILDILRDLDRHLEELIRDTKRILEEGDAEERLLKKLEELLRRLLKRNKEALERLKRILEELLKRNRDALKRAEDELRKVLEDLRRRPEEEVLKRILDRIEELLRRLVKVNTDSLRELKRVVDELVKVDRESLRELERVLRELTK

SEQ ID NO: 13639 - protein, 238 aa, Artificial Sequence; identical to SEQ ID NO: 13638
  Synthetic

SEQ ID NO: 13640 - protein, 241 aa, Artificial Sequence
  Synthetic
SKEEEIVRELEKILRDHLRKVERIVEDLEKLLDDHLKKIEELAKRLEEIIREAARKLEEKGVDDKVIKKIRELLREIEEELRKVLEDVRRLHKKLREELRRVVKRIRDLHKRILDELRKDTREDAIRRVLELIKKVSREILELVKRVLEALRRISREVAKLLRRVLETIRRVLEEVVKEVEDEEVKELLKRVEKLIDDVRKKVEDLHRELEKALRDIDRKVKRLNEELERLVEEVEEKVKT

SEQ ID NO: 13641 - protein, 241 aa, Artificial Sequence; identical to SEQ ID NO: 13640
  Synthetic

SEQ ID NO: 13642 - protein, 233 aa, Artificial Sequence
  Synthetic
SESEELRRKLEELEKELRDVLTKDRKMLEDLKRRLDKLVKDSERRIRELKRRLDEKIKDEDVKRVITRLVEEIKRVNEEVKKALEDVLRELRKVSEDIARLLKRVIDDIRRVLEELDRTTDKETADRLLKRLKEIIDKVREDVKRLNDKLRELVDRVRKRVEELHTRLRELLKKLNLPREIVEELRKVIEDHERLVREILELLRKAIDDNHKLVRDLLERLKRALDETREDRR

SEQ ID NO: 13643 - protein, 233 aa, Artificial Sequence; identical to SEQ ID NO: 13642
  Synthetic

SEQ ID NO: 13644 - protein, 241 aa, Artificial Sequence
  Synthetic
RETEETLKKLEKLLRKMLEVSKRLNEEDEKLLRTKRKLIEDLLRRVEELLEETRRVVSNTTDERVLRRADEVLDEVRKIVEDVERAVEEALREVERVNEEIIRKNEELVERVKTVLERIRRIREKEKILRALKEVVEILKEALEENLKAVRKSIEIHRKVIELLVRLVERIVKILREILEEVVDDKDLVETLKRKLDKLLRDIRELAKDYKRKLDRLLEDVERLHRELKKELDELLKEVKD

SEQ ID NO: 13645 - protein, 241 aa, Artificial Sequence; identical to SEQ ID NO: 13644
  Synthetic

SEQ ID NO: 13646 - protein, 245 aa, Artificial Sequence
  Synthetic
SELEKLLTDLERVIRKVVEDLRRLLEEHKKALDEDKKRDEDSNEELADAIRKVIEKLKRTTDEEIIERALRELLKVATEVIKKNIESNRESVKVTRRVIKDIVEVVKRLIDVLRKVIKEIVRRDPRRDKAEKVRRLVEELARRLEELLREIRKLLEDSTRKVERLNEEVERLLRELAETVKELTDKRAREEDTKRLLEKIHDDHRKLVEENERLLREDHKTLEDLIRKIKKLAEEILELTARETK

SEQ ID NO: 13647 - protein, 245 aa, Artificial Sequence; identical to SEQ ID NO: 13646
  Synthetic

SEQ ID NO: 13648 - protein, 240 aa, Artificial Sequence
  Synthetic
DEREVLKEILDLVRRLLELALEILKRSLELLRRLAEEAKKVLDRSVELLRRLVREAKEAAKNPDERVKREVVEKAERVLEESKRRLTEVLERIKRVLEESKRLIKEVLDRIRDVIRRVKERRGEDKDVKKLLDLLRELLRELKELLEDHLRIIEEIIEKLKRLIDEHLEILKKILDRLRREGITDELVKEVEDRLRESEKKLERLLEDVERLLRENEERLRRLLEEVERLLRELAETLER

SEQ ID NO: 13649 - protein, 240 aa, Artificial Sequence; identical to SEQ ID NO: 13648
  Synthetic

SEQ ID NO: 13650 - protein, 241 aa, Artificial Sequence
  Synthetic
SEKEEVEKRLKKVDEDTKRAVEEVKKAIEEVLRRHEEASKRVEEAIRRVLKELEDLKEDESVLRRVLRMIEEISKEHIRVLEETLKLIEEIVKKVLDVLREDLDASREVVERVERAIKDEKTLRELREILERHERLMEEVLRRLEKLLEEARKFVERVKRENKKLLDDARDVIRRLEEARRDVDREELLERLKELIKRLLEALKRLDEEVSKLIDELLKRLEKLAKEVLDLNRELLERTRR

SEQ ID NO: 13651 - protein, 241 aa, Artificial Sequence; identical to SEQ ID NO: 13650
  Synthetic

SEQ ID NO: 13652 - protein, 244 aa, Artificial Sequence
  Synthetic
SDEERLDKVLKEAEDIIRELERLLRESLETLKRLIERLEKLLRDSLEELRRLIEDLARKRVPKEILDRLLTVHEETLRLLKEVLDKLLEVHKEILDELKKILEKLLRAVEEILRRLKKIRRERELEEVLKRLKKALEDIKRELEEVLRRDEEVNEEAKRDLDRIVERNERANREIEEELRRSNVPEDVVRMLKEVSRRDEELTRRLLRMAKKLLEDNEELSRRLVKKLDEVLKRVEEIIKRETD

SEQ ID NO: 13653 - protein, 244 aa, Artificial Sequence; identical to SEQ ID NO: 13652
  Synthetic

SEQ ID NO: 13654 - protein, 246 aa, Artificial Sequence
  Synthetic
SREERIRKLAEDLKRKIEELLRRVRKLAEEHKRLIEKILEESERLAEELKRRAEELKKRLDKEEILRVVDKLIKILKKLVDAHRRSLEKHLRVVDELIRRIEEVLKKLLEILDELIKLLENRDSKEVERVLREVLEKLERVIRELEKLLREVLKASEDISREDMKAIRDVLEDLKRVLDEIRKKGVPKEVLDELRRLLELLKKLVDRLLELNKRLNDHAKKLVEDLLRLLKKLLEEIKKLVDDARR

SEQ ID NO: 13655 - protein, 246 aa, Artificial Sequence; identical to SEQ ID NO: 13654
  Synthetic

SEQ ID NO: 13656 - protein, 236 aa, Artificial Sequence
  Synthetic
SEEERLEEEVRRELERYRRTVRRLAEEVKEELERYEREVKKEEEKLEKTLEDLERELTRDGLDRESAKETLRKLREDIRRTLKKNEDLLRKIEKRIKEVLDRNEEMLKRIKELVDRGNLDRDKLERIERLIKRLRELSKRVAEELERLIRELRKLNRRVLEELDRLLRELEDRLRKTEDKKTIAEELKRVLRELTRILRELVKLNSDVVRRLLEVLTRLAKLSEDVVREILEIERE

SEQ ID NO: 13657 - protein, 236 aa, Artificial Sequence; identical to SEQ ID NO: 13656
  Synthetic

SEQ ID NO: 13658 - protein, 245 aa, Artificial Sequence
  Synthetic
SEEEKLETVREELRRALERIEELITKNEKKIEDTLRDIRREIEENARTVKEALERIKKDGVDREDLKDIKRRYDEMLEKLKRELDEIVREIKERHERLRKELDDIVKRVEEKLRELRKKPNSEELIRELLEIVREALERIRRLLKKLLEANERLLKRIRELLDELLKANDKLVKDLEDILRKENMPKEKVDRTKEELERLKKEHRERVEETKRKLDELKKEHEREIRKTETDLRRLLKELADRAK

SEQ ID NO: 13659 - protein, 245 aa, Artificial Sequence; identical to SEQ ID NO: 13658
  Synthetic

SEQ ID NO: 13660 - protein, 247 aa, Artificial Sequence
  Synthetic
SEDEKLRKLVEEVERTLKKLIDYLRENVEDVDRILRRLKELIDRHLKKVRELIEKLLRGGIDRKELRDLKRRVEDLHRKIREELKELKKRYKELIDRIKEDAERILKEAKRKIDEIEKLDDDRKSLLKALEEIVRDLVRLIRELLRKLKEINKDLVKAIRELLEALLEIHKRIVDAIRDIVRRELREDKDTVREIEKDLEDSKRELERIKEEIEELLKRLEDKNERAIEEIEEDLKRLEERLREAAK

SEQ ID NO: 13661 - protein, 247 aa, Artificial Sequence; identical to SEQ ID NO: 13660
  Synthetic

SEQ ID NO: 13662 - protein, 248 aa, Artificial Sequence
  Synthetic
SEEEKLRKTEEDLKRTLEELKKILDDHLRIIERLLREIKRVLEENKRNARRLLEEIKRSGLDTEELKRIEEEYKRRLDEILRELRELVEEAKRLHDRIKEELDELRKRVKELLERIRRSDRDRKELLKELEDVIKEAVDAVRRLLDELRKVHKRLVDAVRRLVEKLKRINKRLVDLIREILEKMKKDLDERVLKRLEKELRDHLKRLEEIIKRLEEDLKKTLDELKRTIEDAERKLRDLERKVKEDAK

SEQ ID NO: 13663 - protein, 248 aa, Artificial Sequence; identical to SEQ ID NO: 13662
  Synthetic

SEQ ID NO: 13664 - protein, 246 aa, Artificial Sequence
  Synthetic
SILERLVRELIRLLRELLRIHKELVERVIRVLERLLEVHKKLVETIERLLDKLAELVRRGLPEKDLKTEIDRVKTELERVLRETKEEVKRLIEEIKRLEDDSRRRMKELVEEIERLIRKLEKDGTEPREKLKRAADEARRLLEELKKLHETSIDETRRILEKLKRVHEELEERTRRLDKRLEELARRGSDKREIEKVLREIKEELRRSLRELKRVLDEVKERLKESLERLRKLIEEIKERLDRIRK

SEQ ID NO: 13665 - protein, 246 aa, Artificial Sequence; identical to SEQ ID NO: 13664
  Synthetic

SEQ ID NO: 13666 - protein, 252 aa, Artificial Sequence
  Synthetic
SLEEITKRLLELVEENLRRHEEILRELLELAKRLAKEDRDILEEVLKLIEELLKLLEDNTSSEEDLKRLLKEVIEELRRVVKRVKDKWDEVVKRIEDLVKKLKELHDDTLRKLRELVRKIVTDIREKGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 13667 - protein, 252 aa, Artificial Sequence; identical to SEQ ID NO: 13666
  Synthetic

SEQ ID NO: 13668 - protein, 247 aa, Artificial Sequence
  Synthetic
SKIEEVLERAKEVLDRLLDLHRRLVKEIEDVLDRSNELLDRLLKELEKVLDELLDIVRRRSSEEVLEELRRILETLARRLDDALRKDKELVDRLEKSLEDVLRTSERIVRKLEKELEDVVREGAVRKEVVEAIVRLLRELVEINREIVKRIVELLREHNRASRRLVEEIKRLLKEILDVARKIVERTSEEALKELKERIEEIKKTLRELLKELKKLNREIKETIKELSERLARAVEKIKRELEKLRK

SEQ ID NO: 13669 - protein, 247 aa, Artificial Sequence; identical to SEQ ID NO: 13668
  Synthetic

SEQ ID NO: 13670 - protein, 241 aa, Artificial Sequence
  Synthetic
KAEEAVEKLVRIARAIVKINEDLSREVVRILREIVRLNEETTRLLVEIAREVVKVVEDAGLSEDVVRKLRKLVKELEDLLKKSNDDIRKLVEDVRRRLKESNDEIRRLVERLEELLKRLPDDEELLRLVEELTEELLRTHEEVVKALEKLTRDLLELHRELLERVRRLTKRIEEELKRVNVSEELLRRLEELRKRLEKVLDDSRKELEKLKRELERLLEESRRKLEKLKRDLERVLEETRR

SEQ ID NO: 13671 - protein, 241 aa, Artificial Sequence; identical to SEQ ID NO: 13670
  Synthetic

SEQ ID NO: 13672 - protein, 243 aa, Artificial Sequence
  Synthetic
DDRRILKLLIDIIRKLVKLNEETADKLIRVIDELLKMAEESLKKVIDLVRTLVEIIRRERGKRDLERVLRRIKEEMERIKREHEEALKEIEERLKRIVDEHERLLEEIERELREVEREADDKPQSERVKRLRERLRRILKEILDVSRKVLKDLKDLADEILEDSEEILKELERLIREILKVTAETDDRKVVEELLRKVEKLIKDIRERYERLVKKVRDLVERWKELVRRLLKKAEDVIREIEK

SEQ ID NO: 13673 - protein, 243 aa, Artificial Sequence; identical to SEQ ID NO: 13672
  Synthetic

SEQ ID NO: 13674 - protein, 236 aa, Artificial Sequence
  Synthetic
DEEDALRTIEELVKRVNEENKKILDESEDLVRRLNEKNERINKESRDLVKKLREDAEDLDDEELVKKIIDVIRRNLELNRRSVKLVIEVLERNLELNEESIRLVLKVLEEILEILRETTRSEKLKELEKIAKRIIEEIRKALEEAKELNKRIIERLEKVLREIEKLNKELEDLVRRKGAGDERVLKLVEDAAREDERLNRELDRATREVAEEDKKLNEDIDKTLNDVIRELLEAAR

SEQ ID NO: 13675 - protein, 236 aa, Artificial Sequence; identical to SEQ ID NO: 13674
  Synthetic

SEQ ID NO: 13676 - protein, 240 aa, Artificial Sequence
  Synthetic
SSVETIKKLVEDARKKLEDSIRKIEKLVRDVEKTLRDSLKRIRDLVEKVVRTLRELLREPKTEELLRRTRKLVREVLERLKKINKEVLDILKKVLEDLERIDKEVLDLLRDIIKKLEDMNQVDEKVIRRLRRLAEEIEKRVEDINRESRKKADDIRRKVEEINERSDRAAKEVEDEARRNDSDLEELVKRITDILREHVKMHEDLIRAIAKVLRDHVEAHKRLIKRITEILEEVVKAVTD

SEQ ID NO: 13677 - protein, 240 aa, Artificial Sequence; identical to SEQ ID NO: 13676
  Synthetic

SEQ ID NO: 13678 - protein, 242 aa, Artificial Sequence
  Synthetic
DTKEEIKKLVEELLRLIEELIKRTEELNKEDNEIAERVVETHSRILRDLLRSLEEVARTRDKRVVKTLDEKAREVVKTSDKLVDEWRERSERIVEEAERLVRKLEEDVRRVIDEIRRLTQREKLKKILDELKRLLEKVIKLLEELIRKHLELAERVIRLLKEITRENLEIVKEAIDALDAGLDDDELREVLDRIRERVKRSEDKLREVLERLKRDSKRIHKDLRKALEEAKKDVDEIRKETE

SEQ ID NO: 13679 - protein, 242 aa, Artificial Sequence; identical to SEQ ID NO: 13678
  Synthetic

SEQ ID NO: 13680 - protein, 238 aa, Artificial Sequence
  Synthetic
RREEELKRIIREIERILEELRRRSREIEEKLKKVLEEHERVSRRIKERVEDLKRKVRDKEKLVRRLAELLKEASDVNHKLIRDIARLLKEASEIIKRAVKRLSDLLEEVVRVLKDGNSDERLVDTARRLVEEIVRRLEKVVEEHEEIVERVVRRLEESNRKHRRLVKEIIDRLEDLVRRNVDEKDIERIVEEALKLHEDVHDENRRILEEAIRTHREVIKRLEEIVKEAIKLIEDVTR

SEQ ID NO: 13681 - protein, 238 aa, Artificial Sequence; identical to SEQ ID NO: 13680
  Synthetic

SEQ ID NO: 13682 - protein, 238 aa, Artificial Sequence
  Synthetic
SEKELLEEIEKRAEEVLREHDKRSEEIKRELERVLKELRDLSRKIEEDLERLVREVTDLEELVRRLVEIARRASKIIEDVVRKLAKLLREASEVIKKTVDKLVRLLEEAVRLLREGNTEEERVRDLERLVEEIVRRLEEIVRKHRELVRRIVERLREIVEEHKRIVEEVVKTLERLVENRVDKKDIERIVRELIKVHRDVLRKLEKVVREALELHDRVNKELREVVERALRLLREVTR

SEQ ID NO: 13683 - protein, 238 aa, Artificial Sequence; identical to SEQ ID NO: 13682
  Synthetic

SEQ ID NO: 13684 - protein, 239 aa, Artificial Sequence
  Synthetic
SEEEILKKIEDRLRAITEKHERMLREIKKELKKVMDEHEDLLRKIEKELRDVLERLRRGVDRKEVIELLARILEKVLELNERILRKLVKILKKVIDLHREAIRELLEVLEDVLRRLRGTDDDVARELERVVRELKEELKRSVEKIERAAREIEDLLRRVLEESKRLVEELKRRLRRIKDNNLDATLLERIVERARRELTKNHDKLRKILERLERILRELNEDLRRILTTAVDILRKLRK

SEQ ID NO: 13685 - protein, 239 aa, Artificial Sequence; identical to SEQ ID NO: 13684
  Synthetic

SEQ ID NO: 13686 - protein, 237 aa, Artificial Sequence
  Synthetic
REDEVLRDIERLLREIEEKIRRILEESTRELRKVEEEVKRIIERTKRELKKIKEDVERKGIDEELRKLLDEVLDKLTKLIERNKRSLERILELIKRIIDENLEVLRDIIRLLEELLKMTKDNRVPKDEVIKLVEDVVRRIEELVTRVVRRNEKLVKDLDDLAKKNVRENEELLREIDRKLDRDLLEKIKRVIREHIKALEKLARDLKEILRRHIEALKELARDLAEVIRKLLEDVKR

SEQ ID NO: 13687 - protein, 237 aa, Artificial Sequence; identical to SEQ ID NO: 13686
  Synthetic

SEQ ID NO: 13688 - protein, 240 aa, Artificial Sequence
  Synthetic
DLERLVELLKRIDDEAVKLVRKLVEVLKRIDEELVRLVEELLRALRRINEEVVRLVKRVPDKKKLKDRSEKLIREIEKLLDELRRRSEELLEEIRRLLERLKDESRKLLKRVEKELERVTDKKALELTDRWLKLHKEVVDRLAKLLRDWLRLHRRVLRELEKLTKEHLTEHERVVKILEDGRREEELLKRLRRIVEESKRRVDELLKELRKISEDVAREVERLLRELERISREVKRRVEE

SEQ ID NO: 13689 - protein, 240 aa, Artificial Sequence; identical to SEQ ID NO: 13688
  Synthetic

SEQ ID NO: 13690 - protein, 240 aa, Artificial Sequence
  Synthetic
SDEEVARELSDIVRKLVERNKESIEDAMRIVKELVDRNKKVTEDVLRLLEKLLEDVRDTPNDEELLKRVEEIVRRIAKELDDLVKETRKIVEEVEKRLRDDVKRTEDIVRELVKRAEEVNRTEKVEEAIKKIIRLLEEHVRIIREAVERIIRVLEKHVRIIEEIVRALITLARRIVELIARNGSEEFLRRLKEEVRKIVEKVKRDLERSLKELERILEEVKRMLERSLRELERVLKEIKD

SEQ ID NO: 13691 - protein, 240 aa, Artificial Sequence; identical to SEQ ID NO: 13690
  Synthetic

SEQ ID NO: 13692 - protein, 231 aa, Artificial Sequence
  Synthetic
SKEEILRELEELSRRLVEKLKDLLRKLEKLSDEVVKELRKSLEELKDLADKMVKKLGDSEIARELLKVVEEHVKLLEEILERLKTVSKDIVRVVDRIAKKLLEVTKEIVELVKRLKTDKDALRELERKLEDVHRRIREELKRLLDRLRDLHRRLKEILEDSKRKLEELLTRANSDKRLLEEIVKLLRDVAKRNLDLLEKHRELLERALEEVKRLLDEHLKLLRDALRRLKK

SEQ ID NO: 13693 - protein, 231 aa, Artificial Sequence; identical to SEQ ID NO: 13692
  Synthetic

SEQ ID NO: 13694 - protein, 237 aa, Artificial Sequence
  Synthetic
SREDLLRKLKELIETILRKSSELLDRLLKLVREHSETSERLIRELKKILEDILKLIKGGISEDDVRRIVKEAKDELRRSVEEVKKSVDDLKEELKRSLREVRELVKRIADALEEIVRRSSSLREVIKKLLELLRRLLEVHERTIRLLAELLERHLEVHEESIRLLLRLLEELLELVERKGDEKELRRIKEAVERVLRDHKRKNDKILRDVEEVLRRHLEELRRILKDVKKVLDEARK

SEQ ID NO: 13695 - protein, 237 aa, Artificial Sequence; identical to SEQ ID NO: 13694
  Synthetic

SEQ ID NO: 13696 - protein, 237 aa, Artificial Sequence
  Synthetic
DDEELLKRLEDLDERLLRFSKENLEELRRRTRELIETSETLLERLREIIETILKVIRDGARKEEVKKLVDELERVLEESLREVKRLVDELRETLKKSLEDVRRLVREIEEVLDKIVEDSSRLKDVIDKLREILKRIADIHEESLRRLVELLEELLRAHERSLRKLTELLRRLLEAVRQGGPERFLEEIAERVERILKEHRELLKRIEDEVRRVLTEHKKKLEKLKREVERVAEETKT

SEQ ID NO: 13697 - protein, 237 aa, Artificial Sequence; identical to SEQ ID NO: 13696
  Synthetic

SEQ ID NO: 13698 - protein, 237 aa, Artificial Sequence
  Synthetic
KETDEVVKRAKELVDTLLKVIKEHVERLKRLVEELLKVIRDHVRILRELAKRLREKVVKSEIADEVEKIVRDVARENERVVERIKRLAERNARSNDEVVRRIEELVDRLAKLAKKLDKKELLDTLKRITDEAIRLVEELLEENKRSMEELIRLVEDILEKNRRVEKKIIDLVRREPTTSDVERVLEELRRRLEKSVEEVERVLKRLKEELDKSVEEVKDVLRRLLEDLKRVVEELRR

SEQ ID NO: 13699 - protein, 237 aa, Artificial Sequence; identical to SEQ ID NO: 13698
  Synthetic

SEQ ID NO: 13700 - protein, 240 aa, Artificial Sequence
  Synthetic
SEEERVLEEIKREIDRIVKRARELLEKYRELVERIKRRNEEILKKYEKLLEEIERLADAGVPKEELLKLLREISKEHLKVLKELLDLVKELSDVSLEALKELLEELTRIVKEVLKALRRADIPEVDKVIETLERLLDELREVVERIIKRDADLLRKIEKVVRDIIETDKKLLEELERLIRAGVQERDLKRALRRHAEELTRLNKELNELLKEHEDELRRLLAELDRIVRKLLRTLKELTE

SEQ ID NO: 13701 - protein, 240 aa, Artificial Sequence; identical to SEQ ID NO: 13700
  Synthetic

SEQ ID NO: 13702 - protein, 236 aa, Artificial Sequence
  Synthetic
SKEEEAKRVIDELREELRRILRENTELVKESERRITELLKENSDLVEEVRRRLEEVLEKERDEKIKRLVELVEELLKRHNDIVRRLVKLHRDLLKRHNDVVRRLIELLDDLLRKLVEAIERGEDEKRLRKLLEDARRRIEKLERESREELKEVHERLKKLADDSRRLLEDVKRKLEEEGTREDLKRLVDDVLRLAEESHRKIEELNRRTLKLMEDSHRKLKELVRKALELITELTR

SEQ ID NO: 13703 - protein, 236 aa, Artificial Sequence; identical to SEQ ID NO: 13702
  Synthetic

SEQ ID NO: 13704 - protein, 242 aa, Artificial Sequence
  Synthetic
DSIERLAEELDKIVTDVLRVNEDSVRTWTRILEEVLRLNRELARILIDIARRVLELVKRKSPEEDIKRLTEELKRVLEEYERRLDRLTEEARDALREYERRLEELKERLRRALDRARKDVDEEVEKITRETEKELERLTETHKELVKTLEELLRRIVDDTARVIKEILDLLKELLDMTRELSEKELLDEVRRLLKRVKELLKRSIDLVEKILRDVKRLLDESIELVKRVLDKIRRLLEELAR

SEQ ID NO: 13705 - protein, 242 aa, Artificial Sequence; identical to SEQ ID NO: 13704
  Synthetic

SEQ ID NO: 13706 - protein, 239 aa, Artificial Sequence
  Synthetic
SEEDEVLKTLDRKHKEAKKELDKVLRELEEEHKKVKRELDEVLKRLEDIHRRITELLRRGDIRLEDVLRMVKEANRELVEVIKRIVKTVEDLNRRAVEVVKRLAEELERLNREMVKVLRKSGREEEIEKDLRRSSKDIRRLVEEIERRLRDSLRKLRKLADDLAKKLKESLDKLEELVRRGVDEEAVERVLKENKELIEEIVRLIRKILDENIELIRRIVRLLERLLRENLRLIEEARK

SEQ ID NO: 13707 - protein, 239 aa, Artificial Sequence; identical to SEQ ID NO: 13706
  Synthetic

SEQ ID NO: 13708 - protein, 248 aa, Artificial Sequence
  Synthetic
SKEEDVRRLIEELVRELRRILEENRRMLKELVEKLEEVLRRSEEVWRRLAKELDELLKELNRDVVREAVETIRRVLEDLVELDRRVVKVIKEVLERHAKSSTELVRELEDVLRAAVEAIEKVKREEDLKRELRKLKERLKKVLKRHDDTNKELFRELEDVLRKHEEELRRLADELRRLLEDLKRKGDIPEEVIKKIEDLVRKTERELREVHKELRRLVEEAKEVVDRSVEILRDLVRKIVRILEESAR

SEQ ID NO: 13709 - protein, 248 aa, Artificial Sequence; identical to SEQ ID NO: 13708
  Synthetic

SEQ ID NO: 13710 - protein, 249 aa, Artificial Sequence
  Synthetic
STEDELRKIKEELEDIRRRIEELDKKDNEDLDRIDEEIKRRLDKNIRDLDEIAKEVRKRRQDKDLLKEIVERLAEVLRHHVRVTADVVRLLAEVLKHNNELLKEAVRLLTELLRKILKVLKDAGKPEDEVRKLKEELEEIERRLRELVERNRRLSEELIRRAEKNVEDVRKKVEDLIREAEEVVKANLPKEELAEITERLLKKYREVAEENMRSLKELLREYREVNTRTHKALERIIDRIREILEKVRK

SEQ ID NO: 13711 - protein, 249 aa, Artificial Sequence; identical to SEQ ID NO: 13710
  Synthetic

SEQ ID NO: 13712 - protein, 233 aa, Artificial Sequence
  Synthetic
KEKEAIKEVAELLKRLIDDLLRLLKEDVDTARRVLDEIKKLLEENERIAREVLRRLREDKGKERAEELVREWIERTREILKRIEELLRRWTRKTREILKRIEELVRRVIEVVRRLDVPKELVDKLEEVLRKLLKLVEDHVRKVEKIIRELLKLIKEHVEKVERIARKLLELLRRNRDETDLDRIVKEMEKVLEDSIRELEKLVKRLEDILRESEKALRDLLRELRKVLEEVRT

SEQ ID NO: 13713 - protein, 233 aa, Artificial Sequence; identical to SEQ ID NO: 13712
  Synthetic

SEQ ID NO: 13714 - protein, 230 aa, Artificial Sequence
  Synthetic
SSMETAVKLVKDLLREDIRSNEEHVRLAKKLLEEDIESNERLLRILKKLLDLVEKTEDDEKLRKDLREVLEELRELVDRNKKRLEDVLRESERLATENKKRLERVLRELERTGLEERVLREVRKLLEELKELNDRTLEETRRLLDRLKKLNEEILELLERLLRRLEKLRKDKSDREELRRVAEEIKRRAEELLRRTEELVRDILRRHEDALRRTEELVRRIEKRLRDATR

SEQ ID NO: 13715 - protein, 230 aa, Artificial Sequence; identical to SEQ ID NO: 13714
  Synthetic

SEQ ID NO: 13716 - protein, 247 aa, Artificial Sequence
  Synthetic
RELEDVLRMIEELARRLVEILERHNKLSKRVIELLVRILEEHLKLVAELIKKAVEILRRILREDGKLAEEVIKRLEDAVEESKRNVDETKRKLKEAVRKDNELVKTVKEILKRVVDTVRELVKNNGDKEEIIRLIREMLKKLEEILRESEKLLRDLLEEAERSLEENIERLERLLEDLKRIIENANVRDDIRKLLKELLDDVKKIIDDSRRLLDELRKELEKILKESEKLVDELREAVDRLIRKVRE

SEQ ID NO: 13717 - protein, 247 aa, Artificial Sequence; identical to SEQ ID NO: 13716
  Synthetic

SEQ ID NO: 13718 - protein, 237 aa, Artificial Sequence
  Synthetic
SREELLKELRKLVEEIKRRSEELLRRLEKLLEDNERRTRELLERLKELLREIEERIRGGRPSEEVIRLLEELVRAIERVLEEHLESNRRLVEAAERVLREHVELVKRLVRAIEDVVEKELEEDKIRTIKKLLDEWRRRLEKLVRDVRRKLEEWIKRTEEMIDEVRRLLEELKETIRRKGNDRDIVRELTELVRRLLKRVEELLKRSLEILRELIKAIADAIKESLDILDRLLREVAR

SEQ ID NO: 13719 - protein, 237 aa, Artificial Sequence; identical to SEQ ID NO: 13718
  Synthetic

SEQ ID NO: 13720 - protein, 242 aa, Artificial Sequence
  Synthetic
EEEEVLRRLRELIERLVRETEEKLKEIERRIEEVLERHRRALEELKKEIDEILEEAERRKEKVEDVVRELRRIAERLLEINERSLELLRRILKALEEIVTRHLDTLRKIAEEIIRAMRDSEKAKKLLEDLRRLVEENKRRVDELVKKVERVVEEIEELSRRLLEKLERVLKEIEDVAREGTSEEALRRLVEKVKRVLEEILKVSEEVLEKVKKVLTDILKRLKELVERNVRLLERILDEARR

SEQ ID NO: 13721 - protein, 242 aa, Artificial Sequence; identical to SEQ ID NO: 13720
  Synthetic

SEQ ID NO: 13722 - protein, 241 aa, Artificial Sequence
  Synthetic
SKIEKLLRVIKKIIDKLEELLKRLLEVVRESIELLKRILDELLKVVERTADELRRIVNDKRLLEIIEDLVRRVLELHERTIDDVRRLVKEVEEEWKRVIDELRKLVKKLEDIVEEARKSEDLETVLRLVEELTRRIEKTTEDLERRHEKILKEIIDLIRENLKRHEDITREIIKAIEKLPTTKDLERLLRKVKEDNDRVKKEVERLLKEIEDRNRKVVEEIKRRLEEIKRELDKVVEEIRR

SEQ ID NO: 13723 - protein, 241 aa, Artificial Sequence; identical to SEQ ID NO: 13722
  Synthetic

SEQ ID NO: 13724 - protein, 241 aa, Artificial Sequence; identical to SEQ ID NO: 13722
  Synthetic

SEQ ID NO: 13725 - protein, 241 aa, Artificial Sequence; identical to SEQ ID NO: 13722
  Synthetic

SEQ ID NO: 13726 - protein, 238 aa, Artificial Sequence
  Synthetic
KDEDKLRRIVAVLEDLIRLTEELAKILKRVTERLKELTEELKRRNEKVVEEILKLLRDSGLQTEDVTRKLKKIRDDYKRITDKLREDHERIREELEKILERLKREHERIIRTLEEISRKLRGEELVDTLLRLVEEVARINVEVLERLIEIVERLVEINRRVLEEILRLSAKLAEDLDRSIGDEEVVRRIRELATKNLDDNRKALEESRRIIEEIVKRIKDVIRTSREIIKELRKEIRT

SEQ ID NO: 13727 - protein, 238 aa, Artificial Sequence; identical to SEQ ID NO: 13726
  Synthetic

SEQ ID NO: 13728 - protein, 231 aa, Artificial Sequence
  Synthetic
KEAEELVEVVRKHIKTLAEIWKKLVDALRKHVEILRRLLKELVEVIRRAIERVRRDGIPEEVIRDAERVLRRIEELIERLLRENERVIREVEELIKRNLDENRKVVEDLKEVVDRNGDKRELTEIVRRLLKSNKRVAEEVVRLTERLLRENKKITDELVKIVEDLLRRITKTRGRTERLDTVLEELRRVLKELERKLRESIKELRDVLREVEERLKESIEELERVLDRLRR

SEQ ID NO: 13729 - protein, 231 aa, Artificial Sequence; identical to SEQ ID NO: 13728
  Synthetic

SEQ ID NO: 13730 - protein, 239 aa, Artificial Sequence
  Synthetic
SEEEIAERVKDLIRRVLEEHERSVKKVEDLIERVLREHRRVLEEVRRLAEELERRLGDEKLVRAVRKIAEDVVDIIRKILEIVRRTVELMKRIHKKVLDIVRKLVEDVLDILKRREREESVEEVKRRVERENEKLKREVEKVKKEHRDALERLAKEVDDVLRDAKRFLEELEKDVSNIEDDRRKDDLRRVLEELLKRLKELLEELKRINEELLKTLEKLARDNLEINKELIKRLDEETR

SEQ ID NO: 13731 - protein, 239 aa, Artificial Sequence; identical to SEQ ID NO: 13730
  Synthetic

SEQ ID NO: 13732 - protein, 246 aa, Artificial Sequence
  Synthetic
SEEDVLRKLEEIVEELERSNRDAVRRLEEVVKRVEDLWEEVVRRLRELVREVEERLRDVEAKEVVEELVKVLEEAVRIVEKALRDHVEVLRRVVEKIADLLRRNVDVLRRVVEKLKRILEARRRVDEKEVRKRLDDIRKELEDVLRETRKTVKKIEDDLRRVHKRLDEIIEDLKRRLKEVLKRVEEKGVKKKEIEEIIERVLRLLAELLKRVKRISEDLKRLLDELIEENADILRKLDELVTRDET

SEQ ID NO: 13733 - protein, 246 aa, Artificial Sequence; identical to SEQ ID NO: 13732
  Synthetic

SEQ ID NO: 13734 - protein, 251 aa, Artificial Sequence
  Synthetic
DKERIIKRVLDELKEALKKAEKLHEDVLRELRRLLDEALKLHEDVLRELEELLRKIESTLEDEKLKKKLRDVKRDIDRLVERNRRLLEELRKRLEDLVRRNRELLERLKRKLEELDRRIKELEERGTPREELLERVAEIIREILEDIRRVVTHLRKSIRDILKEIREVVKHLVEVIRDIARRITELLAEDRNREKVEELADEIRRVVKRIEERHDKLRKDIERLVRRIEELHKRLLEELEELVKRITEELK

SEQ ID NO: 13735 - protein, 251 aa, Artificial Sequence; identical to SEQ ID NO: 13734
  Synthetic

SEQ ID NO: 13736 - protein, 231 aa, Artificial Sequence
  Synthetic
SVLETIVDIVRKLIELIEKLLRDLLELDKRNVDAVARNADKILKIAEDIVRTIASKGVPEEVKRRLEEILERIARLVRESKERLKRNNEELEKLVRKLEKELKEVLDDVKRVVDAGEDKDDALRRILELLDRLLESIKRVLKEITDSNKRLLDEHERVSKELIELLREMAERVNLDEDLKRELDRLIKEIEESNRRLKKTTKDLVDEVERILRKIKDDIEDVKRKIEEDKR

SEQ ID NO: 13737 - protein, 231 aa, Artificial Sequence; identical to SEQ ID NO: 13736
  Synthetic

SEQ ID NO: 13738 - protein, 245 aa, Artificial Sequence
  Synthetic
SEDELLDRLDESVKEVLDRHRKLLEDLADTIRRVIKKVKDLLDEHKKTLEDVIEKVLRRGIDVEELEKVKDELEKAHKKLEDDLRRILEEVKRLVEELEKHLKRIEDEAKKAIEELRRREPDKELLDRALEAIDRLLKLLTENIKRIEEIVKELLDRLKRIVDELLKVSERVVDLLRKIVDKLDTDETVVRDLRRLLEELRRISEEIVRDLRRLLEELKKIVEDVVRESKKLLDDLRRIIDETVR

SEQ ID NO: 13739 - protein, 245 aa, Artificial Sequence; identical to SEQ ID NO: 13738
  Synthetic

SEQ ID NO: 13740 - protein, 243 aa, Artificial Sequence
  Synthetic
SRAERLADEVRKAVKKSEEDNETLVREVEKAVRELKKNNKTWVDEVRKLMKRLVDLLRDNQVRDRDLLKELEEVLRRVLEALAENHERTEEILKRWLDRYREDIERLRKVLKEVIEALKREGRDDKRIVDELEEILRRNEDVLDKIKKRLRRLLEEDRRLLERIVRELKRLLDDLDRITKELKSEELVRIAIEVLKRLLEIIEELVRLNNEILERLLKIVRELHKDNIKILEDLLRIIEEVLR

SEQ ID NO: 13741 - protein, 243 aa, Artificial Sequence; identical to SEQ ID NO: 13740
  Synthetic

SEQ ID NO: 13742 - protein, 236 aa, Artificial Sequence
  Synthetic
SEVETLIRLIEENLRLLKEVADLSLEVIERLLRILKEIVKRSLDVIRRLLKLIEEVLKDRRLVERAKKEIDRLLEENDKLLKEVEKVIKELLEENRRLVTRVRRMNEELLRLIKENRKRKDDLLRELKDLNRKVLKALKESHDKLKRALEEVLRVLTESHKRLEEVLKEILDELRRRGVEDERAKKRLEDLLREHREILKEVVKRLKELLDRHRKLLDEARRESKRVLDEIDEKTK

SEQ ID NO: 13743 - protein, 236 aa, Artificial Sequence; identical to SEQ ID NO: 13742
  Synthetic

SEQ ID NO: 13744 - protein, 236 aa, Artificial Sequence
  Synthetic
SRVETLIRVVEKNLELLREIVERSLRVIKKNLRLLEEVARLSLKVIKELLEEIKRRVRTEDLLRDVERKIRDLLRKNEDLARRVREINETLLEENRELLRRAEKVNKRILDLIRNNEKPSEVLARELEKVNREVLKALEESHRKLRKVNKEVLEVLKRSHDETEKVLREILTELRRSGNEDRRVKEELKRLLEKHRELLKEAVKRSEDVLKEHKEVLDDVRRESEKVLEELRRAET

SEQ ID NO: 13745 - protein, 236 aa, Artificial Sequence; identical to SEQ ID NO: 13744
  Synthetic

SEQ ID NO: 13746 - protein, 245 aa, Artificial Sequence
  Synthetic
SEKDEVTRRIRELLKEAEETNREAIERIKRLLDRVREKVEEVAKRSEELLRRLKKVLDRDLQDDEALLKLLIDALREHNRLSTELIKILIDVLRTILKIIKDVLATNIEIARRILDLVRRLAERAGLDDRLVKEVEKLVRTAERLHRDALRKVKRLVEELEKRLRELVKTDHDLVRRLETLLRRKERRKEDLLREIARILRESLRLIRELLKEIEKIVKEIIELLERLNDELRKIIEKILETTKK

SEQ ID NO: 13747 - protein, 245 aa, Artificial Sequence; identical to SEQ ID NO: 13746
  Synthetic

SEQ ID NO: 13748 - protein, 231 aa, Artificial Sequence
  Synthetic
SRKELLKKLREVLETNLKLIEDLVRDIERALEEDRKLIEDLLRRIEEVARRILELRERGGSREEDVIREAEKIAERLKELVEKLADDSRRIVEELKKRIKELLRRSEKLVEELKKDLREDEKLLKLIEDLLRVSRRVIEALLEIVERLLEVSERVMRAIKKLIDDLMKVLRAGVEDKRLREVIKRLIEELRRLLKEYEDVLRKVREDLKKLLEEYKRVLERVDEELRKRDK

SEQ ID NO: 13749 - protein, 231 aa, Artificial Sequence; identical to SEQ ID NO: 13748
  Synthetic

SEQ ID NO: 13750 - protein, 243 aa, Artificial Sequence
  Synthetic
DEEKRVEDVLRRVEDLLRKLEEEHRRIVKRIRDELRESERKIEELVDRLRKEIDRIRKTRDDRSSVVTELIKILEEVVRAIERIVERNIEILDRIVKLHRELVKRTIEILREAVKLVAELADSEDAKRILKKLKDIVRALEEKLRRLNKEVEDVVKKLEDDHRRLVERVRRVVDELRELLERNTVRKEDLLRRTEKVEREIRKTLDDLHERTRRVVEETLRKNEELLKEIKRVVETILDEIRK

SEQ ID NO: 13751 - protein, 243 aa, Artificial Sequence; identical to SEQ ID NO: 13750
  Synthetic

SEQ ID NO: 13752 - protein, 234 aa, Artificial Sequence
  Synthetic
SKKETLVKLAEEIIADIHRVNRESLELIKRLIERVEKLTKESLDSIRKLIERILRDIDDEEVVERIERLLKKLLDENEKIIREIRELLDRLKKANEKVNEEIKKLLDDLKKELRDATDEETAIRLLVDVLRKILELLKRLSEINVRVLEEIVRLIRELSERNKRVLEDALRLVKERVDSDEVREIKEKVRELIDKDRRLVKEIEDLAREILDTDRKLVKRLEEVVRELIERARR

SEQ ID NO: 13753 - protein, 234 aa, Artificial Sequence; identical to SEQ ID NO: 13752
  Synthetic

SEQ ID NO: 13754 - protein, 236 aa, Artificial Sequence
  Synthetic
DEERVLTEIEKLVKRLKDRNDEIRRELEKTSKRLEEELERIERELDRLVEELKKELERTKDKDTIVRLIIDVVRKLLKLLEEILRLILRVIERHIELLRRLMKENIDVIKRILEELAKAADSKILEEIRRLLTEWIRKSKEIADEVDRLLKEWLDEVREIAEEIRRLAEELIKRIKDRRSDKDLEDLIRRVLTRVKELARRLDRKNKELLKEIERLIREDKETADRVKTEIKKKTD

SEQ ID NO: 13755 - protein, 236 aa, Artificial Sequence; identical to SEQ ID NO: 13754
  Synthetic

SEQ ID NO: 13756 - protein, 248 aa, Artificial Sequence
  Synthetic
DEEELVRRVEKLARDIEETLERLVKELERLYREIEKELKRLVKELEDANRRIVKRLKDLFDKKAPLERLVREVLELVKEHLKLVEDLIREVDKLNERLAEANEKLIREVLKLLKELLDIIAESVDSRKLEELERLVREVIREVAELLKRLKELHDKVSKDIRELLKELRRLHEEVIKTIKKLLDERMPDEEVLRRIEKLNKELEDVLREVEERIRKLLRELEEVSRRVTERIKRLEDELRKAFEEVTR

SEQ ID NO: 13757 - protein, 248 aa, Artificial Sequence; identical to SEQ ID NO: 13756
  Synthetic

SEQ ID NO: 13758 - protein, 236 aa, Artificial Sequence
  Synthetic
SKKEDAIRKARKLLERIRRLADKAIKRSRRLLERVRELVKESLDILRKLLERLRDLVRKIKKDGKREVLKELIRLLEELLKINKRVLDSVIELVERVIRSNEDVLRKVIRLVEELIRLVEETTDAKKLRDELRRLKEELKDIARRNRERLKRLEETLRRILKKSRDDLKRLLDEAEKKDITDELRRLTEEILKLHEESVKKLEDLTKEALEASEDVHRKLEKLTEEILRRTEEAEK

SEQ ID NO: 13759 - protein, 236 aa, Artificial Sequence; identical to SEQ ID NO: 13758
  Synthetic

SEQ ID NO: 13760 - protein, 238 aa, Artificial Sequence
  Synthetic
KEKEEADRELRELKREMEDILREVEKELRELLKKSEELLEEIERLSKELTDEAREVERNNLPEDELATELLKVIKKILDVNRDVVRKHEEILEDLERVLREVVRKLLELIRKLLDVIRRRVDSEDLKRVEELIREIEETIKKLLRELEKLIRKVKKRTRELLKESEDLIREVLDVIEKNKDLRELARKLLKRLKELNDRILETLRRLNEETARLVKEVLDTARRLLEELIRVLDETRT

SEQ ID NO: 13761 - protein, 238 aa, Artificial Sequence; identical to SEQ ID NO: 13760
  Synthetic

SEQ ID NO: 13762 - protein, 247 aa, Artificial Sequence
  Synthetic
SKEDRLREILTELKEVIDTILRKLEEDARRLKKAHEESNEKLKRIVEDLERVLRELLRKLKERVDERLEEEAKRILTEVRKELKKIEEEARRINKEYEDDVRDIERKVERIKEKLERLVERIERSDRDEKELIEEVIKVIEDVLRLIEELIKEWIRVNEKALELDRRLVEEVKRVIERLLRAIERLISKGNKELLDKAKEIVDRVTEEVERILEENERLWRESIKDVKRILDEAREIVRRLLEEVRK

SEQ ID NO: 13763 - protein, 247 aa, Artificial Sequence; identical to SEQ ID NO: 13762
  Synthetic

SEQ ID NO: 13764 - protein, 233 aa, Artificial Sequence
  Synthetic
DESEKVKEILERIERSLREVKRRVDEVLKRIKELLEELKRRHDESVKELKRILEEIRNSDKEAVKRVEKREREIIKRDIEVNERVLRELKKLLEELKKVLEENLKRLKELLEELDTTDDIRREVERLIKENRELIKRVEEEMRKLEETLRRMAKEYKREVDELEERARKSNLDGEELAKTLEKLAKELLDANRRLVDTSVKLVKRLLEIVAELVERHKESNRRLLKLIEDRDR

SEQ ID NO: 13765 - protein, 233 aa, Artificial Sequence; identical to SEQ ID NO: 13764
  Synthetic

SEQ ID NO: 13766 - protein, 236 aa, Artificial Sequence
  Synthetic
SEEDILRRVVEELERLIKEAKEIIEEIRRLHEELDRKSEELLDRLLELLRDLLRRLNVDDERLRRALERVEREIKRLKDEYKENNKRLEEEVERLKKELDDALERLKRELDKLKRDKDALAKLVKELLDVVREVVEALKRLSTHNVEVNEKLDRDLVRLWEEAVEVIKRVLRERLSDKDKVRRLDELVKELLERLRRLHEENTEEVERVLRESARLLDDLLRKVEEVVEKIKEELR

SEQ ID NO: 13767 - protein, 236 aa, Artificial Sequence; identical to SEQ ID NO: 13766
  Synthetic

SEQ ID NO: 13768 - protein, 237 aa, Artificial Sequence
  Synthetic
SREELVKDILRLLTESNDEHKKLSDKLVDLVRKLIELAEKLTEEVVDLVRRLLEELNLDEEVLRRLKEILEKLRKDNRDVLEELKKVLEELKEANAEVHRRSERLLRELKKRLDKVKGEEAVKLIEDVLREHSRLLEESVRRNERVAERLVELLEDLVDKNRRVLEELVELIARALDSEDAKELLKKVKEIVDELVRRHKKLVDEVREVVERVVREHRELVKKDRRLVDEVLKRLRT

SEQ ID NO: 13769 - protein, 237 aa, Artificial Sequence; identical to SEQ ID NO: 13768
  Synthetic

SEQ ID NO: 13770 - protein, 237 aa, Artificial Sequence
  Synthetic
SREDLTRETERLLRESNEKHKELTKEIIRLVDRLIKLLEELTERLKELVKELLKRLRLDKEVLDRLREILKELDEANRTVVDTLRKVLKRLKEELDRVHRESEELLRTLRDLAERVRGEELVERITRALETHSELLERSVELLKRVLEELVKLARELVKRNEDVLRRLVELVERALDSEDAKKLVKEVRDVVERVRREHDKLVKEIEKIVRDIEKKLRDLVREDRELVKKIEKKLRD

SEQ ID NO: 13771 - protein, 237 aa, Artificial Sequence; identical to SEQ ID NO: 13770
  Synthetic

SEQ ID NO: 13772 - protein, 239 aa, Artificial Sequence
  Synthetic
SAEDLVRRVKDLVDKLEDKLRKVVRTNERLWEEIRKRLEELVRRNKELWDRLVEKLKAGDKDKDELIEEAKRLEDESNKLVEKLVRDIERVLRESNKLLDTLAKEIEEVLEEIVELVEREGLADKKAREKLEDIKRRLKEVLKKLREESKRIIDELRRLLEEYKRLVKEIRDRIEEVRKRNSEIRVLVELVRRHNKVLKELVEELEKLVRDHNRVVEEVVRELVELLRRAVEVIKEVVK

SEQ ID NO: 13773 - protein, 239 aa, Artificial Sequence; identical to SEQ ID NO: 13772
  Synthetic

SEQ ID NO: 13774 - protein, 253 aa, Artificial Sequence
  Synthetic
REKEVIDDVRRMLEDLLRTIRRVIEENKRIVKESSDHIREVLKRVLEVLRRLLEEVKRLTERPVDEEDVKRTAEELLRILEEVVKEVEDAVERNRRLIEESIKELKRIADELVRRAEAVIEKVETELGRESEKVERIVRIIEEVIEAIKRIVKSLVEINEEYVRLVEELVKDIVDIIRRVAKLLKELADSRRDRKDVERELEKIIREVEERLRRVKEKLDDIDRRAKELHEEVMKRLEELVERIRRLLEDVER

SEQ ID NO: 13775 - protein, 253 aa, Artificial Sequence; identical to SEQ ID NO: 13774
  Synthetic

SEQ ID NO: 13776 - protein, 254 aa, Artificial Sequence
  Synthetic
SDEEILREILKTLEDVVRRLEELLKENEKLIRESTKLIKDVLDELLEIIKRVAKLIRDLKRNKVDEKTVEDIVRKIEEDLKRVVDKLRKLVKESEKKLTDSVKALRDVVRDIERLLRELVDKARKNVRTDELREVVERLEKLLRDALRVIKRIVDELERLNREYLTDVKEIVKRLAELLDDILRVVREIARDEDEETVERKLKKLLDKARTELEKIKRRLDKLNEDYERKLRELEKRLRDLLERLRKTLEDIRK

SEQ ID NO: 13777 - protein, 254 aa, Artificial Sequence; identical to SEQ ID NO: 13776
  Synthetic

SEQ ID NO: 13778 - protein, 242 aa, Artificial Sequence
  Synthetic
SEIEKILEELKRLVERVLKLNEDIARRIAELVKKDLKLIEDLLRELEDLVRKILDALRKKKDSKELVEEIKKRLDELLKRVREESDRVLKELKELLDEVRKVHEEIKEALERLLDKARKTIKDERILRLIEEIVKRLIELVEDNLRKWEELVKRHIELNEELLKRLEKVVEDIKRIIELVARGEEDKDKVVEEIRRLLKRLKEEAEKVARESEELLRRIREASKELAERAKDLLRKLDEAVR

SEQ ID NO: 13779 - protein, 242 aa, Artificial Sequence; identical to SEQ ID NO: 13778
  Synthetic

SEQ ID NO: 13780 - protein, 251 aa, Artificial Sequence
  Synthetic
SDEERILDTLRRIIEDLLRLLREALRRHEELLRRNIELIRRVLETIKEVLRRLLKLLLEVAKEEIKELKDALRKLLEELDKALKEYKKRIKDSLDELRKVIKRLEEELRRLLRELEEVRKKIEDRKTLIDTLKRVIDDIVKLLEDALRDLERVLDENMELSRRVVEILERVIEDVLRLLEEVVRRLKERRDREELDRLLEDVRRVIEELKKLVREVLERSERMVKEVRDLWRDLKRRIEEAAERIKDELRR

SEQ ID NO: 13781 - protein, 251 aa, Artificial Sequence; identical to SEQ ID NO: 13780
  Synthetic

SEQ ID NO: 13782 - protein, 239 aa, Artificial Sequence
  Synthetic
SERELLEKVRKVAEENIRILEEVLRKIAEVVKEDLKLLKELLEATERVVEELLKRIVEKKKREPEEAIRRLRKLLKELREEMERVKKESKRLLEELERILRRAKEKTEELLKRLRELLEAGLPRKDLAETLLRVVEAHAKLLRDVARVLLKLLEDHIRLSRELARRTEEVLKRIAKILREESEDETLERLLEELERLVKEVVERSERLLKKLLEDVRRVAEELVKSVEDLLKDIEREVT

SEQ ID NO: 13783 - protein, 239 aa, Artificial Sequence; identical to SEQ ID NO: 13782
  Synthetic

SEQ ID NO: 13784 - protein, 232 aa, Artificial Sequence
  Synthetic
REKELVDDIRRILEEILRLLRRLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLKELVRVTEELVRTNKELLEEAVRVIRKEVEDDSLVREVEELIKRLEKHIDDLLKTSRDLVKRVLDLVDEVVKRVEDLVERVKEKIDT

SEQ ID NO: 13785 - protein, 232 aa, Artificial Sequence; identical to SEQ ID NO: 13784
  Synthetic

SEQ ID NO: 13786 - protein, 247 aa, Artificial Sequence
  Synthetic
DEERLAEELERVLDRNRKLLEEALRELRRVIEENRKSVKRLLDELKRVLDELLKVLRELSRDDKDEKLRKVIEDLIRKLTKVLDKVRRLVEENIERLRRVLEKLERLARENLEDLKKVLDDVDKKLKDRRLVERLAELVRELIEVNKEILEMLKEIVRELLEINRTLLERLKDLVRTALEIIKLLARGDITEEDVERAVKEIRDRLRKLLEDYERAVRRLEDKLRRVRERYEKVLKRIKDKLEETKR

SEQ ID NO: 13787 - protein, 247 aa, Artificial Sequence; identical to SEQ ID NO: 13786
  Synthetic

SEQ ID NO: 13788 - protein, 247 aa, Artificial Sequence
  Synthetic
SREEVLRELEEVIEDNRRLLEELIEKSKKVLDESLKLIDELLRRLEEVLERVLRLLEELSKLDDEETLRRIVTKIRKELEDVLDEVRRIVKEILDRDRRVAEDLKRVVDENLEKLKKVLDELDKKLKDRRLVEILRDIVRLLIEINERALRELLKLHEEHTRIVAELLRELERVVEELRRLVELIARGEIREDDLKRVVDEVEKKLRELKRRYKEALERIKEKIKELKDRYERAVREVVAELRKTTK

SEQ ID NO: 13789 - protein, 247 aa, Artificial Sequence; identical to SEQ ID NO: 13788
  Synthetic

SEQ ID NO: 13790 - protein, 230 aa, Artificial Sequence
  Synthetic
KKDEEIREKLDRLLEENRRALEEITTRLDDLLRRNKDALRKVMEKLKRLLDDLRRADIREELLKRIADVIRDIMRLLKELHDHTAEVIKTIKKLLKELHDINKEIIERLKRLKDNNVPKEELLKRVEELVRTSLRLTTEVLKTVEKLIRDDKRLSEEILKRVKELIEELKRRVDIERVKEILERILRVVEEAVRLNEESLRRILDVVRKAVKLDRESLKKILDVVEEAVR

SEQ ID NO: 13791 - protein, 230 aa, Artificial Sequence; identical to SEQ ID NO: 13790
  Synthetic

SEQ ID NO: 13792 - protein, 243 aa, Artificial Sequence
  Synthetic
SRVEELKKLIEDILRISREVVERIKRVAEDIHRINRRVLDDLRKLIEDILRTVEEILARKVKDTEMAERLRDTIRRVVDEIRKLLEEHEKRSRELLEEIRKLLEDILRRSERAVEEIRELLKKNVRTKDVLRIIEEILREHLELLERVVRRIEEILRELLKTIEEIVKRIKEILEELKEVLKRGRVKDDEVEREIRRVKEDLDRILEEYRRLLEEIKRKLEEILRRVEELHRRLRRKLEEIDR

SEQ ID NO: 13793 - protein, 243 aa, Artificial Sequence; identical to SEQ ID NO: 13792
  Synthetic

SEQ ID NO: 13794 - protein, 244 aa, Artificial Sequence
  Synthetic
SRVEKVLELLKRIIEILRELVKVHLDVLRHNDELLKRIVEDLKRLVKKLVDILKEIVEKRKGEELDEIVRRLAKKLDEIIKTLKRLVDELARRNKESIDTLRRLVERLEERLREIVKLLKKLEEEGVDEETLKRLIETILRDIERVVRELKEIMDRINDENRRVVETLVKIVDDLLKDVEDVVRRANVDEEALERLKRLLEEIRERLEELKKRLEESLKRHEEEVRKLLDKLRRLLRRAEEEAR

SEQ ID NO: 13795 - protein, 244 aa, Artificial Sequence; identical to SEQ ID NO: 13794
  Synthetic

SEQ ID NO: 13796 - protein, 232 aa, Artificial Sequence
  Synthetic
SKEDELRKVLETLERLARELEELNKKILDDLKKLIEELRRHTEEVMRRLKELADELRKKPTSEDLERILRRLEELLEEHKDDLEKITETLERLVKKHNDLNKEVLDKLRRLLEKAKKDRTGREVLKELDEIIKEWRRLLEESIRELREIIKEIKKRLDDSIRKFEKMVEDVERSGAGEEVVRVLEELLRLVRDNVRRLDEILKELLRLVEESVRTAEEILKELLRLIKELAR

SEQ ID NO: 13797 - protein, 232 aa, Artificial Sequence; identical to SEQ ID NO: 13796
  Synthetic

SEQ ID NO: 13798 - protein, 237 aa, Artificial Sequence
  Synthetic
SIEELVDELLKVLKEVVEETAKLLEENNRRLKKITDDVRRLNEDTIRRLREVVKELETKRDERDVVRRIIEKLKKVVDDYRRVIEELIKRNEEVAEESRKVSEKLLKELEDLLRDIEKKVKSREKVRMLKRLIEELIRLNKELADIDVEINKKVSEVLRRNLEKVVEIAKRVLDVIRRDTDDDKARKALEDLERELRDVDRRSDEEATRLHEEHKKALDRYVKELKRVLDKMKEDTR

SEQ ID NO: 13799 - protein, 237 aa, Artificial Sequence; identical to SEQ ID NO: 13798
  Synthetic

SEQ ID NO: 13800 - protein, 237 aa, Artificial Sequence
  Synthetic
SEKELVDKLIKLLEDVVKKLEDIARDNNRILKEIADRVKELNERTVEEIKRVIEELRRKKDDREVVKKILEDIERVLREYEREIEKLIKRNDDVARKSEEDVRRLLEEVKKVLDEISKDLKDERLVKALADVIRKAIELLKRLLDKDVKINEEVSRILKENLDEVRKIVEELLKLIERDTDEEKLTRAAEDLLRKLRRVDEESDKKLREVHRKHKEALEEVKRRLKEITEEADRATR

SEQ ID NO: 13801 - protein, 237 aa, Artificial Sequence; identical to SEQ ID NO: 13800
  Synthetic

SEQ ID NO: 13802 - protein, 240 aa, Artificial Sequence
  Synthetic
SESELIRELEKLVKEIVDELERLLRNNIRLLEEVAKTLIRLLENNIELLDEILRELERLSKENRPDDEVRRTVEELLRRSREHSREVKETVEELLRRLERHSEEVRKTVEKLLTDLRRVVERNNQEDLRKLVDDIERVLRELLEVNRRANKKAKEVLEELLEVNDRANRKVERLLEVLLRGEVSEEEVRRTIERLKEEHEDALRRLKEILEELKDEHRRVLKRVKDKLRELKRRLEEREK

SEQ ID NO: 13803 - protein, 240 aa, Artificial Sequence; identical to SEQ ID NO: 13802
  Synthetic

SEQ ID NO: 13804 - protein, 228 aa, Artificial Sequence
  Synthetic
SEREELERLLKELEDVTREVVERLKKLLRDNEKLTDEVRKRLRDLLRRLEEMVRRRGLSDEVLKDLKRLIEELLKTVEELLREHIRSVEELLKAIRKLLEDHIRLIKELVRRADQRDETLERVDRKLEEDHRRILRRLEKVVEELKKEHERILRELEKVVDKVKKDLERVRREEEIEEIVKRLVEVLEKVLRELERASRKLVKVVEEVLRALEEISKELVDVVREVLR

SEQ ID NO: 13805 - protein, 228 aa, Artificial Sequence; identical to SEQ ID NO: 13804
  Synthetic

SEQ ID NO: 13806 - protein, 244 aa, Artificial Sequence
  Synthetic
DEDRRLEDAVRKLRKEHKDIMKKLDDIMRELDEDHRRIKERLDRILEELKKLLTRVLRETREDELLRKVLELLTRLLKLLADVLEENKRLLEDILRLLKELIETNLRLLEEILRLLRKVRREPVSEEEAKRLVEEITRLLERSTEEARKLVETIKRLLEESLDKLRRLVEEIERRLRTVLEEIRRRGAPEEIERIIRRVIEVIREILDLVRKVNKKALRVIEEILEDLARVNKKAVDAIDELRK

SEQ ID NO: 13807 - protein, 244 aa, Artificial Sequence; identical to SEQ ID NO: 13806
  Synthetic

SEQ ID NO: 13808 - protein, 244 aa, Artificial Sequence
  Synthetic
DEERLLKTILDVIRKVLKESKDILRRVEEILRRVIETAKEIHKEVKEIIEDVLRLLRENDKLEELVREVAKRLKEVIDRWREVVERVAETLKRVLEEHEEVVRRVARELEELLKRLREGEKLRAIEEVVKKVVRALEELSKELEKIVRTIVKLLRENVRRLEEILRRVVKLLRELVKLAKERSREEEIEKRVREIKKEVEDLLRRSEELLKELLDRIRKLLEELKKRHEDLLREVKKDLDEIRR

SEQ ID NO: 13809 - protein, 244 aa, Artificial Sequence; identical to SEQ ID NO: 13808
  Synthetic

SEQ ID NO: 13810 - protein, 240 aa, Artificial Sequence
  Synthetic
DEVEELLKRVRELLKRSEELVRKILEDVKRLLERSIEEVEDLLRKVEELLKRLLDLVERRKLLEEILRELVRLLKEIVRKVLELNRKLVEDVIRIAKRLLELNKESVKEWDRILKLLRDGTVDKKELLKDAEEALEKYERAVREILKELEEIIKEYVRRVEELLKELKDAVDKAKDEVRKEGSDEDLDRDVDRVLKEIMDLLRDLVRRTKELLEELLRLLEELVRRHKELVRKILDEIRK

SEQ ID NO: 13811 - protein, 240 aa, Artificial Sequence; identical to SEQ ID NO: 13810
  Synthetic

SEQ ID NO: 13812 - protein, 247 aa, Artificial Sequence
  Synthetic
REAEELLRELEELLKKSEKVLEDLLRKNRELIKDSKRRLDEVRRKVEKLAEEVEEVIRRGVSEEELIRVIKKVLDDLRRIIKELIEVSRKYLRTTLELVKELLDVSRDVLREVLRIIKALLDTIAKDNKEEKIKEIADVADEIRKLAEEDIRLIKKLLEESAKLVDEDVRKLEEIAKEITELVERLRRTTDKDAVRKLIEELKKLLEDLVEHHERLLKEDHERLKRLLDHHRELLKTVLTILRETAK

SEQ ID NO: 13813 - protein, 247 aa, Artificial Sequence; identical to SEQ ID NO: 13812
  Synthetic

SEQ ID NO: 13814 - protein, 238 aa, Artificial Sequence
  Synthetic
ELDEILRKVVEDSRRLVKELEDILREVIERTERILEEHRDLTRKADEDIRRILEEATRTKTDDELRERLKRLLDETAKLHRDVKKRLEDLNRDLLRLEDEILRRLEELNRRLEEVLRKKNKVSEKILKEHRELLEESRKRLEEIKKEHREMLKRSEDESRKILRDLEELVKEIDDKEDKKPKEEVLKDIVRVLRDVLKKANDLLKTHLDLNRESVKKVVEIARRHVKMNEDSVRKVEK

SEQ ID NO: 13815 - protein, 238 aa, Artificial Sequence; identical to SEQ ID NO: 13814
  Synthetic

SEQ ID NO: 13816 - protein, 238 aa, Artificial Sequence
  Synthetic
DVEDVLREVVERSRRLVEEHKRISEKVIRDTKRILDEHRELTERVIRRAKKLVDDARRTKTDEEVLKRFADLVRELLELHRRVKKKLDELNERLLRAHRTLLERLERLNRELLKLLRERNKVSEEIIRKHEELLKKSRRESEELIKAHETMLEESERRSKKILDEVERLLREIEKKARKKPKEEVLKDAVRVLEEILRKLNELLERHLKLNEESLERMNRILTRHVKLNKESADDARR

SEQ ID NO: 13817 - protein, 238 aa, Artificial Sequence; identical to SEQ ID NO: 13816
  Synthetic

SEQ ID NO: 13818 - protein, 245 aa, Artificial Sequence
  Synthetic
DEEELLRRVTEELKRLLDEARKLHEDVKRELEKLLKENDDLLRDVKRKLERLLEALKRGELTEDEVIERILRLVEELLKRHAETVERILKLVRDLLRLHEKLVKEILDLLTRLLELLERRKGEENREKVDKLKKLAKKVVDEVERSLEELRRLVEEVIKRIRDSLRRSARIVKEAVRELRELLRDVRDKDKLLERIRRLLETLLEVLKRDNEEIKRILEELLRVAEENLRRIKEIIDRLLDATRR

SEQ ID NO: 13819 - protein, 245 aa, Artificial Sequence; identical to SEQ ID NO: 13818
  Synthetic

SEQ ID NO: 13820 - protein, 249 aa, Artificial Sequence
  Synthetic
DEEEVVKRLADVLRENDETIRKVVEDLVRIAEENDRLWKKLVEDIAEILRRIVELLRRGGVPEELLDRLRKVVKRIVEKAEKILERLNRVSKAIAEKLKTIVDELNEVSKEIVKRAEDILRKVKDKETVLRKLRTLVKEYADLSKEVLERVERIVREYVKLSDEVVKSLREIVEELIRIIEDLLRKVNLDEDVKRALEELVKRLRKLLEDVKKKSEDIVREVERIVRELKKRSDEILKKLEDIVEKLRE

SEQ ID NO: 13821 - protein, 249 aa, Artificial Sequence; identical to SEQ ID NO: 13820
  Synthetic

SEQ ID NO: 13822 - protein, 240 aa, Artificial Sequence
  Synthetic
KEREEIRERVKRILETSRKLLEELAKAVEDVLRRSKELIDELRDAVRRVLEELERGGLEEELRRILEEVARILERLIRALEDLNRRAAEILRTLIDLAKKLHDELKRVIEELDKKPKSRELVEEAKRAVERYKRVVEELLDRLREAVERLRRAHEELLRDAARVVKELVDKLREVLKRVDEDRTKKIVERIIELIEELLRLLVKVVEDSVRLIEELLKLAEEVAKRSLKLIEDLLRAIEK

SEQ ID NO: 13823 - protein, 240 aa, Artificial Sequence; identical to SEQ ID NO: 13822
  Synthetic

SEQ ID NO: 13824 - protein, 247 aa, Artificial Sequence
  Synthetic
SDDEVIEKVKEDLRRLIKEAEDVVREYEKRLREVEKKLDEVVKESERLLRELLKKLEAGEKDVREIVRELLEVNKDVLRKVVEIVKELKKIDEDLLRKVEDIVRKLLEVIDEALRRVIESKKDVDRVRKIVEELRRKAEDVLRRIRELVRDLERISDETLERVKKLVKESEDLAREALDRIEKVNTDKKELIKILRDLARKHRELLKRLKELTREHLKRVREILEELLRVTRELVEEIDKILKDLKK

SEQ ID NO: 13825 - protein, 247 aa, Artificial Sequence; identical to SEQ ID NO: 13824
  Synthetic

SEQ ID NO: 13826 - protein, 240 aa, Artificial Sequence
  Synthetic
SEDEVLERIRRALERVEDEHRKVLEKIVEDLKDVLEKHKRVLEEAKRDLERIKEDADKGVPIEELIDKLRRLLEKLIERVRRITELLKRIIEEVARMLKEITDELRRIAEEVVKDTPEDERLKEVRRELEELLKENDKLIKDLVKEAEDLLDEDRKLISKVLRDLERLIEDLRDRLRDSDEKSLKDLLREVLERSKKLLEEHHKHLEEIVRRTKELLERHHRHLKEIIRRIEEILKRERD

SEQ ID NO: 13827 - protein, 240 aa, Artificial Sequence; identical to SEQ ID NO: 13826
  Synthetic

SEQ ID NO: 13828 - protein, 237 aa, Artificial Sequence
  Synthetic
SKEDELREVLERVKRLIETVKRALDEALDRTRRLIEELDKTSKRVLTTVKKLIEDARREDKRELLKKLAELIEEHLRTLEELLRRNKDLLREILELLEELLKELKRLLKELLENQERDEEVKRVLDRIRRLLDEVRKDLERLVEEVRKLHKEIEDRLRELTKRTRELLDKIRRLLEEGVDERDLLRELLRIVKEHVDEVRKLLDELRKVNEKIVDAVRKILEKLLKIATDAIEETRK

SEQ ID NO: 13829 - protein, 237 aa, Artificial Sequence; identical to SEQ ID NO: 13828
  Synthetic

SEQ ID NO: 13830 - protein, 251 aa, Artificial Sequence
  Synthetic
SEKERLMEEIKRVAEELRKTVDRLRERNEKVVRDIRETVREVEREHEDVVKELADRVRELRRTDALERLVKLLLDIIKRLVEESRKLVELVLKIIEDNVRALTELVKRLLRIIEELLRVLRDVEGKEELDKVKKKVRDELKKVEEEAERILRESERLLREVEDTVRRIHEEVERKLREVEKRIEDSNLSEEVREVLRRLTKILRDLLKRNKEIMEKLLRDLKELLKENKKALEDLLRKLEELLRRIAEAEK

SEQ ID NO: 13831 - protein, 251 aa, Artificial Sequence; identical to SEQ ID NO: 13830
  Synthetic

SEQ ID NO: 13832 - protein, 240 aa, Artificial Sequence
  Synthetic
SKEETTKRLLDRHLERDRELLDRAARTNEEILRRNREVLKELFELLKRILDRVREANLIKRELLREAEERVKEILKEVDDINEEYKRELERILDEVDKRNEETKRLLEEIVDELRRTGTTEEVIRKVLEVVRRNLEVHRKLLEDSIRLIRRLLEVTRELLERLIEVIERLLRALLEDKKELEEVLRELRELLKRLKKRLEELLREHEKLLEDYKDRLRKSDDDLRRSVEEIKKALDRLRK

SEQ ID NO: 13833 - protein, 240 aa, Artificial Sequence; identical to SEQ ID NO: 13832
  Synthetic

SEQ ID NO: 13834 - protein, 240 aa, Artificial Sequence
  Synthetic
SKLEDSAEKLKEHLKRDRELLKRAEDLLREILRRNREVLDELRRTLDDILRRIREENLIKKEALDEVKKEIEEVLRKADRANEKIKKAVEDIVRKAEEANRDTEEKVRRILEEVKRRGTTDEIVRALLRVLEENLRVHKELLEELLRVVKELVDLTRDLLRRLIEIIEKLLRLLKEDVKEAKEVLDRLEKLLRDARKRLKELLDEHEKVLEDMERRLRESLDDLRRSLDRIRKDLKRKTD

SEQ ID NO: 13835 - protein, 240 aa, Artificial Sequence; identical to SEQ ID NO: 13834
  Synthetic

SEQ ID NO: 13836 - protein, 243 aa, Artificial Sequence
  Synthetic
SEKERTKELLERLLKLIRELLKKLEDLNRDLLRRVKEVLDRLAELNEELLRRVEEVTRLRDEVDKDELTRRLREIIRRYEEELERIVRELERILTEYEEMVRRLLREIEELIDRVKKELDKLPRTEILEKVKKVIEKILDSIRKVIKASLESAKELLDELRRVAKASVRLVRELLRIAEEVKEKEKLTKLIKEIKERSKRLLEEVKRALEEVMKKNEKILRDVRDDLRRAREELREILREADD

SEQ ID NO: 13837 - protein, 243 aa, Artificial Sequence; identical to SEQ ID NO: 13836
  Synthetic

SEQ ID NO: 13838 - protein, 249 aa, Artificial Sequence
  Synthetic
REEEKLKETLERILRELEKLAKENKELLERILKRDEDLTRENKETLDRLLKRVEEVTRRKEDDDRLREILERIKEEVDRDVRKNEKILKDIEDEVREAVKRNETRLREIKRKVEELVKDLREKLKDVDRARRIVEELKKIIDKVLDDHRKMVRRLLEVIKKLLDLHRESVKKLKEVVKELLDILREVRGDREVEKVLRDIKRKIKEIVDEHRDMNRKIKEEIDRIDTEYKKSLKDIKKEIEEVLDEARQ

SEQ ID NO: 13839 - protein, 249 aa, Artificial Sequence; identical to SEQ ID NO: 13838
  Synthetic

SEQ ID NO: 13840 - protein, 240 aa, Artificial Sequence
  Synthetic
RKEEAIERIRREIEKVRRRLREVHKESEERIRRLEDEYRRALETSAELIRRILDELRKNRVREDDLRRDEELARKLEKLNKELLEALRRIVKKLEDLNREVEKSSEELVEELKRVLDSDLDRDELTEVAKRLKDKLKRILDELRRLHEELKEELERLLKRYAEVIEKLKEDLKRVLAEVTDKRVKDIVRKILRVIEENLKFVAEAVKKLKEIIERNLRLLEEIAKLLLDILEEVLKRLTT

SEQ ID NO: 13841 - protein, 240 aa, Artificial Sequence; identical to SEQ ID NO: 13840
  Synthetic

SEQ ID NO: 13842 - protein, 240 aa, Artificial Sequence
  Synthetic
REKEVIEDIKRLLDEILKRLEEANKETEERLEKLRKEYRELLEDSKRKIKDIEAELRRLNVPEEKLRLVRELVKRLEDLNRRLKKALEDIARRLRDLNRRVKELIKRLLEELKEVAESNLDREEVEKVIRDLIRRLEKILTDLDEVHERLKKDLEKLLEEYERTVRKLLKDLEEVLKRVDKEAVKEIVKRLKEVIKDNLRVVEELVRKLKEIIEDNLRVLREIAKLLKDVLEKLLRDVRK

SEQ ID NO: 13843 - protein, 240 aa, Artificial Sequence; identical to SEQ ID NO: 13842
  Synthetic

SEQ ID NO: 13844 - protein, 240 aa, Artificial Sequence
  Synthetic
DKDKRLEELLKRLKELNDKTFEELERILEELKRANERSLREAERILEELRRRIEERNLDKRLAELLKKLLDDLKRLLEEYTRTNEELLKRLRELLERYRETNKKLLDLLRKLLDEARRTKTDEDLLRRLEDILRKYEDEVRRLLKELEDILREYEDTSRRLLEELERIAKEAAERVSRIKDKDVKDIIRTILEVARDLLRLLEEDSRTNSEVVKRLLDLLREDSKANSEVVKRLLDVLRE

SEQ ID NO: 13845 - protein, 240 aa, Artificial Sequence; identical to SEQ ID NO: 13844
  Synthetic

SEQ ID NO: 13846 - protein, 240 aa, Artificial Sequence
  Synthetic
SKEETLKRLLDELEKRNRETVERLERLLKELEDRNRRSLEELERVLEELERKIEESNLEKELKDTLRRILEELRKLLEEYFRKNEELLRLLRKLLDEYRRTNEELLRLLEELLDTARRTRNDSELLKRLEDIAREYEKRVRRLLEKLKDILDKYRKTVEELVRKMEEILKEAKKTISRIERREVKDIVRKMEEVIRRLIEILRRDVELNLDVAKKLLELLKEDSKLNLDVARELLELLDR

SEQ ID NO: 13847 - protein, 240 aa, Artificial Sequence; identical to SEQ ID NO: 13846
  Synthetic

SEQ ID NO: 13848 - protein, 243 aa, Artificial Sequence
  Synthetic
RELELLDELLRRTERLVKEYLRVSKELLEETLKLLTELLKLSKRLLEETERLLRRDKLGDEEEIRRLIRRAEDSHRRLKEIIDRLFREAEESHRRLEDTIRKLKREAREVLKALERGERSLKEVLDVLDTLVKRLIKVLRDNNRRLEELLRRLVKVLEENARILEDLVRELIRAAREKLRDKSKTELLEEAVKRLETLLRRYKEEIRRVAKRLEELLRELNELSKRLEETLKKLLEDLREDAR

SEQ ID NO: 13849 - protein, 243 aa, Artificial Sequence; identical to SEQ ID NO: 13848
  Synthetic

SEQ ID NO: 13850 - protein, 243 aa, Artificial Sequence
  Synthetic
DEEETLRRLLERKVELAKEYLDVSKEVIDRTTKLLDEYLKTSKRIVDKTVELLERDDLGPKELIKRLKEELERSLRELEEEIKRLKRELEESLKKLKEIIDRLKEEAEKLLRVLKRGEKSEEEALRALAKLVRELIEVLRENDERLRDVLRRLIEALRKNNEILERVLRKLVRAAEERLRDKSLRERLEEARRRLEELLRELNEITKDLERKLEKLLRDLNELTKRLEEELKRLLDELKKRTD

SEQ ID NO: 13851 - protein, 243 aa, Artificial Sequence; identical to SEQ ID NO: 13850
  Synthetic

SEQ ID NO: 13852 - protein, 247 aa, Artificial Sequence
  Synthetic
SEEDELVKRLRELVKELIDAIREHLRRLEELLRELLKALEDHLRKLAELVRRIIEELRRTNAVDDKLLETLDRIVKRVAEEHKRLNEELERIARKVAEESRRLLEELERIVRKVETDIKDLKDKGGDKDAIARLVKELADVARRVVTEHARLVRELARAIKEVVKAHVELVERLLEVIKEVIDRGDVPEELKERIRRIVETIRRSLERLKEEADRIVKEIEKSLRELEERLERIVDTIRKLLEDAKR

SEQ ID NO: 13853 - protein, 247 aa, Artificial Sequence; identical to SEQ ID NO: 13852
  Synthetic

SEQ ID NO: 13854 - protein, 251 aa, Artificial Sequence
  Synthetic
SEDDVLRKLLEAIKKLLKETKEILDRYLRESDRHNKALREILERLLELIKTLLEDLVRRTGKVKDLDKLAEDVKRVRKRLEEILEDNKRKSEEIARRLDKILDEIRKRVEDVVRELERITREVKDKDTLVREVVRLLEELLEVARRVVKRLEDLVRENNRVNNEVTERLVELLKRLLELTDDLLRKLRKDVPEEALKEIKRKLRELEKEIRKVVEDSRRISEESLRRLEKALEDIERILKKLSDEIRTDAT

SEQ ID NO: 13855 - protein, 251 aa, Artificial Sequence; identical to SEQ ID NO: 13854
  Synthetic

SEQ ID NO: 13856 - protein, 233 aa, Artificial Sequence
  Synthetic
DEEEVTKEVERLNRELLKRLREIVEETKDLNRRLLEILEELVRRTEKLLKDVLEIRKRGEKDERVLRDLKRTVEELIKRAKDALERYERDLRRIEERLKKLLDDYRKVLEDITRALPRDEKVERLVRLLERSLEVIEELIRLIVKILRDSLRVVKELIDRIVRIMERILELLRKEKDKDRLREELKKLLEELRRVLEDAKRKSEELSRRLEEVLRRAEEKNKEIMDRIRKARE

SEQ ID NO: 13857 - protein, 233 aa, Artificial Sequence; identical to SEQ ID NO: 13856
  Synthetic

SEQ ID NO: 13858 - protein, 235 aa, Artificial Sequence
  Synthetic
KEKEELLEEVERKVTELKKRSEDLVRKLDEEVKRLEREHEELLKKLRDAVEELRRAKLEIDDLERTTRELTREHEETLRKSLRELERLLEDHVRTIEKVLKDLRKILEDVAKKTRDDERLKELTKRLEEAAERLRRDHERLLRDLERVMRELKKLHEDARRELERVVREVKEEEDRETVLRKIIRLVEELLKILARINEEVKKLIRKLLEILTRINKKMIEVIDELVKIIREAAT

SEQ ID NO: 13859 - protein, 235 aa, Artificial Sequence; identical to SEQ ID NO: 13858
  Synthetic

SEQ ID NO: 13860 - protein, 243 aa, Artificial Sequence
  Synthetic
SEEERTKESLKKVLKALVDLNRELLRKLEENMRELTKLNEEVKRKLKEVLDKVRENGIVDKDAEREAERLMRELDKSSEDTKRETRKLIEESKKSTRRTEEEARKLTETLDRLKEAGLPREDLLRALVRLLEELARLIEEDVRRNAELVKRHIELVERDVRELLRLIKELVDLLRDLAEKLRRTEEIRKIVEEILKEIKELADRYREEVRKSKDKLRRILEDYKRKVDELKERLRELIEEVET

SEQ ID NO: 13861 - protein, 243 aa, Artificial Sequence; identical to SEQ ID NO: 13860
  Synthetic

SEQ ID NO: 13862 - protein, 239 aa, Artificial Sequence
  Synthetic
SLKELAEEVLRRILELLRRIIEIHERSLERSNRTLKKLIDEIERVMREILETLKRALSIKDKEKLKEVRDRLRELLTELLRRAEEIAKENERLLRENKKRLKKIAEELRKLLEDLKRRLSGGPDKLERILREETKLLEDILRRIEEVVKEHEKLNREVLKRLKEILDRTRELLKKLADEDSRDRTLLEEIRRRVEKVIREARETLREHRERVERSIEELRRMLEDVERIVREAIERLRR

SEQ ID NO: 13863 - protein, 239 aa, Artificial Sequence; identical to SEQ ID NO: 13862
  Synthetic

SEQ ID NO: 13864 - protein, 239 aa, Artificial Sequence
  Synthetic
SEVEDILRRLAELNKRLIDKLRELIDRIRRLNEELLRVVEDILRRLKRLADELIRVVRERGDIPEELLRKLEEELKKIVDELRRLVEEYEKALRDLIKELRKAVEEYRRTLAELVERLRRLEEPEELLKDLAEDVRRNIKAVEEVIRRFEKNVEDNIEVVRRLVDALEKLVRRLEKVLRDKLRDEDLKRLLEKLKEDVERVLKEVRDRTRESLKHLEDVIRELEKKTEDSLRHMEERRK

SEQ ID NO: 13865 - protein, 239 aa, Artificial Sequence; identical to SEQ ID NO: 13864
  Synthetic

SEQ ID NO: 13866 - protein, 239 aa, Artificial Sequence
  Synthetic
SKEELVKEALEENVRSVEEVIKLLKDALDENLKVVERVIRELKRALERVKDVIRKLIEQRELLRRAEEELDRLEEELKRILDEYRKRVREIKEKLKKLLEDIRRVHEELERRLRREGPAERLLKELKELNKRIREMTERINREVRELNRALLEKIEDLVRRLVELLERVKERLKDNGRLDKKVADELKKLLDELKKILEEIRRMLEEANRKHDDIVRDIRRVLEENDRKLEKIADDIRR

SEQ ID NO: 13867 - protein, 239 aa, Artificial Sequence; identical to SEQ ID NO: 13866
  Synthetic

SEQ ID NO: 13868 - protein, 239 aa, Artificial Sequence
  Synthetic
SKKEELEKLLDTNLTEIRRLLKRVKDVLDRNLEVVRRVIEELARLLDEVTEVVRRLIDDEKLLREVEKVAEDIKRELERILREYEKLVEDIKRELKRLLEELERAHREIKKEVERDGPDDRVLKKLKELNDDLLRAIKEINDKVKKLNEDLRKKIEKIAREVLKLIEDVKRKLKEKGRLDEKVKRELEKLIKRVKDILDDIRRRLKKVNEEHEREADRLRRELERLDRELKKRMDDIRR

SEQ ID NO: 13869 - protein, 239 aa, Artificial Sequence; identical to SEQ ID NO: 13868
  Synthetic

SEQ ID NO: 13870 - protein, 236 aa, Artificial Sequence
  Synthetic
DEDEELKERTKKSLEKLRRLLERLEKIIRESLDKLRDLLRLLEEALKRILDELRRNNVVSKDLLTELKKLLDRLREEVKRLLEESKELVKELKKRVDELLTESREAVKDLERKVRREEGEEKLLRLVKRLLERHLELSDRIARLVVKILEDNLRLIDELVKIIKELLERVLEVVRRVVRDRDKLEKIERDIRKIIRDLEEIARRLKEDHERVIKELRETVKKHKEDLEEVIRELRR

SEQ ID NO: 13871 - protein, 236 aa, Artificial Sequence; identical to SEQ ID NO: 13870
  Synthetic

SEQ ID NO: 13872 - protein, 234 aa, Artificial Sequence
  Synthetic
REKEDVARRIKRIHDELETRIRKLARDLERIHRKLKEDIERLVREAEKKLRELEKKTTDDKIKTLIDRTRKTLEDLTDEIRRLLKKHLEDLKRLLDDIERVLRRHLRKLKELLDVARRNEVPDKEVRDEIRKSSRELEDILRRLREKLKTLHEEVRRAVERVRKKIEDLEREVRREGVPEEIERLVEELKKILETILKLIAELNEEVVRLLEDILRLVRELNERVAELLERAEK

SEQ ID NO: 13873 - protein, 234 aa, Artificial Sequence; identical to SEQ ID NO: 13872
  Synthetic

SEQ ID NO: 13874 - protein, 243 aa, Artificial Sequence
  Synthetic
DEERIIKTLEDINKKLVEDIKRILDKVRELNERLADAIRKILEETKRILERTTRKVRKDGEISEELLRRLEEKLRKLLEDLERVLREHEDESRRILEEVERLLKRHKDRSKELLDRARDVKDRVKRDKELVDRLKKLIDDSLESVRELIERLKELLDRLVKSVEDLIRTIKELLDRLVEVLREVVSDKDTLRTVEKLVEDVKRRLDKLLEDYKRLIEEVKKELDKLLKEYEDRLREIKKRIDE

SEQ ID NO: 13875 - protein, 243 aa, Artificial Sequence; identical to SEQ ID NO: 13874
  Synthetic

SEQ ID NO: 13876 - protein, 244 aa, Artificial Sequence
  Synthetic
DLEDAIRELLRRLTELIEELVRILEELNKRLNDLVRRLVEILRRINELLKKLVDRLRKDPDASEDLKRVVEEARRLHREALERLKEVVRELRKLHDDARKRLEDVRRELEKRLEDVARRTREDEKLERLRKAIKDILDKLEELLRKHLEDVERILRELEELLERHKRMLEKLLKDLEDLLRRRVEERELKKVLDDIREKVKKTIKEIDEVLEKITRENERTRKEIEEMLRTLRELIKRLLEETK

SEQ ID NO: 13877 - protein, 244 aa, Artificial Sequence; identical to SEQ ID NO: 13876
  Synthetic

SEQ ID NO: 13878 - protein, 239 aa, Artificial Sequence
  Synthetic
SEEDEVAKTLEDILRRLEELLREHHELHRRILEELEKLLRDHIKLHKDILDEATKSTDDLEKLADEVRKKLRESLKTLKKIVEDIERKLEESKRRLKRTVEEIRKKLKELLERIETRNLDERLLRALRELVRLLEEILRRLLELLEEDVRLLKEILRELERLLREDIKLLEEILELLKRRPDSKETLKRLKDRSKELNDRVRETLKRLAERSKRLNEKVEEDVRRAVEELRRLLEEIRK

SEQ ID NO: 13879 - protein, 239 aa, Artificial Sequence; identical to SEQ ID NO: 13878
  Synthetic

SEQ ID NO: 13880 - protein, 227 aa, Artificial Sequence
  Synthetic
DERKVIEDLVEVLRDLLRVIKEVLDRNVKLIKDLLRLNLKVAEELIRVLKELLDRLRRDKDLRELEERIKRVLEEHEDVIRRAAEKVEKVADDSRKVIEDISRKVEALSRRNLEMDTLAELAKEILKLIEDLLRDHKRKTDRLLEELRELTKRTARKLEKILEDIVRKTGETEELDRIRKELKRLLDELTKLHEDVRKKSEELVREAERTLEDVKRKLDELLERAKK

SEQ ID NO: 13881 - protein, 227 aa, Artificial Sequence; identical to SEQ ID NO: 13880
  Synthetic

SEQ ID NO: 13882 - protein, 244 aa, Artificial Sequence
  Synthetic
DEERELERLLEDVRRRHEELLRRLEKLLEDIRKLYEDVRRKLKRLLERVDRLVREILRRDKRDKVREVIKELLEVLRRVVERIEELIEESLRVDERVVEEIKKLIEEHLRVLEEAVDRIKKKKDDEETMREIIRELEEVNRRLDEEVKRLKRENDEVLRRVKEALKRLAEELREALKRLEERTGRDELIKELADIVKEILRLAEELAKELEKINRELDRVTRELIKDLLRISRELIKRLEDTTR

SEQ ID NO: 13883 - protein, 244 aa, Artificial Sequence; identical to SEQ ID NO: 13882
  Synthetic

SEQ ID NO: 13884 - protein, 238 aa, Artificial Sequence
  Synthetic
SDKELLDDTIRKMRKLHRDSVELLDDIRRKLEELLRKVRELLDRNVKKIRELIELRKKTDERELKKRVDDIERENEEALRRIAEEIKEIKKKIDRAVKEYKTELRKLKEKLKDALRRVSDEKVKEVIRRLLEALDRNAELNEDVLRRILEMLERILETIKEIIKKNIKSLRELLELIARGSRDSDLEDLIRRDIEELKKVIEKLEELVRRIEELLREAKERDKESLDRIEDELRKAKK

SEQ ID NO: 13885 - protein, 238 aa, Artificial Sequence; identical to SEQ ID NO: 13884
  Synthetic

SEQ ID NO: 13886 - protein, 238 aa, Artificial Sequence
  Synthetic
EEDDLLKANLDTLRELHKESEKLLRDIEETAKELHKKSEELLKRITDELDRLVKLSRKVDDKVLEELIRRIVREIEKMVEDYERELRDLVRKIEDAVRRYEKKVREIEKRNKEFLKKVTDEKVKEVIERNLKTIRENVELNKEILRRIIEVLRENVRLNREVAKELIRVAEEILKLLRAGSRDSDIKRILDDLRRRLEDALRRDRETLKRLKEEIERVKKEDRRSLERDKEELEKARK

SEQ ID NO: 13887 - protein, 238 aa, Artificial Sequence; identical to SEQ ID NO: 13886
  Synthetic

SEQ ID NO: 13888 - protein, 235 aa, Artificial Sequence
  Synthetic
SAAELILKAAKEAAEANREAAELALKAAEESARAAREAAELALKAAKEAAEAARRGAEDKDTALKLVDEAVRKAEEALRRANEKNRRAVRKAEEAVKRAAEKNRRAVEKAKEAAERGRADEKKKRRLEELAKRTEDAIKRILEELKKLAEDSEEIDRRALKALKELADEAREIAKANLDKDDLTRAADELLKKAKKLADDYKRAADRLLKEAEDLAREWKKLADKALEDAKRDAD

SEQ ID NO: 13889 - protein, 235 aa, Artificial Sequence; identical to SEQ ID NO: 13888
  Synthetic

SEQ ID NO: 13890 - protein, 235 aa, Artificial Sequence
  Synthetic
KAEEAAKEAARLAKEDADLAKKAAEDAAELHERHAKLLEDSARTAAELAKRLAEAATVDEAARLLKKAAEDYKKAADEAARLNREAAKEAEKAARDAAKLNREAAEDVKRAAKDRLREAVERAKEALKRSLDLAKEAVERSKEALKRSVELNARAVEIAKEALKEALRIAAERAERKEDLDRLAKIAKEAADALEELLERSKESAERAARALEKLLKEWADSAKKAADALEELDR

SEQ ID NO: 13891 - protein, 235 aa, Artificial Sequence; identical to SEQ ID NO: 13890
  Synthetic

SEQ ID NO: 13892 - protein, 237 aa, Artificial Sequence
  Synthetic
DELETLKKEAEDVLRELRDILRKLEDLSRKTIEDMRRIVEEVLKLNEDSIRELKRIIEELDSKDLMDTVEKVVKRNLEIAERVIERLLELVRRNADIARRVIEELLKVLERLADIVRKRIKSEVLREIKRVAEEVLKKVREVLKRHEDAIRKVLERVRDVAREHRRVVKEVLEDVKRAGGLTDEVVKKLEDVSRKSIDDLRKIIETLREVVERSIEEIERIIRDLERVIREIIEREK

SEQ ID NO: 13893 - protein, 237 aa, Artificial Sequence; identical to SEQ ID NO: 13892
  Synthetic

SEQ ID NO: 13894 - protein, 240 aa, Artificial Sequence
  Synthetic
SKIEELAKIAEEHAELNRRAARKNNEIAKEAAELWKRAAEKHVRIAERAADAIRKAAKSEAAKTALKLIKENAEDAKEAARRALELAKESAERNTRAAEEADKLSKDAARTAREARREDALKKAADKAAEASRRAVELNKKAAEDHHRANETAARLAERASRHLIEALERAVRAAARELEDEKALREAKELAERAARENREALKEAKELAKRNSEKAKESAKEHKKLAEDANKRAEEATR

SEQ ID NO: 13895 - protein, 240 aa, Artificial Sequence; identical to SEQ ID NO: 13894
  Synthetic

SEQ ID NO: 13896 - protein, 240 aa, Artificial Sequence
  Synthetic
DEEEVIEEILKTLEEINRRVLKLIKDILEKVKRVDDEIKTLVKEVLRENERVLREVREKAKVKDLVKELLKRVREVAKIHREIVRRHLEILERILEEVAKVVEEHIDALRRILELLERVIRDEEVVKEVRKLVEDVLRASREVLERVTRLAEELIRESKRVLDTSRKLIEEIEDRLRKVRSEKMLEDILRRLEEINRTSLRLVDEVSKKTREVLERILKLVKEVLDESRRVAKKVKDDLK

SEQ ID NO: 13897 - protein, 240 aa, Artificial Sequence; identical to SEQ ID NO: 13896
  Synthetic

SEQ ID NO: 13898 - protein, 229 aa, Artificial Sequence
  Synthetic
SAVDIAREAARRVIELLKRSAEAAEEAARRSIKLAKESADAAREAAKKVIEILKRAADEDRALKEIEDLARELRKASKEVLEEDERLARELEEISRRVLDEIRRLAKELEDKATKKKAEKAAREIERAAKEHLEVNKRAAKRSKDATERHLEANDEAAKRIRDAADEVRKRGEEDAARKAAEIAARAAKRSADTAKRWAEVAKEAAEESAKSAKKAAKIAEDAAREIEK

SEQ ID NO: 13899 - protein, 229 aa, Artificial Sequence; identical to SEQ ID NO: 13898
  Synthetic

SEQ ID NO: 13900 - protein, 231 aa, Artificial Sequence
  Synthetic
DLREAAKEAIDAAEEAARRTEEAAKENIRALEEAAKRTRDAVRRAIKAIEDAVRDAGSTDEAVKIVEDAARDALRASKESIDIVREAAKRSLDASRESIKIVEDAAKKAEDAARKAGRDASRAAELAKRAAEADKRAAEEDARLNEEAARADRRVAEELARLAEEVADAAKKADKREDLERIAREAAERAKELADRLEEIYRRAAEESKRLAEELKRIYKRAAEEAKKAAD

SEQ ID NO: 13901 - protein, 231 aa, Artificial Sequence; identical to SEQ ID NO: 13900
  Synthetic

SEQ ID NO: 13902 - protein, 242 aa, Artificial Sequence
  Synthetic
SKIEELMKLVEKIIRKTLDLVRKHAEVSKEVLKEYIRISKEHLDVSKRVAEELKKEIEVKRLLEEVERVAKKVVETNKRNIETVERVLEDIKRTNTELLKRIEDVLREAVRVAEVLRRGDSDKEEVVRRIKELLKELLKVIREVVEKDKRLLDELLKSNADVVRTDEELLRRLLRVVERDVERKEDLDRIRDTLRRVIERSKRIHDRLREMLEEVKRRSEEIVERIERELRDVARKLEETLR

SEQ ID NO: 13903 - protein, 242 aa, Artificial Sequence; identical to SEQ ID NO: 13902
  Synthetic

SEQ ID NO: 13904 - protein, 243 aa, Artificial Sequence
  Synthetic
SLTEELRRVVKEIEEVVRRDVRTLEEVVKKITEVVRRDDKSLREVVKRNEELVRLLARGDRRDEDVLRAVAKSNKELLDSSREVLKTVADLLRRLLESSKRVADRVEELARRLLKMVKDSGKDDRKLREKLKKILREYRERLKEVAKKIRDALKRYEDILREIEKKNRDVLKRAEELRSKDTSEKDRREILRELVELTERSVEEIARVNKELVDIVRELVKELKRLNERLVELVKRLVEETAT

SEQ ID NO: 13905 - protein, 243 aa, Artificial Sequence; identical to SEQ ID NO: 13904
  Synthetic

SEQ ID NO: 13906 - protein, 241 aa, Artificial Sequence
  Synthetic
RAIETLVDVVREAIEINKRLVDRNVESNKELAKLNRDLVRRNRESNTELADLVRRDKDVDRLREEAKRVLEENKRLLDELRERHERVLKRNEDLLREVERLHTRILRDLREIVRRDNSRKEVLERLERVVRDILRSLKEVLDENAEVVKRILKSLEDALRENERVVREVLELLKRVRDQDREEELKRVVDEIVELLKRVLETTEKVVRDNVRLLEKALRSSKKVLDENVKKLEDVLRDLKR

SEQ ID NO: 13907 - protein, 241 aa, Artificial Sequence; identical to SEQ ID NO: 13906
  Synthetic

SEQ ID NO: 13908 - protein, 241 aa, Artificial Sequence
  Synthetic
SAAEALAKLAKENAELNRELAERNARSNKELAELNEEAARRNAKSNKELAELARRERDVDELRRRAEEALRRNKELLDKVRRDHERALRRNKKLAKEAEERHKKSLEDAKRIAKRDKAREEALRSAEEAVRRALKSLKDALRSNEEAVRRALKSLKEAADENEKAVKEALDLARRARDDDTEEELKRAIEEAAKLLKRAADETRRAAKENAEALEKAARESKEAAKDNAEALKKAAEEAKK

SEQ ID NO: 13909 - protein, 241 aa, Artificial Sequence; identical to SEQ ID NO: 13908
  Synthetic

SEQ ID NO: 13910 - protein, 232 aa, Artificial Sequence
  Synthetic
TEEEVVEDVKRVLDESHDDLRRLIETLTRVLRESLKRIKEALEELERVLKKLLDLLEGGRDKREVLDEIRKVLERLREVIEELLRINKEVLRELERVIRELLKKNEDLARRVRRDVKSRLLEVLERLARESLELNRRILEELRKLVEKSLRAVEKILKRLEEIVRKLLKLVEDNKPREEVKRVLEEARDELRRLLEEYKKIIEELERELERLLREHREVIRRIKEEIDKSSK

SEQ ID NO: 13911 - protein, 232 aa, Artificial Sequence; identical to SEQ ID NO: 13910
  Synthetic

SEQ ID NO: 13912 - protein, 234 aa, Artificial Sequence
  Synthetic
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKVVEYDTENAKRVVEELKRVVKRDADVVRKLVELLDRKAR

SEQ ID NO: 13913 - protein, 234 aa, Artificial Sequence; identical to SEQ ID NO: 13912
  Synthetic

SEQ ID NO: 13914 - protein, 235 aa, Artificial Sequence
  Synthetic
SELEEAVKRVRDALRENLDSIRRLVEKIRRVLEEHNKLSKELVDRIEEVLRRTVEAVKKDKPEEDLRRDLERVLEELTRLVDEVRKTNERALTELEKLVRDDKRKLEEVLRELRERLVKIEELLRRLEEVIRRSLRSLEELLKLLERVSRELVEVLRELLELLRKVVKRLLDLLRKGSDKRDVARVVRELIELVKRVLERDKRIVDELVKLVDEVLKRNKEIVDELVRLVDEARR

SEQ ID NO: 13915 - protein, 235 aa, Artificial Sequence; identical to SEQ ID NO: 13914
  Synthetic

SEQ ID NO: 13916 - protein, 238 aa, Artificial Sequence
  Synthetic
SELEDLIRLLREVIKRLEESVKELVDIVEEAIERLRKIVKELIDLSRKVIDELLELGVEERVIKKAKEASEEALRKLEDVIRKLKKILEDVLKKLKESIDELLREVDELLKRPQDKEVLREILERLRELLRRHTKVLREVIKEIADALEEVLRVIEEILDLHRRLLDEIRKVLERAGLPEELLDRIRRLIEESIKKLARIADRLRKLIEDLRRLLEELLRRNEELIERLERMLDEKAR

SEQ ID NO: 13917 - protein, 238 aa, Artificial Sequence; identical to SEQ ID NO: 13916
  Synthetic

SEQ ID NO: 13918 - protein, 238 aa, Artificial Sequence
  Synthetic
SEKEEAAKAAEEAAEIAERADEKAARSSKEAAKIAEKADKEAAESTRKALDDARRALEEAPADTRARDLARKLAREAEESLKEHKKISEELKKRLDESLKEHREISERLKKELKELREADRDLDELARELERLAKEHADSLREHARRSRELAEEHVKSLKRHAEESEKLAERAAREASDEDAARRAEKAARENADSIRRAAEKSRKAAEDNARSIEKAARESEEAAERAARILKRAKD

SEQ ID NO: 13919 - protein, 238 aa, Artificial Sequence; identical to SEQ ID NO: 13918
  Synthetic

SEQ ID NO: 13920 - protein, 229 aa, Artificial Sequence
  Synthetic
KEVEDVVEKLRELIDRALDRNRKVVEEVRDVVRRALEENRKVVEEVRKVIKEILDRVDDETVRTVVELLERLLDEHLRIVEEIVRLLTDLLRRHLRVVEDIVRLLRELLKILTELRRREELEKIARRLLETIDRLIRTLERLYDEAREEIEKLIRELERLYREVDKRIKEAGLPKEATDLIRELIERLRKVLEKSRRLIDRLVKLSRDVLEETKRLVEELIREVKRAET

SEQ ID NO: 13921 - protein, 229 aa, Artificial Sequence; identical to SEQ ID NO: 13920
  Synthetic

SEQ ID NO: 13922 - protein, 240 aa, Artificial Sequence
  Synthetic
KLEEIVKKLEDLNKKAVEILRRVLEEHEKLVEKVKKVLRDVLRLLEKVVREVIETLKKKDTDEKVREALKELEEVVRKIKEEVEKVLKRLEEVSKRLKDEVRRVLKESEDVAKKIRRDVRRVRSKDAAKRATDLLKETLRILEEAIRRIVKVIEDSLEILREAVERIVRLLEELLKILARIGLDEEVLRKLKEIIKELKDRLKKLLDDYERIIDELRRELERVLREYEKILEDLRKELED

SEQ ID NO: 13923 - protein, 240 aa, Artificial Sequence; identical to SEQ ID NO: 13922
  Synthetic

SEQ ID NO: 13924 - protein, 237 aa, Artificial Sequence
  Synthetic
SELEEAAKALERIAKKAAKAARDWAEEDRRLAEEAIRAAEEWAKENKKLADELAKAAKDNRDEKDLRRILEEVKKRSEKLAREAKKVLKRIADDSKRLAEEAEEVLKRAADELKKIADELRKRGAGAKEAEDVAKKALDAAREAVEEAKDVNREALKLAEEAVREAERVNREAARLAEEARSDEAVRALEEAAKRSEDAARKAAKLARDAAEKSRRAAEKAIRLLEEAAKEAKDAAR

SEQ ID NO: 13925 - protein, 237 aa, Artificial Sequence; identical to SEQ ID NO: 13924
  Synthetic

SEQ ID NO: 13926 - protein, 239 aa, Artificial Sequence
  Synthetic
KEAEEIAEAVKRLAEASAKTAEELARAVRKAAEDLVKLAKEHADALRTAADRIAKLIEAEEAARKALEAAKKAIEDNERAAKEALEAAKRAIDIIREAAERSKKAAEEAIDIIRRAKEGREDIERALRELLKANRKAVEDAKRALKELADAAREAVKKAKETAERLIEAIKRAADEAPASEDIRREIKRIADELKEITKRLEDEVEKIIRRLEKIAKEAEDRHRKLAEELRRIAEEAKR

SEQ ID NO: 13927 - protein, 239 aa, Artificial Sequence; identical to SEQ ID NO: 13926
  Synthetic

SEQ ID NO: 13928 - protein, 241 aa, Artificial Sequence
  Synthetic
SVDEALEELVRRLLEVLKTVLERTKELSRDDLRVVKEVLRIIEELVKRLLKVIRDGLDDADRVLEEVERVIREAKREVKRWEEVVRKVVEDSRRLIERVLREVEEVIKEAKRLLDERKLGGRREVIEELLRLLREIVRHHKEVSDEHLKLSAELVKRILDVVEETLRLATEIVRRIKEEGNSEDVRRDIERLLEELKRRVERLLEDIERLLRELEKLNEDVLRENKKLLEDLERRVRERKK

SEQ ID NO: 13929 - protein, 241 aa, Artificial Sequence; identical to SEQ ID NO: 13928
  Synthetic

SEQ ID NO: 13930 - protein, 237 aa, Artificial Sequence
  Synthetic
DEERIVREIVKIIEEAVKELVRLVREDIELVKDVVRRHNRLNEEIVKLWKELVDEVLKSRDAEELRRILERIKRLHEENSRRLKEVVERWVKLLKESLEKLEDVARKAREKLKTVLDKPRGEELIKDLARVVEEVLRLLEEVIKTHAEINKRALELLKEVSKHAADIVREALKLAAEVVDDKDLLRRAEEEIRRLLKENEDILKRVEEEVKKSNEELRRILDRVRRELEKALKRLRD

SEQ ID NO: 13931 - protein, 237 aa, Artificial Sequence; identical to SEQ ID NO: 13930
  Synthetic

SEQ ID NO: 13932 - protein, 243 aa, Artificial Sequence
  Synthetic
SKEEEVKRLIDELKRVNERVNKTIKELVKLLEESHEEVLKEIERLIREVLRVIKEVIEAVDKDRKLERLEEKVRKVVEELKRLLDRSRRILRELIKTIDRLLTEHRKEVDKVVRELRELLRAGADAKELLKILEDLLRKSKEVVKRILDIIRKLLEDSRKVVEELVKLIADLLEEILRALKEGRKEALDKLVDAARRVLEAVRDVLRKDERSVERVLDEVRRVAEELERTHREVVKRVEDAAR

SEQ ID NO: 13933 - protein, 243 aa, Artificial Sequence; identical to SEQ ID NO: 13932
  Synthetic

SEQ ID NO: 13934 - protein, 243 aa, Artificial Sequence
  Synthetic
DKEKTVADLIEKVERSHERVLKRLAELIEELKRVNERVNREIERLIRELEEVIDRVIKAVDPDKKLEELEKKVREVSRRLEEILRDHERLVRKVVEELKELLDRSRRLVREVVRKLKKLLEDGSDAKDLLRIIADLLRLSDEVVKELLKLNEKLLKLSEEVVREILKLVKDLLEDLKRALEEGRREMLEELVRVARRVLEAIKTVADELRKRHEEVSREIERVAEEDKRTVEEVLKRIEDAAR

SEQ ID NO: 13935 - protein, 243 aa, Artificial Sequence; identical to SEQ ID NO: 13934
  Synthetic

SEQ ID NO: 13936 - protein, 233 aa, Artificial Sequence
  Synthetic
KDEEIIKRLEDLLKENVDRLREILERVERTHRKVIEELKRILEELEEILRRVIEKLRRKNTLDDKLIKKIEEVLKRLLEVLDELLKRIEKASRESLDSTRRLLDSHEKVLREALRVLREIDGERVLEEVKRVVEDVIREWEEALERNKRVVEKLIKTVEDILKRIDEVVRRLIEAVESRDVERLLKELKRIVEEILRLVRELVTRDIDALRRLLESVRRLVDKLIRIVEERRR

SEQ ID NO: 13937 - protein, 233 aa, Artificial Sequence; identical to SEQ ID NO: 13936
  Synthetic

SEQ ID NO: 13938 - protein, 242 aa, Artificial Sequence
  Synthetic
SDKDRLLEEIKRLIDESRRKAEEILKRSTELLEDSKRDLREILRRSEKILDELLDLIRRNELPEKDLLRELEEVVKENLELAERLSKKLEDIVRENRDLLEKLSRLLVKILKEIVKMVEEAGLDEELTKLIEEVLEDNKRAVKELEEKLKESLKRNKRVVDDLRDKLRKSLEELKDVVTRLRSKEIKDALRRVLEKHKKVLREAIKKHEESLEEHRKVLEEIIELHKRSLKKLEDVIDTVRK

SEQ ID NO: 13939 - protein, 242 aa, Artificial Sequence; identical to SEQ ID NO: 13938
  Synthetic

SEQ ID NO: 13940 - protein, 236 aa, Artificial Sequence
  Synthetic
SKEELIKELKETVKRIIKLLEELSKKMEEIIKRIAELLRELSKKLVDIIKRIIELLRREGAEEEIVKRLDDVAKKNNEAVREIVEELRRIVKENREAVERVAKRLRDVLREVDRVVKELTGEDLKRELDRVLKLLLRILEDAVRELKRSLDEVRKVLKRVVEMHRTSLKELEDILRKVDVREEILKEIKRLLDESKERLDRVLREIEELLRRYEEEVRRVLEEIKKILDELRERIR

SEQ ID NO: 13941 - protein, 236 aa, Artificial Sequence; identical to SEQ ID NO: 13940
  Synthetic

SEQ ID NO: 13942 - protein, 234 aa, Artificial Sequence
  Synthetic
DTERAADEARRRLEKLARDHKEKLKKAAEDLRRLLEEAERAHRKIEKELEELTRKVRDLERAAEELLKLAEEAAKASEEAARRLLEIAERIAKSNEDAARELLKIAEDLARRAEKEEAARRLLEAAKRAAEDSRESAKDLLRAAREAAEKIKKSARELLKAAEDAAKTIRDAKDREDAERALKEAADRAREALRRNLRALREAVREAEEAIEKDARAIDEALKKAREAIEEAER

SEQ ID NO: 13943 - protein, 234 aa, Artificial Sequence; identical to SEQ ID NO: 13942
  Synthetic

SEQ ID NO: 13944 - protein, 238 aa, Artificial Sequence
  Synthetic
SKVEELAERAARSHKELADAIRELAREAAESHKEAAEVVKRLADEAARAAKEVAKAIEDETAAKILEEAAREALRAAEEAIKLLEDSAREVLRLAEEAIRLNEEAAKRVLDAAREAAELEDKEAVDRALKRALKISRDALEEAKKIAKEALELSKRAADEAARIAKEALETAEDALRKAVRDRKVLEDAKKILEDLRKKAEDALRKHKKILDELEEKAKKAAEKHERILRKLDEDAKR

SEQ ID NO: 13945 - protein, 238 aa, Artificial Sequence; identical to SEQ ID NO: 13944
  Synthetic

SEQ ID NO: 13946 - protein, 242 aa, Artificial Sequence
  Synthetic
SEDEEVLKDIKRLLEEVKKTLEEVAKRHEKALREIEERVKEIVKEHEDLLKEVEDKARSNTIDEKDLVEMLRRIHERTVKLIDELVKTLLRLNEETVKALEDLVRKLLKILKDVLERVKDKRVLDLIRELIKKVKDDADKLLELLREVIKRSADIAKEIRDLLDKVIKDSERILDEARRLKNKEDLDRLLKEVLDISRKVLEEVLKIIKRVLEISKRVLEEILRRIEKVLRDIDRVLKKLRE

SEQ ID NO: 13947 - protein, 242 aa, Artificial Sequence; identical to SEQ ID NO: 13946
  Synthetic

SEQ ID NO: 13948 - protein, 238 aa, Artificial Sequence
  Synthetic
SREEDLARKIAEAVKELLDADRRLLREIEKLAEELLRINEELLRRLEELARELLEAVDDERVVDELRRVAERIRRVVERATRELKRVLDEIRRISEKSIRDLEKVLEEIRKIIDDVSRLERKEEVLRVIKEILERLEKVLEEVRDVNRKILERLKEVLEEWERINRELLRIAREVLEKVKVEERLLRKLEEILRRLKDESRKVLKKVKEILDRLKRETEEILDKVRKILERLEEEVRR

SEQ ID NO: 13949 - protein, 238 aa, Artificial Sequence; identical to SEQ ID NO: 13948
  Synthetic

SEQ ID NO: 13950 - protein, 238 aa, Artificial Sequence
  Synthetic
SAEEAAEEALRRAAEAAKESIKAAREALEEVRKAAEKSIRAAEKALRDVKKAAEEAKSAKDEETAKRAAEKALKALKEAIEINAKAAEEALRALREANRINREAAEKALKAAKEALDRANLPDKKLKTAEDLLRKAKKEVEDANRRSEKLIREAEERVRRALKRSKELLKKLEDDARRERAIEEAAKKAIDLARDHARLVKKIAKDLIDLAKEHADLVREIAKRIIEAAKRIAEIVRK

SEQ ID NO: 13951 - protein, 238 aa, Artificial Sequence; identical to SEQ ID NO: 13950
  Synthetic

SEQ ID NO: 13952 - protein, 230 aa, Artificial Sequence
  Synthetic
SDEELLEEIKKILDEVLKKNADAVRSLEKVLDKVLEDNARAVEELKTVLDKVLRDLERRGVGDEEIRELLERLKRELDEALKELAKEYEKLKETLRRVLEELADLYREAKERADRDPDKRKIVEELAKLLDRDVKLNRDLARRVLRLLERDLRVNKELVDRAREVLDEILKRNEDKDVEEVVKEVRDVLRESVDKVRRVIEEVKRVLDRSSEEVERAVEEVKRVLDKVRK

SEQ ID NO: 13953 - protein, 230 aa, Artificial Sequence; identical to SEQ ID NO: 13952
  Synthetic

SEQ ID NO: 13954 - protein, 239 aa, Artificial Sequence
  Synthetic
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLEGSDDLRELKKRIEDLLKEDKERLEKIARDIERDLERYARDLKRLEDELREDIERARR

SEQ ID NO: 13955 - protein, 239 aa, Artificial Sequence; identical to SEQ ID NO: 13954
  Synthetic

SEQ ID NO: 13956 - protein, 239 aa, Artificial Sequence; identical to SEQ ID NO: 13954
  Synthetic

SEQ ID NO: 13957 - protein, 239 aa, Artificial Sequence; identical to SEQ ID NO: 13954
  Synthetic

SEQ ID NO: 13958 - protein, 238 aa, Artificial Sequence
  Synthetic
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 13959 - protein, 238 aa, Artificial Sequence; identical to SEQ ID NO: 13958
  Synthetic

SEQ ID NO: 13960 - protein, 238 aa, Artificial Sequence; identical to SEQ ID NO: 13958
  Synthetic

SEQ ID NO: 13961 - protein, 238 aa, Artificial Sequence; identical to SEQ ID NO: 13958
  Synthetic

SEQ ID NO: 13962 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 13963 - protein, 245 aa, Artificial Sequence; identical to SEQ ID NO: 13962
  Synthetic

SEQ ID NO: 13964 - protein, 245 aa, Artificial Sequence; identical to SEQ ID NO: 13962
  Synthetic

SEQ ID NO: 13965 - protein, 245 aa, Artificial Sequence; identical to SEQ ID NO: 13962
  Synthetic

SEQ ID NO: 13966 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLEEKIRKIKRELDDLSARLREKIERTRK

SEQ ID NO: 13967 - protein, 234 aa, Artificial Sequence; identical to SEQ ID NO: 13966
  Synthetic

SEQ ID NO: 13968 - protein, 234 aa, Artificial Sequence; identical to SEQ ID NO: 13966
  Synthetic

SEQ ID NO: 13969 - protein, 234 aa, Artificial Sequence; identical to SEQ ID NO: 13966
  Synthetic

SEQ ID NO: 13970 - protein, 238 aa, Artificial Sequence
  Synthetic
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 13971 - protein, 238 aa, Artificial Sequence; identical to SEQ ID NO: 13970
  Synthetic

SEQ ID NO: 13972 - protein, 238 aa, Artificial Sequence; identical to SEQ ID NO: 13970
  Synthetic

SEQ ID NO: 13973 - protein, 238 aa, Artificial Sequence; identical to SEQ ID NO: 13970
  Synthetic

SEQ ID NO: 13974 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 13975 - protein, 243 aa, Artificial Sequence; identical to SEQ ID NO: 13974
  Synthetic

SEQ ID NO: 13976 - protein, 243 aa, Artificial Sequence; identical to SEQ ID NO: 13974
  Synthetic

SEQ ID NO: 13977 - protein, 243 aa, Artificial Sequence; identical to SEQ ID NO: 13974
  Synthetic

SEQ ID NO: 13978 - protein, 236 aa, Artificial Sequence
  Synthetic
SAEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIGLPEEVVEELKEENKRLRDRLDKLVKDLKKTNKEIEDKLRKLAEELKEELERIADRIRKTGTDRKTLLREIEKLLKTLEDILRDLLRLVEKTLKELEEILKDLVDKARENLKRLRERIR

SEQ ID NO: 13979 - protein, 236 aa, Artificial Sequence; identical to SEQ ID NO: 13978
  Synthetic

SEQ ID NO: 13980 - protein, 236 aa, Artificial Sequence; identical to SEQ ID NO: 13978
  Synthetic

SEQ ID NO: 13981 - protein, 236 aa, Artificial Sequence; identical to SEQ ID NO: 13978
  Synthetic

SEQ ID NO: 13982 - protein, 239 aa, Artificial Sequence
  Synthetic
SEKEELKRLLDKLLKELKRLSDELKATIDKILKILKEVSEEVKRTADELLDAIRRGGVDEEVLREIKREIEEIEKKLRKVNKEIEDEIREIKKKLDEVDDKITKEVEKIKEALDKGGVDAKEVIKALKEILKEHADVFEDVLRRLKEIIKRHRDVVKEVLEELRKILEKVAEVLKRQGRSEDELRKVEEDLKRLEDKLKKLLEDYEKKVRELEETLDDLLRKYEETLRRLEKELEEAER

SEQ ID NO: 13983 - protein, 239 aa, Artificial Sequence; identical to SEQ ID NO: 13982
  Synthetic

SEQ ID NO: 13984 - protein, 239 aa, Artificial Sequence; identical to SEQ ID NO: 13982
  Synthetic

SEQ ID NO: 13985 - protein, 239 aa, Artificial Sequence; identical to SEQ ID NO: 13982
  Synthetic

SEQ ID NO: 13986 - protein, 244 aa, Artificial Sequence
  Synthetic
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKKLLELLEEALRANRRLVEDILKIADEARK

SEQ ID NO: 13987 - protein, 244 aa, Artificial Sequence; identical to SEQ ID NO: 13986
  Synthetic

SEQ ID NO: 13988 - protein, 244 aa, Artificial Sequence; identical to SEQ ID NO: 13986
  Synthetic

SEQ ID NO: 13989 - protein, 244 aa, Artificial Sequence; identical to SEQ ID NO: 13986
  Synthetic

SEQ ID NO: 13990 - protein, 247 aa, Artificial Sequence
  Synthetic
SATERVLDLARDLIRILLEIHKRALKLIAELVSKLLKIHEDVLKLSEELVEELLEIVKRGLPREDLLRALKELLEKIEDVVRDIERRHRDLLREAEEVVEKLKREHEEVKERIERAVKKLAEDGVDKDKLKELVDVLEEILRLSKTTLEELVKALRDVIRASLEALKENLRILRKIIRELEGLEGVDEDTLRRVLERIREEVERVKEKHRRLLEELKKLLEELRARSADLLEDIKRKVRELEEKTRR

SEQ ID NO: 13991 - protein, 247 aa, Artificial Sequence; identical to SEQ ID NO: 13990
  Synthetic

SEQ ID NO: 13992 - protein, 247 aa, Artificial Sequence; identical to SEQ ID NO: 13990
  Synthetic

SEQ ID NO: 13993 - protein, 247 aa, Artificial Sequence; identical to SEQ ID NO: 13990
  Synthetic

SEQ ID NO: 13994 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 13995 - protein, 244 aa, Artificial Sequence; identical to SEQ ID NO: 13994
  Synthetic

SEQ ID NO: 13996 - protein, 244 aa, Artificial Sequence; identical to SEQ ID NO: 13994
  Synthetic

SEQ ID NO: 13997 - protein, 244 aa, Artificial Sequence; identical to SEQ ID NO: 13994
  Synthetic

SEQ ID NO: 13998 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 13999 - protein, 250 aa, Artificial Sequence; identical to SEQ ID NO: 13998
  Synthetic

SEQ ID NO: 14000 - protein, 250 aa, Artificial Sequence; identical to SEQ ID NO: 13998
  Synthetic

SEQ ID NO: 14001 - protein, 250 aa, Artificial Sequence; identical to SEQ ID NO: 13998
  Synthetic

SEQ ID NO: 14002 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 14003 - protein, 247 aa, Artificial Sequence; identical to SEQ ID NO: 14002
  Synthetic

SEQ ID NO: 14004 - protein, 247 aa, Artificial Sequence; identical to SEQ ID NO: 14002
  Synthetic

SEQ ID NO: 14005 - protein, 247 aa, Artificial Sequence; identical to SEQ ID NO: 14002
  Synthetic

SEQ ID NO: 14006 - protein, 236 aa, Artificial Sequence
  Synthetic
SRAERIKRALEEHIRKLKEITDEVRKTNEELLELTRRILEEAKKANEELVKKIREAGDKSKELEEEIRKLIEESERIVEELEERSKELLKRSREEVEEWRRRSEELLRRLEAILRGVKDEKELVERAVKILRDDSRIAKEILRRNLRLIEENLERLKEIIERNLDLLRRLLELLKRAGVDEEALKELEEKLDRYRRKLEDLLRKYAKKLEDYKRKVKKLEEENEELLKRIEKEMEK

SEQ ID NO: 14007 - protein, 236 aa, Artificial Sequence; identical to SEQ ID NO: 14006
  Synthetic

SEQ ID NO: 14008 - protein, 236 aa, Artificial Sequence; identical to SEQ ID NO: 14006
  Synthetic

SEQ ID NO: 14009 - protein, 236 aa, Artificial Sequence; identical to SEQ ID NO: 14006
  Synthetic

SEQ ID NO: 14010 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 14011 - protein, 238 aa, Artificial Sequence; identical to SEQ ID NO: 14010
  Synthetic

SEQ ID NO: 14012 - protein, 238 aa, Artificial Sequence; identical to SEQ ID NO: 14010
  Synthetic

SEQ ID NO: 14013 - protein, 238 aa, Artificial Sequence; identical to SEQ ID NO: 14010
  Synthetic

SEQ ID NO: 14014 - protein, 248 aa, Artificial Sequence
  Synthetic
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKVHEESLRKLLTLAAKVLEVLRKITK

SEQ ID NO: 14015 - protein, 248 aa, Artificial Sequence; identical to SEQ ID NO: 14014
  Synthetic

SEQ ID NO: 14016 - protein, 248 aa, Artificial Sequence; identical to SEQ ID NO: 14014
  Synthetic

SEQ ID NO: 14017 - protein, 248 aa, Artificial Sequence; identical to SEQ ID NO: 14014
  Synthetic

SEQ ID NO: 14018 - protein, 244 aa, Artificial Sequence
  Synthetic
DDERRKLEDLERMVEELKRKSDKLLKEIREEVERLERETRKLLEELKAKVDELREDLRRNPGDRVLEKLVKLLEDILDKVRKLLKENLDLLKRLLDIIEKLLRDNVRLLEELLRIVRELGKSGDEEKLTRKLEKALKEVRDAARETRERLKEAKKEVKTVADRNRARLEELEEEVKRVLDEIRKEGGPSEDLEKAERLVKDILRLNEEHTAELEDVVRDLLRALEKHTRDLEKLVKDALDKVKT

SEQ ID NO: 14019 - protein, 244 aa, Artificial Sequence; identical to SEQ ID NO: 14018
  Synthetic

SEQ ID NO: 14020 - protein, 244 aa, Artificial Sequence; identical to SEQ ID NO: 14018
  Synthetic

SEQ ID NO: 14021 - protein, 244 aa, Artificial Sequence; identical to SEQ ID NO: 14018
  Synthetic

SEQ ID NO: 14022 - protein, 244 aa, Artificial Sequence
  Synthetic
SKIDEALKKLAKILEDAIKLNKELNDTTAEILKEIIKLNAEVLEKIRRILKELVDLILKGLKDDEEAKKELKKVLEEVARRLEEIKKETDRIVKEVEELNERNDREVKRAAEEVRRLLEEIKRSDRDEKELIKALKEIVDRIREAHRRSVEELSEVVKRILDALKDTLRKLEDVVRKLLELARRIAGDTEELRRVVEKVRKELEDDKERYKRLEEEVRRLLEEMKRRSEDLERKVEEILRRLTE

SEQ ID NO: 14023 - protein, 244 aa, Artificial Sequence; identical to SEQ ID NO: 14022
  Synthetic

SEQ ID NO: 14024 - protein, 244 aa, Artificial Sequence; identical to SEQ ID NO: 14022
  Synthetic

SEQ ID NO: 14025 - protein, 244 aa, Artificial Sequence; identical to SEQ ID NO: 14022
  Synthetic

SEQ ID NO: 14026 - protein, 239 aa, Artificial Sequence
  Synthetic
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILEDNLRVLRRIIELIETLLEDNRRVLEEIIKLIEEATT

SEQ ID NO: 14027 - protein, 239 aa, Artificial Sequence; identical to SEQ ID NO: 14026
  Synthetic

SEQ ID NO: 14028 - protein, 239 aa, Artificial Sequence; identical to SEQ ID NO: 14026
  Synthetic

SEQ ID NO: 14029 - protein, 239 aa, Artificial Sequence; identical to SEQ ID NO: 14026
  Synthetic

SEQ ID NO: 14030 - protein, 244 aa, Artificial Sequence
  Synthetic
DELEKVERLLEEIEKIIEDLIRRVEELVRRILEFNKTTLKRNEELVRELEKLVKETTGGTEELKKIVEKLEKLHREVKKKSDDLVKRAEELLKEVKERLKEIVKTIREELRKVKESGGDREELLKLLAEILDKLLKLLKRIIEELLRILKELIKASKESLDDLKRINEELLRDIEDLIRKGIKESKEVVRKLEEDLRRVRERSKKLVREHEKFLEDLEETIKEEKRRVDEELKRIKEEIKETRR

SEQ ID NO: 14031 - protein, 244 aa, Artificial Sequence; identical to SEQ ID NO: 14030
  Synthetic

SEQ ID NO: 14032 - protein, 244 aa, Artificial Sequence; identical to SEQ ID NO: 14030
  Synthetic

SEQ ID NO: 14033 - protein, 244 aa, Artificial Sequence; identical to SEQ ID NO: 14030
  Synthetic

SEQ ID NO: 14034 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 14035 - protein, 242 aa, Artificial Sequence; identical to SEQ ID NO: 14034
  Synthetic

SEQ ID NO: 14036 - protein, 242 aa, Artificial Sequence; identical to SEQ ID NO: 14034
  Synthetic

SEQ ID NO: 14037 - protein, 242 aa, Artificial Sequence; identical to SEQ ID NO: 14034
  Synthetic

SEQ ID NO: 14038 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 14039 - protein, 247 aa, Artificial Sequence; identical to SEQ ID NO: 14038
  Synthetic

SEQ ID NO: 14040 - protein, 247 aa, Artificial Sequence; identical to SEQ ID NO: 14038
  Synthetic

SEQ ID NO: 14041 - protein, 247 aa, Artificial Sequence; identical to SEQ ID NO: 14038
  Synthetic

SEQ ID NO: 14042 - protein, 240 aa, Artificial Sequence
  Synthetic
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 14043 - protein, 240 aa, Artificial Sequence; identical to SEQ ID NO: 14042
  Synthetic

SEQ ID NO: 14044 - protein, 240 aa, Artificial Sequence; identical to SEQ ID NO: 14042
  Synthetic

SEQ ID NO: 14045 - protein, 240 aa, Artificial Sequence; identical to SEQ ID NO: 14042
  Synthetic

SEQ ID NO: 14046 - protein, 248 aa, Artificial Sequence
  Synthetic
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 14047 - protein, 248 aa, Artificial Sequence; identical to SEQ ID NO: 14046
  Synthetic

SEQ ID NO: 14048 - protein, 248 aa, Artificial Sequence; identical to SEQ ID NO: 14046
  Synthetic

SEQ ID NO: 14049 - protein, 248 aa, Artificial Sequence; identical to SEQ ID NO: 14046
  Synthetic

SEQ ID NO: 14050 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 14051 - protein, 248 aa, Artificial Sequence; identical to SEQ ID NO: 14050
  Synthetic

SEQ ID NO: 14052 - protein, 248 aa, Artificial Sequence; identical to SEQ ID NO: 14050
  Synthetic

SEQ ID NO: 14053 - protein, 248 aa, Artificial Sequence; identical to SEQ ID NO: 14050
  Synthetic

SEQ ID NO: 14054 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELERLLRENRRRLEELAREAKKVLDELRKRLEDERR

SEQ ID NO: 14055 - protein, 251 aa, Artificial Sequence; identical to SEQ ID NO: 14054
  Synthetic

SEQ ID NO: 14056 - protein, 251 aa, Artificial Sequence; identical to SEQ ID NO: 14054
  Synthetic

SEQ ID NO: 14057 - protein, 251 aa, Artificial Sequence; identical to SEQ ID NO: 14054
  Synthetic

SEQ ID NO: 14058 - protein, 242 aa, Artificial Sequence
  Synthetic
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAEDNERVLERIIRELTDNLERHLKIVREIVK

SEQ ID NO: 14059 - protein, 242 aa, Artificial Sequence; identical to SEQ ID NO: 14058
  Synthetic

SEQ ID NO: 14060 - protein, 242 aa, Artificial Sequence; identical to SEQ ID NO: 14058
  Synthetic

SEQ ID NO: 14061 - protein, 242 aa, Artificial Sequence; identical to SEQ ID NO: 14058
  Synthetic

SEQ ID NO: 14062 - protein, 244 aa, Artificial Sequence
  Synthetic
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVRKSLKELKELLDKSKKLLEDSKRRLEEILKEIKDDSR

SEQ ID NO: 14063 - protein, 244 aa, Artificial Sequence; identical to SEQ ID NO: 14062
  Synthetic

SEQ ID NO: 14064 - protein, 244 aa, Artificial Sequence; identical to SEQ ID NO: 14062
  Synthetic

SEQ ID NO: 14065 - protein, 244 aa, Artificial Sequence; identical to SEQ ID NO: 14062
  Synthetic

SEQ ID NO: 14066 - protein, 244 aa, Artificial Sequence
  Synthetic
SLKEIVKEIIDRASELLKRLLERSEDSLRTASELLRKILEDSRRSLRTIARLLEELLRTSGPEEELERAARRVKEELERLHKEIRDVIEEIKKTLAKLNEDLREAIERVKRELERLLKELEDSGVPEELLELVKRVVELMAELLDRLLALNEKILRDIMSILDEILDLNREILRLVKEIIELIRRDGPDREIEKEIRRILEELKAKHDEIEKKIRELEREIKRAHEELEDRIRKIERDLDRRTK

SEQ ID NO: 14067 - protein, 244 aa, Artificial Sequence; identical to SEQ ID NO: 14066
  Synthetic

SEQ ID NO: 14068 - protein, 244 aa, Artificial Sequence; identical to SEQ ID NO: 14066
  Synthetic

SEQ ID NO: 14069 - protein, 244 aa, Artificial Sequence; identical to SEQ ID NO: 14066
  Synthetic

SEQ ID NO: 14070 - protein, 242 aa, Artificial Sequence
  Synthetic
SSEELLKRIVDEDERVLEEWARVLEEIKDLSKAVVDLLDKVLKEIEAIVDEVTRRLERDGTDDKKKIRDLVEEIKDIIRRAREKLRRIVKENEEILEEAKRRLDKIAEDNRRTLEKVRKELEETKSEREVKRILERVLREAEDSHRRAVELLEELLDRSRRTIEEAIRLIKELLDRILELLKRLGLPKDLLETIKKRVEEIRRTLEKIKRDYDKAIEEIRAKLERKLEEYKEVIDDLRRKTK

SEQ ID NO: 14071 - protein, 242 aa, Artificial Sequence; identical to SEQ ID NO: 14070
  Synthetic

SEQ ID NO: 14072 - protein, 242 aa, Artificial Sequence; identical to SEQ ID NO: 14070
  Synthetic

SEQ ID NO: 14073 - protein, 242 aa, Artificial Sequence; identical to SEQ ID NO: 14070
  Synthetic

SEQ ID NO: 14074 - protein, 238 aa, Artificial Sequence; identical to SEQ ID NO: 13234
  Synthetic

SEQ ID NO: 14075 - protein, 238 aa, Artificial Sequence; identical to SEQ ID NO: 13234
  Synthetic

SEQ ID NO: 14076 - protein, 238 aa, Artificial Sequence; identical to SEQ ID NO: 13234
  Synthetic

SEQ ID NO: 14077 - protein, 238 aa, Artificial Sequence; identical to SEQ ID NO: 13234
  Synthetic

SEQ ID NO: 14078 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 14079 - protein, 231 aa, Artificial Sequence; identical to SEQ ID NO: 14078
  Synthetic

SEQ ID NO: 14080 - protein, 231 aa, Artificial Sequence; identical to SEQ ID NO: 14078
  Synthetic

SEQ ID NO: 14081 - protein, 231 aa, Artificial Sequence; identical to SEQ ID NO: 14078
  Synthetic

SEQ ID NO: 14082 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 14083 - protein, 236 aa, Artificial Sequence; identical to SEQ ID NO: 14082
  Synthetic

SEQ ID NO: 14084 - protein, 236 aa, Artificial Sequence; identical to SEQ ID NO: 14082
  Synthetic

SEQ ID NO: 14085 - protein, 236 aa, Artificial Sequence; identical to SEQ ID NO: 14082
  Synthetic

SEQ ID NO: 14086 - protein, 247 aa, Artificial Sequence
  Synthetic
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 14087 - protein, 247 aa, Artificial Sequence; identical to SEQ ID NO: 14086
  Synthetic

SEQ ID NO: 14088 - protein, 247 aa, Artificial Sequence; identical to SEQ ID NO: 14086
  Synthetic

SEQ ID NO: 14089 - protein, 247 aa, Artificial Sequence; identical to SEQ ID NO: 14086
  Synthetic

SEQ ID NO: 14090 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKVVDDLKKELERIKREVKRLIEENARTLADIKRAVDEARK

SEQ ID NO: 14091 - protein, 243 aa, Artificial Sequence; identical to SEQ ID NO: 14090
  Synthetic

SEQ ID NO: 14092 - protein, 243 aa, Artificial Sequence; identical to SEQ ID NO: 14090
  Synthetic

SEQ ID NO: 14093 - protein, 243 aa, Artificial Sequence; identical to SEQ ID NO: 14090
  Synthetic

SEQ ID NO: 14094 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 14095 - protein, 239 aa, Artificial Sequence; identical to SEQ ID NO: 14094
  Synthetic

SEQ ID NO: 14096 - protein, 239 aa, Artificial Sequence; identical to SEQ ID NO: 14094
  Synthetic

SEQ ID NO: 14097 - protein, 239 aa, Artificial Sequence; identical to SEQ ID NO: 14094
  Synthetic

SEQ ID NO: 14098 - protein, 241 aa, Artificial Sequence
  Synthetic
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRILRRILELLRRHHDTNRKIVKRILELLRRVLESIRK

SEQ ID NO: 14099 - protein, 241 aa, Artificial Sequence; identical to SEQ ID NO: 14098
  Synthetic

SEQ ID NO: 14100 - protein, 241 aa, Artificial Sequence; identical to SEQ ID NO: 14098
  Synthetic

SEQ ID NO: 14101 - protein, 241 aa, Artificial Sequence; identical to SEQ ID NO: 14098
  Synthetic

SEQ ID NO: 14102 - protein, 241 aa, Artificial Sequence
  Synthetic
SKKELLEEVVRRAIELLKRHLEKLKRILEEIVRLLEEHLEKVERVLEAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELRRLDKAIKDRLRELKKDLDEANRRIKETLKKLLREVEK

SEQ ID NO: 14103 - protein, 241 aa, Artificial Sequence; identical to SEQ ID NO: 14102
  Synthetic

SEQ ID NO: 14104 - protein, 241 aa, Artificial Sequence; identical to SEQ ID NO: 14102
  Synthetic

SEQ ID NO: 14105 - protein, 241 aa, Artificial Sequence; identical to SEQ ID NO: 14102
  Synthetic

SEQ ID NO: 14106 - protein, 238 aa, Artificial Sequence
  Synthetic
SDLEELEALIRRLLKINEDLIRIIEDLIRKSLTLLKRIVDLIRELIREIEEIIRRTGIPKELVDEAREKIKRILDEVERLLRELAKAHREILEELRANLERVRRELKKILDRLRDLKRGSGSEEEIRKLIEELLKVHKESLDSIRRLIEKLLRVHETALRRLAELIRRLLEVLKEVLDKGPVSEEIRKRVRDLEEKVKKLLRDLEEESRRVAEKVEEDLKRVEEESRRTAREVEEKER

SEQ ID NO: 14107 - protein, 238 aa, Artificial Sequence; identical to SEQ ID NO: 14106
  Synthetic

SEQ ID NO: 14108 - protein, 238 aa, Artificial Sequence; identical to SEQ ID NO: 14106
  Synthetic

SEQ ID NO: 14109 - protein, 238 aa, Artificial Sequence; identical to SEQ ID NO: 14106
  Synthetic

SEQ ID NO: 14110 - protein, 234 aa, Artificial Sequence
  Synthetic
SERDVLRELLERIKKLLETLIRIVEELVRRSEETIKRLAELNRRLIEEIRRIVEEVKKGVSEEALRDVERLLKELADETEKILREVKKRLDDNLKRLEEIVRDVERLLKELKEEVDRGDKSKEELVREILKVAEEILRKIEELVKHHLDLNRDILRLFTESAEKLEEILREVLRKLGLDEEVKKRVEELRREYRETLKRLRDESEKIAEELKRLLDELRRRLEELARELRERTK

SEQ ID NO: 14111 - protein, 234 aa, Artificial Sequence; identical to SEQ ID NO: 14110
  Synthetic

SEQ ID NO: 14112 - protein, 234 aa, Artificial Sequence; identical to SEQ ID NO: 14110
  Synthetic

SEQ ID NO: 14113 - protein, 234 aa, Artificial Sequence; identical to SEQ ID NO: 14110
  Synthetic

SEQ ID NO: 14114 - protein, 241 aa, Artificial Sequence
  Synthetic
SKEELVKEIDELNKRVNDLLEELLRKSEKLHKEILELLERLLREIISLLRRILEIVERRLEDETLKRVLEKLEETLRRLKKKVDEELKRLEDENRRLKEEMDRLLRKSAEELERLREKVVRDGGSGDEVLARLLELHTEDLKHAREVLDEVLRLNKKALDLIRAILTEVLKLIKELLKLIEAGADEDELRRLLEDIERKIEALLRELKKESEEIRKRIRELLEDNRDKSRKIKKAIEELKK

SEQ ID NO: 14115 - protein, 241 aa, Artificial Sequence; identical to SEQ ID NO: 14114
  Synthetic

SEQ ID NO: 14116 - protein, 241 aa, Artificial Sequence; identical to SEQ ID NO: 14114
  Synthetic

SEQ ID NO: 14117 - protein, 241 aa, Artificial Sequence; identical to SEQ ID NO: 14114
  Synthetic

SEQ ID NO: 14118 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 14119 - protein, 246 aa, Artificial Sequence; identical to SEQ ID NO: 14118
  Synthetic

SEQ ID NO: 14120 - protein, 246 aa, Artificial Sequence; identical to SEQ ID NO: 14118
  Synthetic

SEQ ID NO: 14121 - protein, 246 aa, Artificial Sequence; identical to SEQ ID NO: 14118
  Synthetic

SEQ ID NO: 14122 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 14123 - protein, 231 aa, Artificial Sequence; identical to SEQ ID NO: 14122
  Synthetic

SEQ ID NO: 14124 - protein, 231 aa, Artificial Sequence; identical to SEQ ID NO: 14122
  Synthetic

SEQ ID NO: 14125 - protein, 231 aa, Artificial Sequence; identical to SEQ ID NO: 14122
  Synthetic

SEQ ID NO: 14126 - protein, 245 aa, Artificial Sequence
  Synthetic
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKNSKDILEEVRKLIDELRKRIKEVED

SEQ ID NO: 14127 - protein, 245 aa, Artificial Sequence; identical to SEQ ID NO: 14126
  Synthetic

SEQ ID NO: 14128 - protein, 245 aa, Artificial Sequence; identical to SEQ ID NO: 14126
  Synthetic

SEQ ID NO: 14129 - protein, 245 aa, Artificial Sequence; identical to SEQ ID NO: 14126
  Synthetic

SEQ ID NO: 14130 - protein, 247 aa, Artificial Sequence
  Synthetic
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 14131 - protein, 247 aa, Artificial Sequence; identical to SEQ ID NO: 14130
  Synthetic

SEQ ID NO: 14132 - protein, 247 aa, Artificial Sequence; identical to SEQ ID NO: 14130
  Synthetic

SEQ ID NO: 14133 - protein, 247 aa, Artificial Sequence; identical to SEQ ID NO: 14130
  Synthetic

SEQ ID NO: 14134 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 14135 - protein, 231 aa, Artificial Sequence; identical to SEQ ID NO: 14134
  Synthetic

SEQ ID NO: 14136 - protein, 231 aa, Artificial Sequence; identical to SEQ ID NO: 14134
  Synthetic

SEQ ID NO: 14137 - protein, 231 aa, Artificial Sequence; identical to SEQ ID NO: 14134
  Synthetic

SEQ ID NO: 14138 - protein, 235 aa, Artificial Sequence
  Synthetic
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLRRLLEVNETLVELNKRVWDRLVRINEELAEVALRVAT

SEQ ID NO: 14139 - protein, 235 aa, Artificial Sequence; identical to SEQ ID NO: 14138
  Synthetic

SEQ ID NO: 14140 - protein, 235 aa, Artificial Sequence; identical to SEQ ID NO: 14138
  Synthetic

SEQ ID NO: 14141 - protein, 235 aa, Artificial Sequence; identical to SEQ ID NO: 14138
  Synthetic

SEQ ID NO: 14142 - protein, 235 aa, Artificial Sequence
  Synthetic
SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVVRELEKVLKESLDTLEEIIRRLDEANAATVKRVADVIRELEDINRKVLEEIKRGSDDAEAVIKVIEKLIRANKRVWDALLKINEDLVRVNKTVWKELLRVNEKLARDLERVVK

SEQ ID NO: 14143 - protein, 235 aa, Artificial Sequence; identical to SEQ ID NO: 14142
  Synthetic

SEQ ID NO: 14144 - protein, 235 aa, Artificial Sequence; identical to SEQ ID NO: 14142
  Synthetic

SEQ ID NO: 14145 - protein, 235 aa, Artificial Sequence; identical to SEQ ID NO: 14142
  Synthetic

SEQ ID NO: 14146 - protein, 242 aa, Artificial Sequence
  Synthetic
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRIIEEHRKILERLLETHEDLIRKHEEILRRLLKAADEERQ

SEQ ID NO: 14147 - protein, 242 aa, Artificial Sequence; identical to SEQ ID NO: 14146
  Synthetic

SEQ ID NO: 14148 - protein, 242 aa, Artificial Sequence; identical to SEQ ID NO: 14146
  Synthetic

SEQ ID NO: 14149 - protein, 242 aa, Artificial Sequence; identical to SEQ ID NO: 14146
  Synthetic

SEQ ID NO: 14150 - protein, 233 aa, Artificial Sequence
  Synthetic
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHHVRVSTRIARLLLDVARKLAEVIKEAER

SEQ ID NO: 14151 - protein, 233 aa, Artificial Sequence; identical to SEQ ID NO: 14150
  Synthetic

SEQ ID NO: 14152 - protein, 233 aa, Artificial Sequence; identical to SEQ ID NO: 14150
  Synthetic

SEQ ID NO: 14153 - protein, 233 aa, Artificial Sequence; identical to SEQ ID NO: 14150
  Synthetic

SEQ ID NO: 14154 - protein, 238 aa, Artificial Sequence
  Synthetic
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 14155 - protein, 238 aa, Artificial Sequence; identical to SEQ ID NO: 14154
  Synthetic

SEQ ID NO: 14156 - protein, 238 aa, Artificial Sequence; identical to SEQ ID NO: 14154
  Synthetic

SEQ ID NO: 14157 - protein, 238 aa, Artificial Sequence; identical to SEQ ID NO: 14154
  Synthetic

SEQ ID NO: 14158 - protein, 246 aa, Artificial Sequence
  Synthetic
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRIHEKIVEDLIKLLEELLRRLEEATR

SEQ ID NO: 14159 - protein, 246 aa, Artificial Sequence; identical to SEQ ID NO: 14158
  Synthetic

SEQ ID NO: 14160 - protein, 246 aa, Artificial Sequence; identical to SEQ ID NO: 14158
  Synthetic

SEQ ID NO: 14161 - protein, 246 aa, Artificial Sequence; identical to SEQ ID NO: 14158
  Synthetic

SEQ ID NO: 14162 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 14163 - protein, 237 aa, Artificial Sequence; identical to SEQ ID NO: 14162
  Synthetic

SEQ ID NO: 14164 - protein, 237 aa, Artificial Sequence; identical to SEQ ID NO: 14162
  Synthetic

SEQ ID NO: 14165 - protein, 237 aa, Artificial Sequence; identical to SEQ ID NO: 14162
  Synthetic

SEQ ID NO: 14166 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 14167 - protein, 229 aa, Artificial Sequence; identical to SEQ ID NO: 14166
  Synthetic

SEQ ID NO: 14168 - protein, 229 aa, Artificial Sequence; identical to SEQ ID NO: 14166
  Synthetic

SEQ ID NO: 14169 - protein, 229 aa, Artificial Sequence; identical to SEQ ID NO: 14166
  Synthetic

SEQ ID NO: 14170 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 14171 - protein, 241 aa, Artificial Sequence; identical to SEQ ID NO: 14170
  Synthetic

SEQ ID NO: 14172 - protein, 241 aa, Artificial Sequence; identical to SEQ ID NO: 14170
  Synthetic

SEQ ID NO: 14173 - protein, 241 aa, Artificial Sequence; identical to SEQ ID NO: 14170
  Synthetic

SEQ ID NO: 14174 - protein, 248 aa, Artificial Sequence
  Synthetic
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLERLLELILRVLEYSVASLEELLRRLLEVIKRIVDTTK

SEQ ID NO: 14175 - protein, 248 aa, Artificial Sequence; identical to SEQ ID NO: 14174
  Synthetic

SEQ ID NO: 14176 - protein, 248 aa, Artificial Sequence; identical to SEQ ID NO: 14174
  Synthetic

SEQ ID NO: 14177 - protein, 248 aa, Artificial Sequence; identical to SEQ ID NO: 14174
  Synthetic

SEQ ID NO: 14178 - protein, 237 aa, Artificial Sequence
  Synthetic
DEDEIAEELKRLLREVEEASKEIVRRMRELAREANKASEDILRTLEKLLEELRRRVEESGGSSKAVLDKIREVLETLKELLDRHHETVRDLVRRLKELLDRHNETVAKLVEDIKALLDKSGGREEIKKRLEDALREHNRIIAEIKKLLDKVLKDHKDILDDIKKKLDDVLREVTEILKRGRIDEVVRRIERVIREVIKILARANKRLHDVVEEIIRLLEEVTDELRRVVEEVIRRTK

SEQ ID NO: 14179 - protein, 237 aa, Artificial Sequence; identical to SEQ ID NO: 14178
  Synthetic

SEQ ID NO: 14180 - protein, 237 aa, Artificial Sequence; identical to SEQ ID NO: 14178
  Synthetic

SEQ ID NO: 14181 - protein, 237 aa, Artificial Sequence; identical to SEQ ID NO: 14178
  Synthetic

SEQ ID NO: 14182 - protein, 246 aa, Artificial Sequence
  Synthetic
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKEALTRNLEKIDELLKLLHELSRRVIEELRKLLEDLKR

SEQ ID NO: 14183 - protein, 246 aa, Artificial Sequence; identical to SEQ ID NO: 14182
  Synthetic

SEQ ID NO: 14184 - protein, 246 aa, Artificial Sequence; identical to SEQ ID NO: 14182
  Synthetic

SEQ ID NO: 14185 - protein, 246 aa, Artificial Sequence; identical to SEQ ID NO: 14182
  Synthetic

SEQ ID NO: 14186 - protein, 240 aa, Artificial Sequence
  Synthetic
DEEELLREIKTILDESLKALEELIRKIMRILDKSLKDLEEIVREIKKTIDELLEKVRRSGLPEEVLKKVASVAEKVKEDIDRLLEDVERSHREVKKKLDELLKEVKRSHEEVKKELDSLRGDSDRDTVAREILRVLKKNLDVLAEVVEKIVKVLEDNLKSLKAVLETLVDLLRKLIKVLREGGLSEEALDDLRRLVKELADKLRKLLKDYKDLLKELKDEAKKLLDDYARLIEELEKKAR

SEQ ID NO: 14187 - protein, 240 aa, Artificial Sequence; identical to SEQ ID NO: 14186
  Synthetic

SEQ ID NO: 14188 - protein, 240 aa, Artificial Sequence; identical to SEQ ID NO: 14186
  Synthetic

SEQ ID NO: 14189 - protein, 240 aa, Artificial Sequence; identical to SEQ ID NO: 14186
  Synthetic

SEQ ID NO: 14190 - protein, 237 aa, Artificial Sequence
  Synthetic
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEDHKRSLDEVKKKLERLLERAKEVVEREKK

SEQ ID NO: 14191 - protein, 237 aa, Artificial Sequence; identical to SEQ ID NO: 14190
  Synthetic

SEQ ID NO: 14192 - protein, 237 aa, Artificial Sequence; identical to SEQ ID NO: 14190
  Synthetic

SEQ ID NO: 14193 - protein, 237 aa, Artificial Sequence; identical to SEQ ID NO: 14190
  Synthetic

SEQ ID NO: 14194 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 14195 - protein, 246 aa, Artificial Sequence; identical to SEQ ID NO: 14194
  Synthetic

SEQ ID NO: 14196 - protein, 246 aa, Artificial Sequence; identical to SEQ ID NO: 14194
  Synthetic

SEQ ID NO: 14197 - protein, 246 aa, Artificial Sequence; identical to SEQ ID NO: 14194
  Synthetic

SEQ ID NO: 14198 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 14199 - protein, 240 aa, Artificial Sequence; identical to SEQ ID NO: 14198
  Synthetic

SEQ ID NO: 14200 - protein, 240 aa, Artificial Sequence; identical to SEQ ID NO: 14198
  Synthetic

SEQ ID NO: 14201 - protein, 240 aa, Artificial Sequence; identical to SEQ ID NO: 14198
  Synthetic

SEQ ID NO: 14202 - protein, 252 aa, Artificial Sequence
  Synthetic
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 14203 - protein, 252 aa, Artificial Sequence; identical to SEQ ID NO: 14202
  Synthetic

SEQ ID NO: 14204 - protein, 252 aa, Artificial Sequence; identical to SEQ ID NO: 14202
  Synthetic

SEQ ID NO: 14205 - protein, 252 aa, Artificial Sequence; identical to SEQ ID NO: 14202
  Synthetic

SEQ ID NO: 14206 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 14207 - protein, 241 aa, Artificial Sequence; identical to SEQ ID NO: 14206
  Synthetic

SEQ ID NO: 14208 - protein, 241 aa, Artificial Sequence; identical to SEQ ID NO: 14206
  Synthetic

SEQ ID NO: 14209 - protein, 241 aa, Artificial Sequence; identical to SEQ ID NO: 14206
  Synthetic

SEQ ID NO: 14210 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 14211 - protein, 237 aa, Artificial Sequence; identical to SEQ ID NO: 14210
  Synthetic

SEQ ID NO: 14212 - protein, 237 aa, Artificial Sequence; identical to SEQ ID NO: 14210
  Synthetic

SEQ ID NO: 14213 - protein, 237 aa, Artificial Sequence; identical to SEQ ID NO: 14210
  Synthetic

SEQ ID NO: 14214 - protein, 237 aa, Artificial Sequence
  Synthetic
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKAKNDKILRDVEEVLRRHLEELARILKDVKKVLDEARK

SEQ ID NO: 14215 - protein, 237 aa, Artificial Sequence; identical to SEQ ID NO: 14214
  Synthetic

SEQ ID NO: 14216 - protein, 237 aa, Artificial Sequence; identical to SEQ ID NO: 14214
  Synthetic

SEQ ID NO: 14217 - protein, 237 aa, Artificial Sequence; identical to SEQ ID NO: 14214
  Synthetic

SEQ ID NO: 14218 - protein, 239 aa, Artificial Sequence
  Synthetic
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKILDENIELIRRIVRLLERLLRENLRLIEEARK

SEQ ID NO: 14219 - protein, 239 aa, Artificial Sequence; identical to SEQ ID NO: 14218
  Synthetic

SEQ ID NO: 14220 - protein, 239 aa, Artificial Sequence; identical to SEQ ID NO: 14218
  Synthetic

SEQ ID NO: 14221 - protein, 239 aa, Artificial Sequence; identical to SEQ ID NO: 14218
  Synthetic

SEQ ID NO: 14222 - protein, 248 aa, Artificial Sequence
  Synthetic
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKELRRLVEEAKEVVDRSVEILRDLVRKIVRILEESAR

SEQ ID NO: 14223 - protein, 248 aa, Artificial Sequence; identical to SEQ ID NO: 14222
  Synthetic

SEQ ID NO: 14224 - protein, 248 aa, Artificial Sequence; identical to SEQ ID NO: 14222
  Synthetic

SEQ ID NO: 14225 - protein, 248 aa, Artificial Sequence; identical to SEQ ID NO: 14222
  Synthetic

SEQ ID NO: 14226 - protein, 233 aa, Artificial Sequence
  Synthetic
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRELEKLVKRLEDILRESEKALRDLLSELAKVLEEVRT

SEQ ID NO: 14227 - protein, 233 aa, Artificial Sequence; identical to SEQ ID NO: 14226
  Synthetic

SEQ ID NO: 14228 - protein, 233 aa, Artificial Sequence; identical to SEQ ID NO: 14226
  Synthetic

SEQ ID NO: 14229 - protein, 233 aa, Artificial Sequence; identical to SEQ ID NO: 14226
  Synthetic

SEQ ID NO: 14230 - protein, 237 aa, Artificial Sequence
  Synthetic
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRVEELLKRSLEILRELIKAIADAIKESLDILDRLLREVAR

SEQ ID NO: 14231 - protein, 237 aa, Artificial Sequence; identical to SEQ ID NO: 14230
  Synthetic

SEQ ID NO: 14232 - protein, 237 aa, Artificial Sequence; identical to SEQ ID NO: 14230
  Synthetic

SEQ ID NO: 14233 - protein, 237 aa, Artificial Sequence; identical to SEQ ID NO: 14230
  Synthetic

SEQ ID NO: 14234 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 14235 - protein, 243 aa, Artificial Sequence; identical to SEQ ID NO: 14234
  Synthetic

SEQ ID NO: 14236 - protein, 243 aa, Artificial Sequence; identical to SEQ ID NO: 14234
  Synthetic

SEQ ID NO: 14237 - protein, 243 aa, Artificial Sequence; identical to SEQ ID NO: 14234
  Synthetic

SEQ ID NO: 14238 - protein, 245 aa, Artificial Sequence
  Synthetic
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 14239 - protein, 245 aa, Artificial Sequence; identical to SEQ ID NO: 14238
  Synthetic

SEQ ID NO: 14240 - protein, 245 aa, Artificial Sequence; identical to SEQ ID NO: 14238
  Synthetic

SEQ ID NO: 14241 - protein, 245 aa, Artificial Sequence; identical to SEQ ID NO: 14238
  Synthetic

SEQ ID NO: 14242 - protein, 239 aa, Artificial Sequence
  Synthetic
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 14243 - protein, 239 aa, Artificial Sequence; identical to SEQ ID NO: 14242
  Synthetic

SEQ ID NO: 14244 - protein, 239 aa, Artificial Sequence; identical to SEQ ID NO: 14242
  Synthetic

SEQ ID NO: 14245 - protein, 239 aa, Artificial Sequence; identical to SEQ ID NO: 14242
  Synthetic

SEQ ID NO: 14246 - protein, 232 aa, Artificial Sequence
  Synthetic
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRVLDLVDEVVKRVEDLVERVKEKIDT

SEQ ID NO: 14247 - protein, 232 aa, Artificial Sequence; identical to SEQ ID NO: 14246
  Synthetic

SEQ ID NO: 14248 - protein, 232 aa, Artificial Sequence; identical to SEQ ID NO: 14246
  Synthetic

SEQ ID NO: 14249 - protein, 232 aa, Artificial Sequence; identical to SEQ ID NO: 14246
  Synthetic

SEQ ID NO: 14250 - protein, 247 aa, Artificial Sequence
  Synthetic
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 14251 - protein, 247 aa, Artificial Sequence; identical to SEQ ID NO: 14250
  Synthetic

SEQ ID NO: 14252 - protein, 247 aa, Artificial Sequence; identical to SEQ ID NO: 14250
  Synthetic

SEQ ID NO: 14253 - protein, 247 aa, Artificial Sequence; identical to SEQ ID NO: 14250
  Synthetic

SEQ ID NO: 14254 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 14255 - protein, 243 aa, Artificial Sequence; identical to SEQ ID NO: 14254
  Synthetic

SEQ ID NO: 14256 - protein, 243 aa, Artificial Sequence; identical to SEQ ID NO: 14254
  Synthetic

SEQ ID NO: 14257 - protein, 243 aa, Artificial Sequence; identical to SEQ ID NO: 14254
  Synthetic

SEQ ID NO: 14258 - protein, 244 aa, Artificial Sequence
  Synthetic
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKALRVIEEILEDLARVNKKAVDAIDELAK

SEQ ID NO: 14259 - protein, 244 aa, Artificial Sequence; identical to SEQ ID NO: 14258
  Synthetic

SEQ ID NO: 14260 - protein, 244 aa, Artificial Sequence; identical to SEQ ID NO: 14258
  Synthetic

SEQ ID NO: 14261 - protein, 244 aa, Artificial Sequence; identical to SEQ ID NO: 14258
  Synthetic

SEQ ID NO: 14262 - protein, 240 aa, Artificial Sequence
  Synthetic
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLRDLVRRTKELLEELLRLLEELVRAHKELVRSILDEIRK

SEQ ID NO: 14263 - protein, 240 aa, Artificial Sequence; identical to SEQ ID NO: 14262
  Synthetic

SEQ ID NO: 14264 - protein, 240 aa, Artificial Sequence; identical to SEQ ID NO: 14262
  Synthetic

SEQ ID NO: 14265 - protein, 240 aa, Artificial Sequence; identical to SEQ ID NO: 14262
  Synthetic

SEQ ID NO: 14266 - protein, 247 aa, Artificial Sequence
  Synthetic
SEAEELLRELEELLKKSEKVLEDLLRKNAELIKDSKARLDEVRRKVEKLAEEVEEVIRRGVSEEELIRVIKKVLDDLRSIIKELIEVSRKYLRTTLELVKELLDVSRDVLREVLRIIKALLDTGGKDGSEEKIKEIADVADEIRKLAEEDIRLIKKLLEESAKLVDEDVRKLEEIAKEITELVERLRRTGDKDAVRKLIEELKKLLEDLVEHHERLLKEDHERLKALLDHHRELLKTVLTILRETAK

SEQ ID NO: 14267 - protein, 247 aa, Artificial Sequence; identical to SEQ ID NO: 14266
  Synthetic

SEQ ID NO: 14268 - protein, 247 aa, Artificial Sequence; identical to SEQ ID NO: 14266
  Synthetic

SEQ ID NO: 14269 - protein, 247 aa, Artificial Sequence; identical to SEQ ID NO: 14266
  Synthetic

SEQ ID NO: 14270 - protein, 245 aa, Artificial Sequence
  Synthetic
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLKRDNEEIKRILEELLRVAEENLRRIKEIIDRLLDATRR

SEQ ID NO: 14271 - protein, 245 aa, Artificial Sequence; identical to SEQ ID NO: 14270
  Synthetic

SEQ ID NO: 14272 - protein, 245 aa, Artificial Sequence; identical to SEQ ID NO: 14270
  Synthetic

SEQ ID NO: 14273 - protein, 245 aa, Artificial Sequence; identical to SEQ ID NO: 14270
  Synthetic

SEQ ID NO: 14274 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 14275 - protein, 249 aa, Artificial Sequence; identical to SEQ ID NO: 14274
  Synthetic

SEQ ID NO: 14276 - protein, 249 aa, Artificial Sequence; identical to SEQ ID NO: 14274
  Synthetic

SEQ ID NO: 14277 - protein, 249 aa, Artificial Sequence; identical to SEQ ID NO: 14274
  Synthetic

SEQ ID NO: 14278 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 14279 - protein, 240 aa, Artificial Sequence; identical to SEQ ID NO: 14278
  Synthetic

SEQ ID NO: 14280 - protein, 240 aa, Artificial Sequence; identical to SEQ ID NO: 14278
  Synthetic

SEQ ID NO: 14281 - protein, 240 aa, Artificial Sequence; identical to SEQ ID NO: 14278
  Synthetic

SEQ ID NO: 14282 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 14283 - protein, 240 aa, Artificial Sequence; identical to SEQ ID NO: 14282
  Synthetic

SEQ ID NO: 14284 - protein, 240 aa, Artificial Sequence; identical to SEQ ID NO: 14282
  Synthetic

SEQ ID NO: 14285 - protein, 240 aa, Artificial Sequence; identical to SEQ ID NO: 14282
  Synthetic

SEQ ID NO: 14286 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 14287 - protein, 243 aa, Artificial Sequence; identical to SEQ ID NO: 14286
  Synthetic

SEQ ID NO: 14288 - protein, 243 aa, Artificial Sequence; identical to SEQ ID NO: 14286
  Synthetic

SEQ ID NO: 14289 - protein, 243 aa, Artificial Sequence; identical to SEQ ID NO: 14286
  Synthetic

SEQ ID NO: 14290 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 14291 - protein, 243 aa, Artificial Sequence; identical to SEQ ID NO: 14290
  Synthetic

SEQ ID NO: 14292 - protein, 243 aa, Artificial Sequence; identical to SEQ ID NO: 14290
  Synthetic

SEQ ID NO: 14293 - protein, 243 aa, Artificial Sequence; identical to SEQ ID NO: 14290
  Synthetic

SEQ ID NO: 14294 - protein, 239 aa, Artificial Sequence
  Synthetic
SEVEDILRRLAELNKRLIDKLRELIDRIARLNEELLRVVEDILSRLKRLADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDRTAESLKHLEDVIRELEKKTEDSLRHMEERRK

SEQ ID NO: 14295 - protein, 239 aa, Artificial Sequence; identical to SEQ ID NO: 14294
  Synthetic

SEQ ID NO: 14296 - protein, 239 aa, Artificial Sequence; identical to SEQ ID NO: 14294
  Synthetic

SEQ ID NO: 14297 - protein, 239 aa, Artificial Sequence; identical to SEQ ID NO: 14294
  Synthetic

SEQ ID NO: 14298 - protein, 243 aa, Artificial Sequence
  Synthetic
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLLEDYKRLIEEVKKELDKLLKEYEDALREIKKRIDE

SEQ ID NO: 14299 - protein, 243 aa, Artificial Sequence; identical to SEQ ID NO: 14298
  Synthetic

SEQ ID NO: 14300 - protein, 243 aa, Artificial Sequence; identical to SEQ ID NO: 14298
  Synthetic

SEQ ID NO: 14301 - protein, 243 aa, Artificial Sequence; identical to SEQ ID NO: 14298
  Synthetic

SEQ ID NO: 14302 - protein, 232 aa, Artificial Sequence
  Synthetic
TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLEEYKAIIEELERELERLLREHREVIRRIKEEIDKSSK

SEQ ID NO: 14303 - protein, 232 aa, Artificial Sequence; identical to SEQ ID NO: 14302
  Synthetic

SEQ ID NO: 14304 - protein, 232 aa, Artificial Sequence; identical to SEQ ID NO: 14302
  Synthetic

SEQ ID NO: 14305 - protein, 232 aa, Artificial Sequence; identical to SEQ ID NO: 14302
  Synthetic

SEQ ID NO: 14306 - protein, 234 aa, Artificial Sequence; identical to SEQ ID NO: 13912
  Synthetic

SEQ ID NO: 14307 - protein, 234 aa, Artificial Sequence; identical to SEQ ID NO: 13912
  Synthetic

SEQ ID NO: 14308 - protein, 234 aa, Artificial Sequence; identical to SEQ ID NO: 13912
  Synthetic

SEQ ID NO: 14309 - protein, 234 aa, Artificial Sequence; identical to SEQ ID NO: 13912
  Synthetic

SEQ ID NO: 14310 - protein, 240 aa, Artificial Sequence
  Synthetic
SLEEIVKKLEDLNKKAVEILRRVLEEHEKLVEKVKKVLRDVLRLLEKVVREVIETLKKGDTDEKTREALKELEEVVRKIKEEVEKVLKRLEEVSKRLKDEVRRVLKESEDVAKKIRRDVRGVRSEDAAKRATDLLKETLTILEEAIRRIVKVIEDSLEILREAVEAIVRLLEELLSILARIGLDEEVLRKLKEIIKELKDRLKKLLDDYERIIDELRAELERVLREYEKILEDLRKELED

SEQ ID NO: 14311 - protein, 240 aa, Artificial Sequence; identical to SEQ ID NO: 14310
  Synthetic

SEQ ID NO: 14312 - protein, 240 aa, Artificial Sequence; identical to SEQ ID NO: 14310
  Synthetic

SEQ ID NO: 14313 - protein, 240 aa, Artificial Sequence; identical to SEQ ID NO: 14310
  Synthetic

SEQ ID NO: 14314 - protein, 241 aa, Artificial Sequence
  Synthetic
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERLLEELKRRVERLLEDIERLLAELEKLNEDVLRENKALLEDLERRVRERKK

SEQ ID NO: 14315 - protein, 241 aa, Artificial Sequence; identical to SEQ ID NO: 14314
  Synthetic

SEQ ID NO: 14316 - protein, 241 aa, Artificial Sequence; identical to SEQ ID NO: 14314
  Synthetic

SEQ ID NO: 14317 - protein, 241 aa, Artificial Sequence; identical to SEQ ID NO: 14314
  Synthetic

SEQ ID NO: 14318 - protein, 58 aa, Artificial Sequence
  Synthetic
DEVRKVLKDVTELSKTSEDKLEKVVREVKRKLDEVNRDLERVVREAKKLLREVRERLE

SEQ ID NO: 14319 - protein, 59 aa, Artificial Sequence
  Synthetic
DEVDEIRRRLKKLLDDSRKTSKDIERRLRELLDRNRRLVERVEEELRKLIKELEELVRS

SEQ ID NO: 14320 - protein, 58 aa, Artificial Sequence
  Synthetic
EEVEKVLKEARDVSEDSKRETTEVLKEAKKALEDINKRLREIVETVREALERVERALT

SEQ ID NO: 14321 - protein, 59 aa, Artificial Sequence
  Synthetic
DEKETVKDVVRRLVEKLEEVVKESKKLVDDLVKRAKEIVRESEELVRRNVRRAEEVARE

SEQ ID NO: 14322 - protein, 55 aa, Artificial Sequence
  Synthetic
EKVLKELEDAVREVKERIKKTNKELEEMVRRVEEEIRESDERLKKASEEVEEKIR

SEQ ID NO: 14323 - protein, 59 aa, Artificial Sequence
  Synthetic
SEMETVLDDVRRVVEESEELVKRARDRVKKLVDDLKRLVEKNEEDVKRVVDELDKLVEK

SEQ ID NO: 14324 - protein, 56 aa, Artificial Sequence
  Synthetic
EEVLEEARRLSERSREELRRVLEEARRLIRRVREELKRVHDKARRLVERVEEKLRT

SEQ ID NO: 14325 - protein, 59 aa, Artificial Sequence
  Synthetic
DEVEEVLERVKKVVADSEELVKRNRERVKKVVDDIRDLIRRNAETVKEVVKTIRELVKK

SEQ ID NO: 14326 - protein, 56 aa, Artificial Sequence
  Synthetic
EEALKDAERRSDESRKKLKKVHDDADRMVREVTRRLDEVHKEAEKRVREVLAELDT

SEQ ID NO: 14327 - protein, 60 aa, Artificial Sequence
  Synthetic
SIEEVLKEAHELNKEANKRLRDVEEDAKRLIEEVLRRLEDVLRESERLAREVLEELKRKG

SEQ ID NO: 14328 - protein, 56 aa, Artificial Sequence
  Synthetic
AKELRRRVERSVEESKRLVDELRKDVKRVVDEIRKVVEEDLRHAKRVVDEIREKVR

SEQ ID NO: 14329 - protein, 59 aa, Artificial Sequence
  Synthetic
DEAEEVKRVVEESVRRNEELVRRNEELVRDVLRRLKEVVDENERLVKEVVDRLRDLVRR

SEQ ID NO: 14330 - protein, 56 aa, Artificial Sequence
  Synthetic
ERVLKEVEELDRRVLEELKRVNDEARKRVRTLLEELRRVNEKVEELVRRILEELKK

SEQ ID NO: 14331 - protein, 57 aa, Artificial Sequence
  Synthetic
DEAEDVVRKVMDEIRKLIEVSKEILKELRRLVEELKKHSDRTVEELRRVVTELLKKE

SEQ ID NO: 14332 - protein, 55 aa, Artificial Sequence
  Synthetic
TDAVRRVRELLETVRRTSEEVLKTLEEFLRRVEKSTRRAEEELEEFLKRVEDRVK

SEQ ID NO: 14333 - protein, 61 aa, Artificial Sequence
  Synthetic
KEADKLAKELEETIERLKRDSERLVTDLERLLERLERRSRELVKRLRRHVEELLKTVRRDG

SEQ ID NO: 14334 - protein, 55 aa, Artificial Sequence
  Synthetic
REVIKKVEDLLREVEETSKRILDRVRELLKKVEDSSRRINEESKKLLKRVEEEAR

SEQ ID NO: 14335 - protein, 58 aa, Artificial Sequence
  Synthetic
SELEKILEDLKRVAERVAKALDRSLRELEKVLRRVEEELTRSNERLREVVKEVEDAAD

SEQ ID NO: 14336 - protein, 56 aa, Artificial Sequence
  Synthetic
DEEVRKLVEDLARRLDDIVRRSEELSRKLAEDVEEIVERSKRLSEELAREARELVR

SEQ ID NO: 14337 - protein, 60 aa, Artificial Sequence
  Synthetic
SEIEDVVRKVETLARESDERVKTLMEENKDLAEKLKKLVRDVVEKVKREVTRLLDEVRRR

SEQ ID NO: 14338 - protein, 58 aa, Artificial Sequence
  Synthetic
EELKKVKERLDEAERRSKELIDEADRLNREMLKRVKEAIKKVKETLDKALEDVERAVR

SEQ ID NO: 14339 - protein, 57 aa, Artificial Sequence
  Synthetic
SDLERVEERLERAVREVEKLHEDSRRELRRVVKEVHDSTRKVEERNRKLVKRVEEAD

SEQ ID NO: 14340 - protein, 55 aa, Artificial Sequence
  Synthetic
KKVIKKLEDMLREWAKLVEKSIKELKELLEELRKVSKKLVDDNDRLAEELKRRVD

SEQ ID NO: 14341 - protein, 61 aa, Artificial Sequence
  Synthetic
DEVKALVDKVRELVRKLKEESDDLVRRNEELAKEVEKRSREVVEKVRDTVRKLLEELERAD

SEQ ID NO: 14342 - protein, 55 aa, Artificial Sequence
  Synthetic
KKVRDDLRKALEDVNRSSKRVEERDKEVLDEAHRSSTRVLETLKRMLERLDEKIR

SEQ ID NO: 14343 - protein, 61 aa, Artificial Sequence
  Synthetic
DEVEKLVKKVEDLVKRLIEVSEDVVREVEKRLRELEKVHREALRKNRKLLEDLLRRLREAD

SEQ ID NO: 14344 - protein, 55 aa, Artificial Sequence
  Synthetic
DKVREKLKRALDRVNKSSREVEETLRRADKRLNDLVKEIKDEDKRMLERLERETQ

SEQ ID NO: 14345 - protein, 61 aa, Artificial Sequence
  Synthetic
KEVEELVKEVRKLATKVIETSKRVVEELEKLAERLLRTSKEVVKRNKELVDDLLRRVREVS

SEQ ID NO: 14346 - protein, 55 aa, Artificial Sequence
  Synthetic
EEVRKELRELLRRVNESSKDVKRRLEDLDREINRLSKRVKEEDRRALKEVEEEIK

SEQ ID NO: 14347 - protein, 60 aa, Artificial Sequence
  Synthetic
SKEEEVKRVLREALERVEELNKRLNEEDKRMLDEVRKVNRDAERVLREALKRVEELLSRV

SEQ ID NO: 14348 - protein, 55 aa, Artificial Sequence
  Synthetic
DELVTDVERVVRELLDHVRRLVRESKELARELIRRSEEIVRTVEEVVRKLEKDVR

SEQ ID NO: 14349 - protein, 60 aa, Artificial Sequence
  Synthetic
DKAKKVEELLRKAIEEVEKLNDEVNRTDEKMLRRVKELNDDVHRTLEEAIKRVRELLSRV

SEQ ID NO: 14350 - protein, 55 aa, Artificial Sequence
  Synthetic
DEVVTEVEKLMRELLEHVKRLIDESRKLAADLEKHSRDIVEEVRRLVEELLRTVK

SEQ ID NO: 14351 - protein, 60 aa, Artificial Sequence
  Synthetic
SKERDVERKVREVIKRVEDLNKRVHKTLEDVIREVEKLNEEVKTRVEKLIREVEELLKRV

SEQ ID NO: 14352 - protein, 55 aa, Artificial Sequence
  Synthetic
DRVVEEVERLLRELEKHSKEIEEAVDRLVRKLEEHVKKVVEEVARLVAELKERVK

SEQ ID NO: 14353 - protein, 60 aa, Artificial Sequence
  Synthetic
SVAEEVKKVKDKLKKDVERLNEEDRRVLEKAKRESKKLLDEIKRVLEELERKLEELLRRD

SEQ ID NO: 14354 - protein, 55 aa, Artificial Sequence
  Synthetic
KEVVTEIRRVVKELLDKVRESIKETERVVRELLERNRKILKEIREVVRKLLEDVR

SEQ ID NO: 14355 - protein, 61 aa, Artificial Sequence
  Synthetic
DEARKLLEELKRLAERVLKTDTDLLDESRRILEEVLKTNKKSIEDSKRLAEDVLRKVAREG

SEQ ID NO: 14356 - protein, 59 aa, Artificial Sequence
  Synthetic
EEVLDRVREIMERVLTESKELNDRIHTISRKAEEDSKRLNEEDRAIMEDVRRELKRVVD

SEQ ID NO: 14357 - protein, 61 aa, Artificial Sequence
  Synthetic
SEAEKLLEELRTIAKEVLDRVRKMLRESEKLAEDVLRENKKSIEDSRRIAKKVLDELRRDG

SEQ ID NO: 14358 - protein, 59 aa, Artificial Sequence
  Synthetic
EEVLERIRRIFEDVLRKLRKLLDEIHRISEKVKKESEELNEEDKRIVDDAERRLEDLER

SEQ ID NO: 14359 - protein, 60 aa, Artificial Sequence
  Synthetic
SVKDAVEKILREAEETVKRLNEETKRRLDEAREESKRLIDEVRRILEKLKEVLDEVLRRV

SEQ ID NO: 14360 - protein, 55 aa, Artificial Sequence
  Synthetic
EELLERVKRLMDELEETSRRILEEVERVIRRNKELADRILKEVAELLKRLEEELR

SEQ ID NO: 14361 - protein, 60 aa, Artificial Sequence
  Synthetic
DEAEELRKTVEDIMKELREELKRLEEESRRIMEELKKRLEKLIEDSRKAAEDLKREADRL

SEQ ID NO: 14362 - protein, 59 aa, Artificial Sequence
  Synthetic
KRLLEEIKERVDRVKKELDEADKRINDSSREVEKTLEDLDRKINKSSEEVRRVLEEAER

SEQ ID NO: 14363 - protein, 60 aa, Artificial Sequence
  Synthetic
DVEETLTRLLKEILDVVRKALRDTREIVRDVRRVSEEVLKELEDLLREVDREVKRVLAEL

SEQ ID NO: 14364 - protein, 56 aa, Artificial Sequence
  Synthetic
DTEVVKRIRELVEKLRELVKRSNDNLKEHVKRNKELAKRLLDELRKLVEDLKRARK

SEQ ID NO: 14365 - protein, 60 aa, Artificial Sequence
  Synthetic
DMEEEVKKLIDEVRRVLEEVLKRVEDIIDASRRTLKKVVDDVRRIDEDVERELKEAEKRG

SEQ ID NO: 14366 - protein, 56 aa, Artificial Sequence
  Synthetic
KEEVLREVDRLVKKVEKTARELLRLLEESIEKSKREAEKLLRSNEDVVRRVRERVR

SEQ ID NO: 14367 - protein, 56 aa, Artificial Sequence
  Synthetic
DAEEDAKRLLKEVKDLLDEVRERHRELNERSRKVLEDARKTHEDLNEESRKTLEDR

SEQ ID NO: 14368 - protein, 55 aa, Artificial Sequence
  Synthetic
REARELLKRILKDIERILETVVRLSERDVEEVRKIMEELKKLSDDDLKRVEEEAR

SEQ ID NO: 14369 - protein, 56 aa, Artificial Sequence
  Synthetic
SAREEIEELIKRVKDTSKKILEDVRRMIERVKRKSKKIKEDAKRLIERVEKLLRDS

SEQ ID NO: 14370 - protein, 56 aa, Artificial Sequence
  Synthetic
KDELRELIKRLEDHSRRVVEEVARLVKELDEHSERVLKTLEDLIRRLDELVKRVTT

SEQ ID NO: 14371 - protein, 57 aa, Artificial Sequence
  Synthetic
KAEETVKELLDRVERISERARKEVRELLERSKESTKRILDEAREMIKRSRDELRRVG

SEQ ID NO: 14372 - protein, 56 aa, Artificial Sequence
  Synthetic
LEDLERLARELARHSEDVMRRLRDLARKDKELSEDLVRRLRELVKRDLDLVKTVKE

SEQ ID NO: 14373 - protein, 56 aa, Artificial Sequence
  Synthetic
SMEDRLREVNEKNNRLIEDATRKSERVLDKIRELLKEVKRRSEDVLRRIKELVEKL

SEQ ID NO: 14374 - protein, 59 aa, Artificial Sequence
  Synthetic
EKTLKELVEKIEKVAEDSLREAEEDVKRIEDLVREIKKRADDDVRRLEDRVRRLRERLE

SEQ ID NO: 14375 - protein, 59 aa, Artificial Sequence
  Synthetic
SSVEEVVEEIERLVDELRKRAEELVRESEKLVAELERRIRKLVEDSEKLVKDLKDRAAK

SEQ ID NO: 14376 - protein, 59 aa, Artificial Sequence
  Synthetic
DKVLRKIEDVDRRLKELVRRVKKKDRDSNERVKELVKRLNDENEKVLKRVEELVRRDKT

SEQ ID NO: 14377 - protein, 60 aa, Artificial Sequence
  Synthetic
DEIKKVVKDLEDLVKRLKDEVDRHVRENERIVEELKRNVDRHVEENRRLVKTLEDEVRKG

SEQ ID NO: 14378 - protein, 55 aa, Artificial Sequence
  Synthetic
EDLKRVLKAVEDVVREAKERLERVNRTIREVVKRAREKLKRVHDTIRKVVDDARR

SEQ ID NO: 14379 - protein, 59 aa, Artificial Sequence
  Synthetic
DEVEEVLKELKRSVDETRKLLKKIEDEAKRNVRRNEELAERVKRTVDRLVEELRDLIRR

SEQ ID NO: 14380 - protein, 55 aa, Artificial Sequence
  Synthetic
EKLKRAEKEDEEVVRRIRELIERLREENEDVIRRAEELLREVVKRIEEVITEARR

SEQ ID NO: 14381 - protein, 60 aa, Artificial Sequence
  Synthetic
SVEDEIRRVIEELDRLLRKDKETIKRVIKELRDLLREVKKRTEEMIRRLDELLETVTRRI

SEQ ID NO: 14382 - protein, 56 aa, Artificial Sequence
  Synthetic
VDDVRRLAKEVLDEVKKSVDETKRLADEVKTRVRKNVKDNTDLAREVLRRVAERAR

SEQ ID NO: 14383 - protein, 60 aa, Artificial Sequence
  Synthetic
SRLEKLVKEIRDVVRELAERVKESVDRARKVVKEDLEHAEESVRRVKKVVKELEELVRKL

SEQ ID NO: 14384 - protein, 55 aa, Artificial Sequence
  Synthetic
KDIKEVEKRLKDVLDEAHKLNKRTNDELKRVNKESNDLNRKTEEDLKRVLERAED

SEQ ID NO: 14385 - protein, 59 aa, Artificial Sequence
  Synthetic
KRKEDLVEEIRKIVKAVEDEVRRSVKESEDSVRENLKEAERIVRELEEIVKELEKLVRD

SEQ ID NO: 14386 - protein, 55 aa, Artificial Sequence
  Synthetic
ELLEDVRKKLEDVLREVEKLNKTVEDKNREVLRRIDELIRRVEEAIEDVRRKVEK

SEQ ID NO: 14387 - protein, 59 aa, Artificial Sequence
  Synthetic
DEKEELVKRVEDKVKDLRDKVEKSVRESTESVRDNERRVRESVERSRDLVRRLDELVRA

SEQ ID NO: 14388 - protein, 55 aa, Artificial Sequence
  Synthetic
EELERVRKELEEVLRRAKRLNEDVLEKNREVVRRAAELNKEVKKLLKEVLDRAKT

SEQ ID NO: 14389 - protein, 60 aa, Artificial Sequence
  Synthetic
DEKEDIDRRLRDMVRRDRELARRSVEEARKLVDKNRKLVERVFRELKKLVDELDELVRRR

SEQ ID NO: 14390 - protein, 55 aa, Artificial Sequence
  Synthetic
KLLKDLEEELRKTREEVHRLNEETNRRLDKVNKDARDLVRELEELIEDVLRKVET

SEQ ID NO: 14391 - protein, 59 aa, Artificial Sequence
  Synthetic
DEKETVEERLDRLVRHHEKLVRESVKELEELVRHNRELIKKSVEDARRLVEDLKRLIDE

SEQ ID NO: 14392 - protein, 55 aa, Artificial Sequence
  Synthetic
KLLDELRERIDKVNEDARKLNEEVERRITESEKEVTDLNRKVDEDIKRVLEKVER

SEQ ID NO: 14393 - protein, 60 aa, Artificial Sequence
  Synthetic
SVEKVVKDVTDTIKKVVDDARRLSEEVVERNERVNKKLERLSREVVERIKDVLKRLRDKK

SEQ ID NO: 14394 - protein, 56 aa, Artificial Sequence
  Synthetic
VEDLKRDADRIVEDIKRVVKELVKHAEKSVEDLERVVKEIVKDAERIVREIEKRVK

SEQ ID NO: 14395 - protein, 60 aa, Artificial Sequence
  Synthetic
DVEEVVRRAREENKRSHDEVRELVKEVNERNKTVLERIKELAERALREIREVLREVDERK

SEQ ID NO: 14396 - protein, 56 aa, Artificial Sequence
  Synthetic
TEKLKEDLDRIVRTSEELVRRLLERARRMVRETEELMRELLTEVKRIVEEVARRVK

SEQ ID NO: 14397 - protein, 59 aa, Artificial Sequence
  Synthetic
DKEELLKRVTEKLEKVSDKSRRLIEEVEREVEKVHREVEERVRKVREDVRDVLRKIRAQ

SEQ ID NO: 14398 - protein, 56 aa, Artificial Sequence
  Synthetic
TELVLREVERLVAENERSVEELKKELEKLVRRNRTLVRKIEEDVRRLVEKITKRRE

SEQ ID NO: 14399 - protein, 59 aa, Artificial Sequence
  Synthetic
SDSERVKKEAEDVLREIKRLIERNKRLAEETSERIRRLLEELKDLADKIVETLKDLIDR

SEQ ID NO: 14400 - protein, 56 aa, Artificial Sequence
  Synthetic
REVVDEVEKRIRELLERLKDVSKKVEESNKKLLDEIRETVERVKKRIKELLEELRR

SEQ ID NO: 14401 - protein, 60 aa, Artificial Sequence
  Synthetic
SLEEVVEEVKRRLTKLLKEIEDVIRRAEEESRRLLEEIERVIREAEKESRRLLEEIRTAG

SEQ ID NO: 14402 - protein, 56 aa, Artificial Sequence
  Synthetic
EDLVRKLAKELLDTLREVLKRIEEIAKEVLDLNDESLKEIRRIVEEDLRKLEEKMR

SEQ ID NO: 14403 - protein, 59 aa, Artificial Sequence
  Synthetic
SEEEEVKRLLDDVREKVKRVAEENRRTVEEVKRVVDEVRRRNKETVERDRRELEKVARD

SEQ ID NO: 14404 - protein, 55 aa, Artificial Sequence
  Synthetic
EEVVREIRRIVEDVRRKVKESVDRVKKILEKVRKDVEDSVREVERTMKKVSDDVT

SEQ ID NO: 14405 - protein, 63 aa, Artificial Sequence
  Synthetic
SKEETAKRLIEEVRKVIEEVKKRAEDSNDHNRRSIEEVEKTLKRLIDEVRRVVEEVKEKISRT

SEQ ID NO: 14406 - protein, 55 aa, Artificial Sequence
  Synthetic
KEAVEEIERLMRKIKKVVEDSVRNVERTMREVEEKVRKVEEDVRRLAEDVTRAVK

SEQ ID NO: 14407 - protein, 56 aa, Artificial Sequence
  Synthetic
DEVEEVLRRVRKIVKEDRDEAKDVREENRRLVEDDKRKVERVKEENRRLVEELRKR

SEQ ID NO: 14408 - protein, 56 aa, Artificial Sequence
  Synthetic
RRLLEEVERRVEKLVKESREIAKRSNDRTKDLVRRSEEILRESNERTRRLLEETER

SEQ ID NO: 14409 - protein, 56 aa, Artificial Sequence
  Synthetic
SEAEKVLKDIEKIVKDLERNAKEVLDRNKRNVEDDKRAAEEVLEKLERIVREIDRG

SEQ ID NO: 14410 - protein, 56 aa, Artificial Sequence
  Synthetic
RELLKKVIRTVEKLLEDVHKLNEDSERAAKKLTDESREIAREVEERVERLLREEER

SEQ ID NO: 14411 - protein, 57 aa, Artificial Sequence
  Synthetic
REVEEAEKRLREIVKEVTERNKEVVERLRDIVRKSEDDSRKSVETNKEIVDRVRRDV

SEQ ID NO: 14412 - protein, 56 aa, Artificial Sequence
  Synthetic
RDVLRELIRTLEEVLKRSEDTNRELEKRIKEVVEDNRRKLEESIKESEKVVDEIRK

SEQ ID NO: 14413 - protein, 57 aa, Artificial Sequence
  Synthetic
SEVEEAERRLKEIAEESKEISKRSVETNAKILDEVRRENTRVLETLKKILEEVERRV

SEQ ID NO: 14414 - protein, 56 aa, Artificial Sequence
  Synthetic
KDELERLIEDIREVVERNKKIADESIKRSRDVVKRSKETNDELEKTIREVVKRIED

SEQ ID NO: 14415 - protein, 57 aa, Artificial Sequence
  Synthetic
DEVEEVLKRLRDILREAKELVERSVKRNEEIAEESRKESEESVRRNEEIVDAVRKRV

SEQ ID NO: 14416 - protein, 56 aa, Artificial Sequence
  Synthetic
RRVLERLIRELERVLEELREKLKRSIEESEDVVRKNREILRRSIEKSEDVVRKIET

SEQ ID NO: 14417 - protein, 59 aa, Artificial Sequence
  Synthetic
DVDEVLDTVRRLVEELLKKVERTSRESVRLAEKLLDEVRESSKRSKDESRRLLEEVREI

SEQ ID NO: 14418 - protein, 59 aa, Artificial Sequence
  Synthetic
REKVDKVRRDVERLVEEVEKTVKRSVEENRRIAEEIKRTVEESVKTNEEVVKRIEETAR

SEQ ID NO: 14419 - protein, 58 aa, Artificial Sequence
  Synthetic
RERELVEEVERRLRESNERVKESVDRSRKLLETSHRRVKELVDRLKRVLERVEREVRN

SEQ ID NO: 14420 - protein, 55 aa, Artificial Sequence
  Synthetic
DELVKRVKEVVDHNERLAEESKKEVDDVVRRNEDLVRKVVEEVKDVVRRIKETVR

SEQ ID NO: 14421 - protein, 58 aa, Artificial Sequence
  Synthetic
RERELVEEVERELKRSTREVEESIEESRKRLEESHRLVAELVKRLEEVLERVRDDVRR

SEQ ID NO: 14422 - protein, 55 aa, Artificial Sequence
  Synthetic
DELRKRVEEVVRTNEELARESVRKVKEVVRRNKELVARVADKVREVVKRIRETLK

SEQ ID NO: 14423 - protein, 59 aa, Artificial Sequence
  Synthetic
SVKEIVKKVVEENKKSDDELREFARRVAERNKRVVEELKKRLEDLVRKNEEVVDRLRKR

SEQ ID NO: 14424 - protein, 59 aa, Artificial Sequence
  Synthetic
SEIVKEVVDRVRKSEESSRKLLEEIVRLVEKSLEEVKRILDEIRRRVEKSERDVRRLRK

SEQ ID NO: 14425 - protein, 57 aa, Artificial Sequence
  Synthetic
DIVEELKENVKRVEETIRKIVKEARENVDDVLKKNKDNVEHDKRTAEEVLKEVKKSI

SEQ ID NO: 14426 - protein, 60 aa, Artificial Sequence
  Synthetic
KDTVRRLLEEASKLNKDVIRRVRELLKRLHERNEESLRRARELNERSRREAERVLEEVRK

SEQ ID NO: 14427 - protein, 60 aa, Artificial Sequence
  Synthetic
SIVDRIREIMKEVREKVKRVVEENRRNAERIKRRVDEVVKTNRKTVDDVRRKVEDVVRKI

SEQ ID NO: 14428 - protein, 60 aa, Artificial Sequence
  Synthetic
REVVEELLRRLRKIVKDVERELKRSTEELNRRSREVLKELEKSTRDVEKVVRELEERLRK

SEQ ID NO: 14429 - protein, 60 aa, Artificial Sequence
  Synthetic
SVVDKIREIVRKSREDVRRVVEEIKDNARDLKRKAEEVVKEVKRIVDEVRETVRDVVEKI

SEQ ID NO: 14430 - protein, 60 aa, Artificial Sequence
  Synthetic
EEEARKLLEDVKKSSDDVRRELKRLLEEVNRVSREAEKKLRELLERVKRIIDTLKDELRK

SEQ ID NO: 14431 - protein, 60 aa, Artificial Sequence
  Synthetic
SVKDEIRRIVKESEEANRDVVEKIRRNVERIRRKVERVVEEIKRIVKEVKEKVEDVVRKN

SEQ ID NO: 14432 - protein, 60 aa, Artificial Sequence
  Synthetic
EEVVRKLLEEVKKSSDESKDRSRRLLEEVNRISRDVERKLEELLRKVEKVVRDLEEELRR

SEQ ID NO: 14433 - protein, 58 aa, Artificial Sequence
  Synthetic
SAEDVVRELKKRVDRSREDNTRVLEELKKAVEESRRLNEESNRRLEKIVRDIKEDLKR

SEQ ID NO: 14434 - protein, 59 aa, Artificial Sequence
  Synthetic
EEVLRELAKIREDIERENKRVLEELEDVLRKVKRVNEEALKNSEDILRDIKEKVDRRRK

SEQ ID NO: 14435 - protein, 59 aa, Artificial Sequence
  Synthetic
SVEELLRKLEEVLRKIREENERSLKELRDRAREIVKRNRETNRELEEVIKELEKRLSRR

SEQ ID NO: 14436 - protein, 59 aa, Artificial Sequence
  Synthetic
EDIVRKIERIVETIEREVRESVKKVEEIARDIRRKVDESVKNVEKLLRDVDKKARDRKK

SEQ ID NO: 14437 - protein, 61 aa, Artificial Sequence
  Synthetic
SEEEKVKEEIRKLIEDSRRHVDELKKRLEKLLRDSEKNVEDAHRTNEKLARELKEKVKKTG

SEQ ID NO: 14438 - protein, 55 aa, Artificial Sequence
  Synthetic
EDVLREAEEMLRDSNRELREILEKIERDLRKSDEELKKSVDDLRRLIKEVEDRLK

SEQ ID NO: 14439 - protein, 61 aa, Artificial Sequence
  Synthetic
SREEELKKELKKRIEDSDRHVKEEKDELDRLIRESEEHVKRLKEEARKKLERLKDLVRKDG

SEQ ID NO: 14440 - protein, 55 aa, Artificial Sequence
  Synthetic
EKVLREAEELLKEVDRKLERILEEIKRRLEKSDRDLRRVLKELEELIDEVRRRLE

SEQ ID NO: 14441 - protein, 61 aa, Artificial Sequence
  Synthetic
SEKEDIKERIKELLKRSEENVRKLREENRELVRRSEENVKEIHKENEDLIRKLEKLRTRDV

SEQ ID NO: 14442 - protein, 55 aa, Artificial Sequence
  Synthetic
EDVLREAKEALEESLRRLRKIHEDSERRLRESLEELRRSVEEAKRLLERLKRELD

SEQ ID NO: 14443 - protein, 61 aa, Artificial Sequence
  Synthetic
DELDRVIEEAEELIRRIEEKLRRINETAKRLLDENLRHSERVHEEINRALERVRKKVEDAG

SEQ ID NO: 14444 - protein, 56 aa, Artificial Sequence
  Synthetic
VKDVKDRLRRIIEELERRVRELKKRHEDILRELNRRSKELKDRHKKILEDLDRRVR

SEQ ID NO: 14445 - protein, 61 aa, Artificial Sequence
  Synthetic
EEVERVIDEARRLLRENERHSEEVIEEITKLIRDVEEKVKRINDRAREALEDIREEVKRKG

SEQ ID NO: 14446 - protein, 56 aa, Artificial Sequence
  Synthetic
VDELRKELERLIRDLNRLSKRIKEELKRRIEELEEEVKRLKEEHERIIEELRRRVK

SEQ ID NO: 14447 - protein, 59 aa, Artificial Sequence
  Synthetic
EEVERAKKELEDRIREWEEDSKRLKDELKRIIKEWEDESRRVKEELRKIIDDLRKAVEK

SEQ ID NO: 14448 - protein, 55 aa, Artificial Sequence
  Synthetic
ERILEEARRLVRRVHESSKRVLDDARRKLKELHERSKRVLDDVRRKLKKVADDTR

SEQ ID NO: 14449 - protein, 60 aa, Artificial Sequence
  Synthetic
SEVERIKEELKRIIEDWDRRSRRLKEELKKEIKDWEEDSRRLKRELEEELKKLKEKVERG

SEQ ID NO: 14450 - protein, 55 aa, Artificial Sequence
  Synthetic
KKIIDEARRLLEELHRKSREVAKEIRKEVKRLHDTSKKVLEDIRRAVKKVADDVK

SEQ ID NO: 14451 - protein, 59 aa, Artificial Sequence
  Synthetic
SEVEKIKRDLEEIIRRWEEDIKRVKKRLDEEIRRWEEESKKVKKKLEDLIRRLEKEVAD

SEQ ID NO: 14452 - protein, 55 aa, Artificial Sequence
  Synthetic
EKILEDARREAERLHKTSKDVLKKVEDLLRRVNEHSRRVLEEAERRIRDVAEKTR

SEQ ID NO: 14453 - protein, 59 aa, Artificial Sequence
  Synthetic
SEVEDIKRRLEKIIEDWRRKSKELEKRLEDIIDEWDKRSRKLKEDLKRIIEEARKAVDD

SEQ ID NO: 14454 - protein, 55 aa, Artificial Sequence
  Synthetic
EKVIKEAEDLLRELNESSRRVAKKAKDDLRELNERSRRALKEIRELLREVRERVE

SEQ ID NO: 14455 - protein, 61 aa, Artificial Sequence
  Synthetic
REVEKIITDLEEVIRRVEEYLKRSDEELEKELRRVKRYLDKSDKDLRDEIRRVKEELDKRG

SEQ ID NO: 14456 - protein, 56 aa, Artificial Sequence
  Synthetic
KDELRARVEDVVRRAEDELRRHSELNKRLVDEARKLLEDHSRRNEELMRELRKLVE

SEQ ID NO: 14457 - protein, 60 aa, Artificial Sequence
  Synthetic
SELEDILRKLEKRMTDVERYLDESNKDLERAVRRVVETLKRIDDEIRRLLEEVERDLDRK

SEQ ID NO: 14458 - protein, 56 aa, Artificial Sequence
  Synthetic
KDELETRLREITKTAEDELRKHSRTNEDIVRELKELVDEHEKELRKVVREAEDESR

SEQ ID NO: 14459 - protein, 61 aa, Artificial Sequence
  Synthetic
SELEEILKDLERMIREVEDYLRKSNERLEDVLRKVKKKLDEINDELRRVVEEVKKKLEDKG

SEQ ID NO: 14460 - protein, 56 aa, Artificial Sequence
  Synthetic
AEELKRRLEEIVKRARDLLKEHSDDNERLVERAERLVEEHRDKVRKIVEELEEEVR

SEQ ID NO: 14461 - protein, 61 aa, Artificial Sequence
  Synthetic
SEIERILEEVERAVRESDERLKDIVRKDREVVKRVKELLDKILRKDEEAIKRVIEDLERRG

SEQ ID NO: 14462 - protein, 56 aa, Artificial Sequence
  Synthetic
KDELKKEVDKWVKRARDIVKELEEHSRRSTDELRRTVEDLERHSEESVRRAEKTSE

SEQ ID NO: 14463 - protein, 61 aa, Artificial Sequence
  Synthetic
SELEKILKKIEDALKKVEEDLDRILEEDRKTLEEVKERLERDNEDLKRVVERVEEELKRRG

SEQ ID NO: 14464 - protein, 56 aa, Artificial Sequence
  Synthetic
TDELRKDVDRLVKRLKKLVDDLRRKSKETADRLRELVKRSRELSRTLAEELRKKTE

SEQ ID NO: 14465 - protein, 59 aa, Artificial Sequence
  Synthetic
SEDEEAKKRVEDLVRELKKSNDELRRKSEESLRRLKELNDELRKRVRDLEDRLRKLVED

SEQ ID NO: 14466 - protein, 55 aa, Artificial Sequence
  Synthetic
ERIIEELDKELKKSSEETDEIVKRDEDVLRRSDEESRRIIKKLEDVLRRADERVK

SEQ ID NO: 14467 - protein, 60 aa, Artificial Sequence
  Synthetic
SKDEEAKKRVEELTRKLEETVREDKKRIEDLAEKLKKVVDKLRRDSERTRKKLEEVERKG

SEQ ID NO: 14468 - protein, 55 aa, Artificial Sequence
  Synthetic
ERILRELEKVLREVKKKHKETLRTLEELLREVAKRAEDINEEDRKVLEDVVRKLT

SEQ ID NO: 14469 - protein, 61 aa, Artificial Sequence
  Synthetic
SEVEEILEDIRRRMTRVEERLRKSNKELEDAIREVTKRLKKSLDDLKKIIEEVKDVADKKG

SEQ ID NO: 14470 - protein, 56 aa, Artificial Sequence
  Synthetic
AEELRKMVEDLTKELEDLVEEDKERVKRWRDELEEIVKRDRDKVERWREEAEKIKK

SEQ ID NO: 14471 - protein, 61 aa, Artificial Sequence
  Synthetic
SELEEILRDVERLVRKVKTDLDDSLRRLKEVIDDVERLLRESNEKLRRVIKDVEDLADKKG

SEQ ID NO: 14472 - protein, 56 aa, Artificial Sequence
  Synthetic
EEALKKLVEDLRKRLREVVEEDKEKVRRWTEKAKRIVEDDKRRVEEWERKLEETVR

SEQ ID NO: 14473 - protein, 62 aa, Artificial Sequence
  Synthetic
DEVERVLDDVRRKLEKVRRDLRRIDEDLRRVVETVKRLLDESNKDLERAVRKVKDELDKKVR

SEQ ID NO: 14474 - protein, 56 aa, Artificial Sequence
  Synthetic
EEELRRVVKELKEDLERLVRELEETVREVKEELEKVVRDDEKLVEEWKKRLEERSR

SEQ ID NO: 14475 - protein, 61 aa, Artificial Sequence
  Synthetic
EEVERVLDDIRRVVEEVKRRLDEIDKKLTEENERVKEELDRIDDRLRKLVEEVKRRLDEKV

SEQ ID NO: 14476 - protein, 56 aa, Artificial Sequence
  Synthetic
REELEKVVEDIKRKLEKAVRDLEKTVKENKDRNDDIVRRVKKTVDDAEERLRRAVK

SEQ ID NO: 14477 - protein, 61 aa, Artificial Sequence
  Synthetic
KEVEDILRELRRAVEEHRRRSEELLRRMRKLVKDLEDRIREILERARRSVKEIKDRIEKDG

SEQ ID NO: 14478 - protein, 56 aa, Artificial Sequence
  Synthetic
EEVLKEVKKLLDEVRKRSKDIVDEVRKLLEEVLKEAERVLREWKKLNDEVEDRLRQ

SEQ ID NO: 14479 - protein, 61 aa, Artificial Sequence
  Synthetic
SEVEEVLKEVRKLIEDWRANSERILRRIERAIRELRRKIREWLERSKKKIKRLEEVIDKEV

SEQ ID NO: 14480 - protein, 56 aa, Artificial Sequence
  Synthetic
EDVLREARKRVDELEKRSREVAKRARDLLKEVRDKIKEVADRSRDLLRKVEEAIEK

SEQ ID NO: 14481 - protein, 60 aa, Artificial Sequence
  Synthetic
SAEEVDRRVEELLKELERRSEEVLETWKELNKKLNKDAKDVTDEVRELLKELAELIKRDG

SEQ ID NO: 14482 - protein, 59 aa, Artificial Sequence
  Synthetic
EEVVRRLLEDLRRLIDEWRKRSKEVEEEVRKSIEDIKRRIEEILRRIRKLIEEIRRRIK

SEQ ID NO: 14483 - protein, 59 aa, Artificial Sequence
  Synthetic
DEDERVKDLLRRVKKTVDELLEELKREVKKSREEAKRLLKELEDRLRRSRKEAEKLRSS

SEQ ID NO: 14484 - protein, 56 aa, Artificial Sequence
  Synthetic
REVLEEAKKILDDARRAIEEIIREWEEVNKEVDDRIDRIVEEWRKVNDKVNKDLTT

SEQ ID NO: 14485 - protein, 61 aa, Artificial Sequence
  Synthetic
SEEEKIVEDLRREVKRLAERVKELIETSKKLVEDSKRHVKDLARRLRDIIRKLKKDLRDKG

SEQ ID NO: 14486 - protein, 55 aa, Artificial Sequence
  Synthetic
RRALEELEKVVREIRRELERVHEETRRVIEESNRELEEILREAKELLEEVKKEAE

SEQ ID NO: 14487 - protein, 64 aa, Artificial Sequence
  Synthetic
RELEKALEEAKRLLDKVRKELKKIHEESRRLLKETRDETRRVLEEAERLLREIKKLIDRLREDR

SEQ ID NO: 14488 - protein, 59 aa, Artificial Sequence
  Synthetic
EEDVRRLVEELRDLIRELERKVKEVVETSRRLAEKDKEDNKRILEELRRLIRELEEDVR

SEQ ID NO: 14489 - protein, 60 aa, Artificial Sequence
  Synthetic
EEIERVEKLVEEVVRRAEDELRRSAEHVDRVVERAERLVERSREHSKDLMRRLEEVLRRG

SEQ ID NO: 14490 - protein, 59 aa, Artificial Sequence
  Synthetic
EDKAREIIERLRDVLRKIEEALERISRKLKEVLRRVEKKLEEDSRTLTRVVEEAKKKLD

SEQ ID NO: 14491 - protein, 60 aa, Artificial Sequence
  Synthetic
KEIEELDEEVRRLVEELKRLSDESRKHSKRLVEELKKLLEDSKRHSEELARRARKVLREG

SEQ ID NO: 14492 - protein, 59 aa, Artificial Sequence
  Synthetic
REDAERIIKKLEDVMKRAEETNRRDIKKLEDVLKDVEDKLREDSKRLREVLEEVKKRLE

SEQ ID NO: 14493 - protein, 59 aa, Artificial Sequence
  Synthetic
SEVEEILRDIERASEESKKTLDRILKKIEDASRRSKELSDKSLKEIRDAMEEIKKELDK

SEQ ID NO: 14494 - protein, 56 aa, Artificial Sequence
  Synthetic
SEELDRRVKELVRKSEEELKDLDREVKELVRRSEELLEDDKRLVKEVVDEARERRR

SEQ ID NO: 14495 - protein, 57 aa, Artificial Sequence
  Synthetic
DELEDVKRRVDEIVRELERLNEKLRRDVEEIVKRLKELNKRLLEEVRRTAEELKTKN

SEQ ID NO: 14496 - protein, 58 aa, Artificial Sequence
  Synthetic
EELREILKELKRVLDESRKLSKEIEEELERVLRDSERATEEILRELEKIIEEVERKVR

SEQ ID NO: 14497 - protein, 57 aa, Artificial Sequence
  Synthetic
DELEEVRKRVERIMEELKRHLEKIAKDSKKSVDELKKHLEDADRKSEESVRKLERDN

SEQ ID NO: 14498 - protein, 58 aa, Artificial Sequence
  Synthetic
RELEDILRRLEEVSERHRRSIEEILRRNEEASRRHRESIRRILEKNRRVLERVERKVE

SEQ ID NO: 14499 - protein, 60 aa, Artificial Sequence
  Synthetic
EEDERAKERVKRVVEENDKVNEDVEREVRKVVKENEDVLEEIKRTVDKIVEDLERLVREG

SEQ ID NO: 14500 - protein, 55 aa, Artificial Sequence
  Synthetic
ERILKELEDANEKSKKRSREILERLREANERIEETARRILKKLEEVLEEVERRTT

SEQ ID NO: 14501 - protein, 59 aa, Artificial Sequence
  Synthetic
KEREDVKREVEKSVEDLRRHVRDVEEKVRKIKKELEDHVRELKKRVEEIRRRLKDLADR

SEQ ID NO: 14502 - protein, 55 aa, Artificial Sequence
  Synthetic
ESVLEELKRANERHKREIERIRKELEDVSKEHEDRIRRVLEELERVLEEVKRRVD

SEQ ID NO: 14503 - protein, 60 aa, Artificial Sequence
  Synthetic
SEEERAKEEVEKHKRRLEKLVRDAERSSTEHERKLREIVERVKRELDKHEEKLRDIERKG

SEQ ID NO: 14504 - protein, 55 aa, Artificial Sequence
  Synthetic
EEVIREVEKISREVTKLLRDNLKRVEEVTERVERTLDELLERVKEVTKEVKERLR

SEQ ID NO: 14505 - protein, 60 aa, Artificial Sequence
  Synthetic
SERERAEELVRRHEDRLEKLVRELEESSDRHKKRLKRLVEEVRRLIEEHRRRLDEIKKEG

SEQ ID NO: 14506 - protein, 55 aa, Artificial Sequence
  Synthetic
EEVLRKVRTVSTEVKKRLDRNLEEVKKLTEDVTRKLRRLLEEVNKITRDVKREIK

SEQ ID NO: 14507 - protein, 57 aa, Artificial Sequence
  Synthetic
SELDEVRERLKRIVDDLRRRSEEVNKRLEEILREITERLREVNERLADIIRKIREDR

SEQ ID NO: 14508 - protein, 56 aa, Artificial Sequence
  Synthetic
EEVLKKLVEELRKRVEDMARTHDRLVEELKRKADEIVRRHEELVKDLKRKLEEVKT

SEQ ID NO: 14509 - protein, 59 aa, Artificial Sequence
  Synthetic
SEEEKAKELVKELRKEAKKIVDEMRKLVEDHAKLVEELVRDHKRLVDEHRRLIEELKDR

SEQ ID NO: 14510 - protein, 55 aa, Artificial Sequence
  Synthetic
EDVLRELEEIVRDIRKKIDDVIRKLEDISRKARKDSDDVNKRLNELTDDVRRKLT

SEQ ID NO: 14511 - protein, 59 aa, Artificial Sequence
  Synthetic
EEEERARDLVRRLEEIVRRLVKEHEDLVRRHKELVDKLVREHEKLLEDHRKLVEELKDR

SEQ ID NO: 14512 - protein, 55 aa, Artificial Sequence
  Synthetic
EEILERARKIVERLKTESDRVNKRLNEITRELEKRSDEVNTEVRRITKKVTEELK

SEQ ID NO: 14513 - protein, 59 aa, Artificial Sequence
  Synthetic
SEEERADKLVKELKKMAEDIKREMDKLVEELKRTIDELRKKHKELVDRHRRLVEELARR

SEQ ID NO: 14514 - protein, 55 aa, Artificial Sequence
  Synthetic
EEVLKTLKEIVRKIEEEIDRVEKRLRELVKELKDDSDEVNKEVNKITRKVKEELR

SEQ ID NO: 14515 - protein, 56 aa, Artificial Sequence
  Synthetic
RTEEEAERTVEDVARKVKEWREELEEVVKEVRERVKRWKEEMRKLDEDTKKKLDDA

SEQ ID NO: 14516 - protein, 55 aa, Artificial Sequence
  Synthetic
EEVIERIERILKDLHRDSERVLRELKRILDELHRESKESNERNKKLVEDAERRTK

SEQ ID NO: 14517 - protein, 56 aa, Artificial Sequence
  Synthetic
DTEKDAKRTVDDVRRKIREWEERLKKIVEEVKELVRELVERAKRLDEETEREAREA

SEQ ID NO: 14518 - protein, 55 aa, Artificial Sequence
  Synthetic
EEVIKELEDLLRRLHEESKRVLDTLRRILEELRDRVRRSNKRNEEIVKELEDRSR

SEQ ID NO: 14519 - protein, 56 aa, Artificial Sequence
  Synthetic
SEEDKAREVLKRVRDEVEKWRKELERLDEESKKKVDDLVRELEELDKKTDEELRRM

SEQ ID NO: 14520 - protein, 55 aa, Artificial Sequence
  Synthetic
EEILKKIRRILEKLHEDSRRSNETNRRILEELEKRVRESNKRNEDILREVKRKAK

SEQ ID NO: 14521 - protein, 56 aa, Artificial Sequence
  Synthetic
KTEEKVERDVERVKRDVDELIRRAEEVVKRVEDEVRKWIKELKELDDETERLVREA

SEQ ID NO: 14522 - protein, 55 aa, Artificial Sequence
  Synthetic
EEVIKRIKKILDDVRRAVKEVLDRIRRILEKVHEDSRRSNKRNKEILDKVREDTR

SEQ ID NO: 14523 - protein, 56 aa, Artificial Sequence
  Synthetic
SDEERVKEELKRILDEARRLLEESDEKLKRILDELRERLKESDERLKRILDKVRKD

SEQ ID NO: 14524 - protein, 56 aa, Artificial Sequence
  Synthetic
SEELEKEVRELKKRLKKLIDESDKNVKEAEKELRELLRRSEEHVKELKKDADRESK

SEQ ID NO: 14525 - protein, 56 aa, Artificial Sequence
  Synthetic
DDERRVKEKLKRILDESRDMLRRSDERVERSVRTLEDALRRSDEKLERILKKAEDD

SEQ ID NO: 14526 - protein, 56 aa, Artificial Sequence
  Synthetic
SKELDDAVKKNKKESKETVDRSEKNVKELHDRNEELLRRSEKNVDDAKRRLDDTSR

SEQ ID NO: 14527 - protein, 56 aa, Artificial Sequence
  Synthetic
DDEERVKKALDEILDRSRRRLEESDEKLDRSLKTLKKLLEESDRDLERILEKAERD

SEQ ID NO: 14528 - protein, 56 aa, Artificial Sequence
  Synthetic
REELEEAVRRNDEESKKTVDDSRRHVDELHRRNEKLIEESKDHVRRLEEELRKKSK

SEQ ID NO: 14529 - protein, 57 aa, Artificial Sequence
  Synthetic
DEKEELSERVERVIRTAEKLLDEIKRKLEEIHKKANEDLERSLRKLEKVVKEVRDAG

SEQ ID NO: 14530 - protein, 56 aa, Artificial Sequence
  Synthetic
EDELREDVERVKRRLEELIERLRKKVDEVKERHERMLKRSEEHVKELKDEVTEEAK

SEQ ID NO: 14531 - protein, 59 aa, Artificial Sequence
  Synthetic
SEKEELEKEVEDLERRHREELEKLNRKSKKIDEDLKRIIEELNKVSKKIKEDLEREIRK

SEQ ID NO: 14532 - protein, 55 aa, Artificial Sequence
  Synthetic
DEVRKRVEDINREVKEMLERNLRHTEEVIKKADREIEKNERHTREVIREAEERLR

SEQ ID NO: 14533 - protein, 57 aa, Artificial Sequence
  Synthetic
SEVEEVDKKLETSHRDIEKRIREVLRELEESSRKLKRDVDEVLKKLEESHRRIAESL

SEQ ID NO: 14534 - protein, 56 aa, Artificial Sequence
  Synthetic
SKRLEELVKEHKRTLEEVKRRLEELVKKHRKDLEDLVREAEELVERHKRKLDETEK

SEQ ID NO: 14535 - protein, 57 aa, Artificial Sequence
  Synthetic
SEVEEVDKEVERILDEARKALKRVEERVRKSHEDIRREIKRVEEDLERSSREIREKL

SEQ ID NO: 14536 - protein, 56 aa, Artificial Sequence
  Synthetic
AEKLKKLVEELEKEIRRLVDELDKLVRKHEEELDRLRKRMDELVKEHKKRLDDTAK

SEQ ID NO: 14537 - protein, 63 aa, Artificial Sequence
  Synthetic
DDEERAKKRVKEAEKEIKDLAKESRDIVEKHRKEVEDVVREMERIVRELAEEAKDVVRKVKDD

SEQ ID NO: 14538 - protein, 54 aa, Artificial Sequence
  Synthetic
EVKDRLRDVLKKAEEMSKEVEDRLRKSSEDLREEVERVEEELKRVLRKIEEDIR

SEQ ID NO: 14539 - protein, 63 aa, Artificial Sequence
  Synthetic
DDRERAKKTVDKVKEDLTRLVRRSEDLVRRHTEKLERVVEELERIVKELEERLKKVVDDVKDR

SEQ ID NO: 14540 - protein, 54 aa, Artificial Sequence
  Synthetic
DVKRTLREILRELEEASREVEERLKESDDRIRERVREVDEKLDRVLEELRKKMT

SEQ ID NO: 14541 - protein, 56 aa, Artificial Sequence
  Synthetic
DELEKVRKELKEILDKLKDVLEESRERTDRLLRKAEEDLRRSDEETERLVKELKDA

SEQ ID NO: 14542 - protein, 56 aa, Artificial Sequence
  Synthetic
KDELKKLVEDLDREVRKIVEELKELNKRIEDELRRIVDEARRSNEKVKELIDRLRK

SEQ ID NO: 14543 - protein, 56 aa, Artificial Sequence
  Synthetic
DEVETVEREADRILKEDEDVLRRSKKITEDILDTLREMLERSERRTEEILKRLEED

SEQ ID NO: 14544 - protein, 56 aa, Artificial Sequence
  Synthetic
KDELKKLVDELKERSKETERELKESNDRLRKKVEDIRRELKRLNDEAEEAVRRLRT

SEQ ID NO: 14545 - protein, 56 aa, Artificial Sequence
  Synthetic
SLIERIEEEIRRVIERVRRLVREIEDSDRKAKEDLERVVREDEETLRRVEKKLKDL

SEQ ID NO: 14546 - protein, 59 aa, Artificial Sequence
  Synthetic
EEEVKKLLEKVKRTARELEKVAEDMLRSNRELVKELLRTLEKSLRDSERTAEKLERAEK

SEQ ID NO: 14547 - protein, 56 aa, Artificial Sequence
  Synthetic
DKEKEISDRLKDVLRKVRDVIEKDKRTNEEARKRVEDLVRKDEETLKRVLEEVRKG

SEQ ID NO: 14548 - protein, 56 aa, Artificial Sequence
  Synthetic
LEDLLRKVEKLAREITERLKESNERSRDLVEKLKREVKKSLRKSERLMEKARETLR

SEQ ID NO: 14549 - protein, 56 aa, Artificial Sequence
  Synthetic
SEREEVKRTLTKAEEEARRLIKRDRDTNTEILKEATERSERDKDKLRKILEEVKKA

SEQ ID NO: 14550 - protein, 55 aa, Artificial Sequence
  Synthetic
KDILDRVRRLVEELRRMIEELNDKSRKLVERLRKLLEDLNRHLEELVKRLRDKAK

SEQ ID NO: 14551 - protein, 56 aa, Artificial Sequence
  Synthetic
SAKEELEDRIRDIVRRVRELITEVKKKNREILKRVEKVIKEVKETNERIEEEVRRG

SEQ ID NO: 14552 - protein, 56 aa, Artificial Sequence
  Synthetic
IDKARKEVEDLVRDAKRVIEELERSLDELVRTLDELVRRLKKSSEDLMRELRKTTE

SEQ ID NO: 14553 - protein, 56 aa, Artificial Sequence
  Synthetic
DEKKEVEKRLKEIEDEVRKMIKEVKETNRRILKKARDLIKKVEDTNKRILEEVRRG

SEQ ID NO: 14554 - protein, 56 aa, Artificial Sequence
  Synthetic
IKKLEDEVRKLKDELRRELERLKRSSTDLARRLEEIIRRLERSSEDLERRLRERER

SEQ ID NO: 14555 - protein, 56 aa, Artificial Sequence
  Synthetic
DEKEEVRKRLTDILRELEDLSRENERSNRRILDRVRELIERVKKTNKDILEEVERG

SEQ ID NO: 14556 - protein, 56 aa, Artificial Sequence
  Synthetic
IDKLRREVEELVRDLRRLIEELSRSSEELVKELEKLLRELEESSKKLAEELRKAVE

SEQ ID NO: 14557 - protein, 60 aa, Artificial Sequence
  Synthetic
SSKERIKEKVDRIEERIREVVKEVEEELRRSTEEARRMVREVKRRLEDSNRKIKKFIDEK

SEQ ID NO: 14558 - protein, 56 aa, Artificial Sequence
  Synthetic
SEELKRLLEDLRRKIEELAKELKKLLEEHKRRVDDVVRRMEELLKRHEELVRRIAK

SEQ ID NO: 14559 - protein, 58 aa, Artificial Sequence
  Synthetic
SEAEEAKKTVEEISERLREALRRSEEETERILRENEKASERHKTEIEKITKELEDKLG

SEQ ID NO: 14560 - protein, 56 aa, Artificial Sequence
  Synthetic
KDELKKVLKEIEDTVRRIVKELEDLNTEAEKASRKSVKELEEHLKRVEERVREEAK

SEQ ID NO: 14561 - protein, 59 aa, Artificial Sequence
  Synthetic
ELKERLEKLLKDWADDSKRMRDELARLLKEWEDRSRKAKRDLEKILEENDDKVKKLDKV

SEQ ID NO: 14562 - protein, 59 aa, Artificial Sequence
  Synthetic
EKVLREVKESAKKISRHSEKVLDEARKELERISEHSRRVLDRVRRESKKIVEDLRERKR

SEQ ID NO: 14563 - protein, 60 aa, Artificial Sequence
  Synthetic
DIERELEEIVRRIKELIRRHKKRLEELVRELEELLRRHREELKKLVKRAAELVEELRRRN

SEQ ID NO: 14564 - protein, 55 aa, Artificial Sequence
  Synthetic
DTVKDMLRKLLEEVKEASDRAREKLTDILRKIKKISEEVKREIDDIRKKIEDTAK

SEQ ID NO: 14565 - protein, 60 aa, Artificial Sequence
  Synthetic
SIEEEAARIVEELRREVEEWERTLREIVERLRRLVEEHKRRLDELVAELKRLVDELRKEN

SEQ ID NO: 14566 - protein, 54 aa, Artificial Sequence
  Synthetic
DIRRKLKEILDELDTITEKLKKELERIKREMKEASRRVREKIDRIRKEIEEVAR

SEQ ID NO: 14567 - protein, 56 aa, Artificial Sequence
  Synthetic
DEIRELLKRIRDVAKRIKDKADRLNEKSRRKVEKLVRDVEKINEDTKRLLDRLRDS

SEQ ID NO: 14568 - protein, 59 aa, Artificial Sequence
  Synthetic
EDVLRELERLLKEIEDLVRELNKTNKKIVDKARKDVKDVHRTNERLLREIERVVREKLK

SEQ ID NO: 14569 - protein, 56 aa, Artificial Sequence
  Synthetic
SEAEELLRRLEKIIEDLERNARALLEKLKEEIRRLDKNLRDLLRRIEKIMRDLTRS

SEQ ID NO: 14570 - protein, 59 aa, Artificial Sequence
  Synthetic
EEVLKEIKRVLEEAEKVSEDLLREIKEVLDRAEELSRRLLKTLEDLLRDIERSVKERED

SEQ ID NO: 14571 - protein, 57 aa, Artificial Sequence
  Synthetic
SSKEKVEELVKEIEEEDRRVLEDTRRLLEEIMRRDEDVLRKTDERIKEIEKELRDRV

SEQ ID NO: 14572 - protein, 56 aa, Artificial Sequence
  Synthetic
SKEAEDRLRDLVRRSREIAKRSRDHLRDLLRESEERVRASLEHVERLVKKLRKDAN

SEQ ID NO: 14573 - protein, 56 aa, Artificial Sequence
  Synthetic
SEAEDLLRRLEEEIRRIKKRHKEVLDELRKLIKEVEDRHKELLDRLREEIRELEER

SEQ ID NO: 14574 - protein, 59 aa, Artificial Sequence
  Synthetic
DRVKEELRRIVKEVRDEIRKANEKIKRLLDEVRERSKDMNRRLKEIVDRVTESLRRKAE

SEQ ID NO: 14575 - protein, 61 aa, Artificial Sequence
  Synthetic
SEVDEALERIKRLIEDLERHVREWLKELREIIEDLRERVRKLLEDLERRIKELEEKARRTG

SEQ ID NO: 14576 - protein, 59 aa, Artificial Sequence
  Synthetic
SKAVEDLERLVEELRKLSEEASRRSRKILEELRETVERVIKRLKELLKKLKEVVDELRR

SEQ ID NO: 14577 - protein, 61 aa, Artificial Sequence
  Synthetic
DRAEKVLEDIRKLIEEMRKHAEEWERRAREAVKELRKEVTDWRRRLRKLLEDLEEKVRREG

SEQ ID NO: 14578 - protein, 59 aa, Artificial Sequence
  Synthetic
SEVVRRLEKLVEDLRKINEDVNRRSRELVETLRDDVRKVNEESKRILEEVKKILDDSKR

SEQ ID NO: 14579 - protein, 59 aa, Artificial Sequence
  Synthetic
DLRRELRRVLEESKKHVKELVRELDEDLTRWERRVEELVKRLRDVLRKLEKEVDELEKK

SEQ ID NO: 14580 - protein, 58 aa, Artificial Sequence
  Synthetic
RVKEELRELVRESDKIAEEIIEKLDRDVKKVKKDHERIDEELKRKLKEVEERVERIRT

SEQ ID NO: 14581 - protein, 61 aa, Artificial Sequence
  Synthetic
SEVEETLREIKEDIKRSKKEWDDLLKTIKELIEDSKRKWDKLLRDVEELIRELLERLRRDG

SEQ ID NO: 14582 - protein, 59 aa, Artificial Sequence
  Synthetic
DRAERDVERIIREAKKLTDKVREDVERLREEWERLVREVKERIKRLLEDLRRLVEETRR

SEQ ID NO: 14583 - protein, 61 aa, Artificial Sequence
  Synthetic
DEAERLLEEAERIIEKSREEWERLLERIKRLIETLRKRYEDDLRESEKRIEELLRKARRDG

SEQ ID NO: 14584 - protein, 59 aa, Artificial Sequence
  Synthetic
DRVAREVERILRELKKLTDDMKKRAKELIDELKRLSEEMHRRIEKSNEDLKRLVDDVDR

SEQ ID NO: 14585 - protein, 61 aa, Artificial Sequence
  Synthetic
DEAEDILRRIRELIERSKRKWDELLREIKKLIEESRREWEELLRRIREIIERLKRLAERDV

SEQ ID NO: 14586 - protein, 59 aa, Artificial Sequence
  Synthetic
ERVKEEMKRLIEDLKRVSEEVKRELDKLIEELKEVSERASKRLKELIDDLDRLVKEVEK

SEQ ID NO: 14587 - protein, 59 aa, Artificial Sequence
  Synthetic
SEDEKAIEELKKEIERLRRLLEELRKHVRRLIEEIKRLVEESKRHVEELIREIDDLRRR

SEQ ID NO: 14588 - protein, 55 aa, Artificial Sequence
  Synthetic
KEVTDIIRELKEVLDEIKRTSEELLRTIEEIVRDAERKNRELLKELKKVLDEVEK

SEQ ID NO: 14589 - protein, 58 aa, Artificial Sequence
  Synthetic
DEDEELIKRLRDRIREIRKLVEDSARNVKRLIDEDERLARRSLRHLEETLKEIERKAR

SEQ ID NO: 14590 - protein, 55 aa, Artificial Sequence
  Synthetic
DEVREVLKEIRELVKELKERNDELLTRWKESIKRVEEEDERILREIERRVEEVER

SEQ ID NO: 14591 - protein, 60 aa, Artificial Sequence
  Synthetic
RAEEEVKRLLKEDNETLKRIEDDVRRLLRKNNESIREAEKTNRELVKRVEDIIRRARERG

SEQ ID NO: 14592 - protein, 56 aa, Artificial Sequence
  Synthetic
LEELLERIKELNERTKKKVADLRRVAKRLDEETERKVRETERRWRDVLDKVRKKVK

SEQ ID NO: 14593 - protein, 55 aa, Artificial Sequence
  Synthetic
REVEEVLERLKELLREHEKHAKEVEDRLRELIRENKEHAREMLERLEKILDELKK

SEQ ID NO: 14594 - protein, 59 aa, Artificial Sequence
  Synthetic
EEALRELRRLLDEIRRVNRKVEERIKEVLKKIDEDNKEVVRRLEEALEKIREVIERTAT

SEQ ID NO: 14595 - protein, 59 aa, Artificial Sequence
  Synthetic
KAKEDVKRALDEWKEVNDRVNEELKKAIDTWREVNRKVKEDVDRLVKEIEELIRRVREN

SEQ ID NO: 14596 - protein, 56 aa, Artificial Sequence
  Synthetic
REDVKRELKRVIEETRERAKRLLEDLRRLIEETKKLAEELLARAKEIIDRIREAAR

SEQ ID NO: 14597 - protein, 61 aa, Artificial Sequence
  Synthetic
RAEEELDRLSREVEKVSKKAREDLEEMRKALEDVSRRVKEKLRRILEEIKEAIKDVKRRTN

SEQ ID NO: 14598 - protein, 56 aa, Artificial Sequence
  Synthetic
RELIREVEKLIEDHRRRLEEIVETVRRLVDEHRRRLERIVREAAKLVKDIKRELEK

SEQ ID NO: 14599 - protein, 61 aa, Artificial Sequence
  Synthetic
SVKEKLRRISKELEKASRDDERENRRILKEARDVIREAADKIRRIEEELRKIIDRVRKETN

SEQ ID NO: 14600 - protein, 56 aa, Artificial Sequence
  Synthetic
EEIIEEVKRLVDEHKKRLDENVKRLKELVDRLRETLERLVDRLRKLVETLKRESDR

SEQ ID NO: 14601 - protein, 61 aa, Artificial Sequence
  Synthetic
KVEEDLKRIKKEIKDAADEDREKNREIMKRLNDVTREVEERLRKILEDLERLVRRVKEEVN

SEQ ID NO: 14602 - protein, 56 aa, Artificial Sequence
  Synthetic
EELIKRVKELVREAKERLKDNVRRLEELVKEWKRKLKEIVDRVRELVKDLERRLKE

SEQ ID NO: 14603 - protein, 61 aa, Artificial Sequence
  Synthetic
SEKEKIVKDVEELIREAEELVRRLLKRLKELNDESEKTARDLVRKNEETLKELKDVVDRRV

SEQ ID NO: 14604 - protein, 55 aa, Artificial Sequence
  Synthetic
RELDELIKKLDEVLRRAEKEAEELIRDHRRISREVKERIKDLNRRIERILREAEK

SEQ ID NO: 14605 - protein, 61 aa, Artificial Sequence
  Synthetic
SLEEIVKRVEEDIRRIIEELRRRIEEADRKIAEIIDRLRKTVEKVNKEIEDLIRELKKKEG

SEQ ID NO: 14606 - protein, 56 aa, Artificial Sequence
  Synthetic
DKRVRELVEEVKKKLRDLVEEVRESVKRLEDTLRRVEEEIRTTARELLRRLREELE

SEQ ID NO: 14607 - protein, 59 aa, Artificial Sequence
  Synthetic
SLEEEVRETVKRLRKEVEDWLREVEKVLEDLLRELKKSIEETKKVAKELEDKLRDVKRR

SEQ ID NO: 14608 - protein, 59 aa, Artificial Sequence
  Synthetic
ERIRRTLEKAREEVKRLSAETKRLIEEVKRRLDELLKRDNDIIDDARRRVKKVLDEIET

SEQ ID NO: 14609 - protein, 59 aa, Artificial Sequence
  Synthetic
DLEEELRKVVEDLERKLRESIRETEEVMRRLEESVEESIRKTEEVVKRLREKLEDVKRR

SEQ ID NO: 14610 - protein, 59 aa, Artificial Sequence
  Synthetic
DEIRDTVRKAKEDVERLLEEDNRRIKEVLDRVAKLNKRDNETIERAEEEARKVLREIEK

SEQ ID NO: 14611 - protein, 59 aa, Artificial Sequence
  Synthetic
DIEEEIREEVERLRRTLKELADRIKKLVDELREKLRRWLEEVEEVLRRLIEDLRRVKEE

SEQ ID NO: 14612 - protein, 59 aa, Artificial Sequence
  Synthetic
EELEKRVREAEEEVRRVNKKLKDDLDKAREDLKEFSDRTRRMIKAVERDVKRVLDEIRR

SEQ ID NO: 14613 - protein, 58 aa, Artificial Sequence
  Synthetic
SVEETIKRILEEVEELIREVKERNERIERRAERLIEEVKRSNDEIKKEVRTAIEKVIR

SEQ ID NO: 14614 - protein, 56 aa, Artificial Sequence
  Synthetic
KEKVDKLVKDLRRVIEELRKSLEDLERRLDDILRRLKESSDELVRELRRLLKEMEK

SEQ ID NO: 14615 - protein, 60 aa, Artificial Sequence
  Synthetic
SVEEALDEIEKKVEEMIREVKETNDRVRRKVKELSEKSKTENERVVREARELIREVERER

SEQ ID NO: 14616 - protein, 56 aa, Artificial Sequence
  Synthetic
KKDVDDLDRDLEKKLRDLKDSSRKLVKRVEDLVRESEDTVRKLIERLERLIRETKR

SEQ ID NO: 14617 - protein, 58 aa, Artificial Sequence
  Synthetic
KVEEELDKILKEVEDLVRRDEEEIKRILEEVKELIRKVKETNDKVEREMRKLVEEVKK

SEQ ID NO: 14618 - protein, 56 aa, Artificial Sequence
  Synthetic
EDSVRELVKRLRERAEESKKRTKDLEDKIRTKIEELERSSKELTDELRTLIREAER

SEQ ID NO: 14619 - protein, 59 aa, Artificial Sequence
  Synthetic
SVEEAIKEILRELEKVNEDSKRLSDRNLKELEKALRDAKKSVEEILRELEKALDEVRKN

SEQ ID NO: 14620 - protein, 60 aa, Artificial Sequence
  Synthetic
REDVERILKEIKDEVDRVRKENERVNRESEDESRKLVEELKKVLRRLKEEVRRIVEELRT

SEQ ID NO: 14621 - protein, 61 aa, Artificial Sequence
  Synthetic
EVEERLEEILRRLERAVEDWKRKNEKILKELRDVVRESKKRTREIEKKIEDAARDVLREVN

SEQ ID NO: 14622 - protein, 56 aa, Artificial Sequence
  Synthetic
KEVVKELEKDVRRIVEELKDSLRRLKEKVEEVARTVKKLNEELDDSVREIVERLRK

SEQ ID NO: 14623 - protein, 61 aa, Artificial Sequence
  Synthetic
NVEEELDRIRREAEKVVKESRELTREILERAREAVEKSEEDTRRILERLERVVKRVKKDVN

SEQ ID NO: 14624 - protein, 56 aa, Artificial Sequence
  Synthetic
EEVLDELRKKVKKLVDELRTEDRRLEEEVKKIVRDAEKRNKELEDEIRRLAEELEK

SEQ ID NO: 14625 - protein, 60 aa, Artificial Sequence
  Synthetic
SETETAVKKLKKLVDDLKREVERLVERLRELVRENSEKSRELVKRSDDLVRELLEKVKRR

SEQ ID NO: 14626 - protein, 56 aa, Artificial Sequence
  Synthetic
SELVKTVEEELKKVLEEVDRLVRKILEDLRRSLEESKRLSEESKKKLEDVLDRARR

SEQ ID NO: 14627 - protein, 60 aa, Artificial Sequence
  Synthetic
RELEEAVKKLKKKVEDNTRTSRKLVTDLEREVEELKKEVEEVVRKSKELVRELKKKVDRR

SEQ ID NO: 14628 - protein, 56 aa, Artificial Sequence
  Synthetic
SELVERVKEELKRSLEESDKLVEDVRRKLKEVLDDIRRLSEESKRELRDVLREADK

SEQ ID NO: 14629 - protein, 60 aa, Artificial Sequence
  Synthetic
ELEEIVKDARRRIKELIDEARRTSEEVVERIKELLKRAEEISREARKRLTELLEELKKTV

SEQ ID NO: 14630 - protein, 56 aa, Artificial Sequence
  Synthetic
KEELRKIVEDILRTIKKLLEELRDDARRLLEEIKRLLEELERHVRKLLKEIDERIK

SEQ ID NO: 14631 - protein, 60 aa, Artificial Sequence
  Synthetic
ELEEIARKAKEDIERLVEEARRISEEVKRELTELVERLRRISEEVRKRIEDLADELRKKV

SEQ ID NO: 14632 - protein, 56 aa, Artificial Sequence
  Synthetic
KKTLKEKVEDILRRIRELLRELRENARELVKEIERLIRELEKDAKRILKKIEDAIR

SEQ ID NO: 14633 - protein, 60 aa, Artificial Sequence
  Synthetic
SVEELVKEIEKRLDELVREIEKTNKKVEDDIRKMLEDIKRVHDKSNEDLEKLVKELREKL

SEQ ID NO: 14634 - protein, 56 aa, Artificial Sequence
  Synthetic
LKDIEKVARDILRRVKKILEENRKHAEKARRELEKLLRESKRLVDELLRRAEEEKR

SEQ ID NO: 14635 - protein, 60 aa, Artificial Sequence
  Synthetic
SREDRARELVKRILDEHKKILEDVEELAKELLRRHEELLKTLRELMRRIEEDLKRLEDED

SEQ ID NO: 14636 - protein, 56 aa, Artificial Sequence
  Synthetic
SEILKTVTRLSEELNRRIREVVRKVEEDLEDLNRRLKKIADEIEERIKEILRRIEK

SEQ ID NO: 14637 - protein, 60 aa, Artificial Sequence
  Synthetic
SIEDVVRRIREEDRRLHEEIRKVVDEIRKRLEDALRSHEERVREVLERIKKLLEELKRRG

SEQ ID NO: 14638 - protein, 56 aa, Artificial Sequence
  Synthetic
EKDLRKKLREIEEKNERLLRELERLLEEIRRTLEDLNRKLDEEIKKLERRLKERDR

SEQ ID NO: 14639 - protein, 58 aa, Artificial Sequence
  Synthetic
SLKELIDEVERRLREVNRRARELVEEVKERLRRVNEESRELLREIEERLEDVLRELEE

SEQ ID NO: 14640 - protein, 59 aa, Artificial Sequence
  Synthetic
EEEIKELVKRARELVKRSKEHVDELMETAKRLVDESRKHAEELFRELKKLIEELREKIR

SEQ ID NO: 14641 - protein, 60 aa, Artificial Sequence
  Synthetic
SEVEKLVEDLRREVKRHSEKVERLVKELRDDLERWKERLEEIMRRLEKLVRDLEELLRRG

SEQ ID NO: 14642 - protein, 56 aa, Artificial Sequence
  Synthetic
EELVREVKERLERSRERVDKLLRDNHKRLKEVLDEAKKLIDRVRKLLRRVLEEAKK

SEQ ID NO: 14643 - protein, 60 aa, Artificial Sequence
  Synthetic
SDVERLITELADSVRDHSRDVRRVVEELEKLLRDWERDIEDIVEKLDRLVRTLEELLRRG

SEQ ID NO: 14644 - protein, 56 aa, Artificial Sequence
  Synthetic
EDLVRTVEKLNTESLDEVRKLVKKNHEDLKRVLDKAKKLIEEVRKKLEEVLDEARK

SEQ ID NO: 14645 - protein, 59 aa, Artificial Sequence
  Synthetic
TLEEILKEVAERVKKANEDSRRILEKVKRDVETVNRENEKILKKAAEDVKRVLDEARKR

SEQ ID NO: 14646 - protein, 56 aa, Artificial Sequence
  Synthetic
EKELREMIEKLKRDNERMLRELERRIEELKRDNDRVNEESKRLVDELKRDAEEKLK

SEQ ID NO: 14647 - protein, 59 aa, Artificial Sequence
  Synthetic
TLEEILREVEKRVKEANERNRKISEELADLVRRVNEENKKILEDVAEEVRRALERARRR

SEQ ID NO: 14648 - protein, 56 aa, Artificial Sequence
  Synthetic
EEELRRMIEELEKRNRDVDRESKKLAEELEKTNRDVNRKSRELVRRLRRKLEEELR

SEQ ID NO: 14649 - protein, 59 aa, Artificial Sequence
  Synthetic
ELEDILREVRKRVEDVNRRNKEILERVAEEVRRLNEENKRILEEARKRVEKVLEDLKRR

SEQ ID NO: 14650 - protein, 56 aa, Artificial Sequence
  Synthetic
EEELRRAIKELKDRNEDVDRRTKELIKRLEDKNRELNRESRERVEELKKRAEELAR

SEQ ID NO: 14651 - protein, 59 aa, Artificial Sequence
  Synthetic
DLEEILKDVKRRVEEANRRNEKILEEAKEKVDRVNRSNEKILEEVKETVKEVLRRAREE

SEQ ID NO: 14652 - protein, 56 aa, Artificial Sequence
  Synthetic
EEELKEMIRRLEETNRRVDKETRKLIEELERRNREVDRESERLIRELKKKAKDDLD

SEQ ID NO: 14653 - protein, 59 aa, Artificial Sequence
  Synthetic
TLEDILREIAKVVKEANKRNKRILEKVARDVEEVNKENKKILDEVKRDVERVLREAEKR

SEQ ID NO: 14654 - protein, 56 aa, Artificial Sequence
  Synthetic
EDELRRMLEELERTLREVDRESDELVKKLKRDAERVNEETRRLIKELKEIADRLLD

SEQ ID NO: 14655 - protein, 60 aa, Artificial Sequence
  Synthetic
SIEELVREIEKTNEDMRREIERLSDENRRRLDKALEDIERRAREIKEKLERVMKRLREKG

SEQ ID NO: 14656 - protein, 60 aa, Artificial Sequence
  Synthetic
EKRVLDELRKLLEDSKDELRRLLEELRRHIKETDDTVRELLDRIRKIREELDDEVRRLEK

SEQ ID NO: 14657 - protein, 60 aa, Artificial Sequence
  Synthetic
KEEEDARRALKRVEEEVRRNKEEMRKLLEDNEKRIRENKKRAEDSSRKVKKRIDELRRDG

SEQ ID NO: 14658 - protein, 55 aa, Artificial Sequence
  Synthetic
EEVLREIEKILRDLERDHRRVLEEIRKRNDELRETHERVLRENEKILEKVERELR

SEQ ID NO: 14659 - protein, 56 aa, Artificial Sequence
  Synthetic
SVDDKVRRRIREIKEELERVLTRSERESDDIKRELEEVLKRSEERTKKIKDDAERG

SEQ ID NO: 14660 - protein, 60 aa, Artificial Sequence
  Synthetic
DERVMRDLERELEKLERKVREIKRELEEHNARLREKVRRIDEDLKRDNKELEDTIREDTR

SEQ ID NO: 14661 - protein, 59 aa, Artificial Sequence
  Synthetic
KEEEELEERIRRLEKLVEDYKRELDRSIKELEDEVDRARRELEKSIEEMKKKVKKAEDD

SEQ ID NO: 14662 - protein, 59 aa, Artificial Sequence
  Synthetic
DRVIRKIKKLLDEVRERLERINRTHRELLKEVEERLKKILKDITDANRRIEERLEEITR

SEQ ID NO: 14663 - protein, 60 aa, Artificial Sequence
  Synthetic
SLKEELKRINDENKEELDRLREELKKLLKEVEEELRRAAEELERINRRIKEELDKVADRV

SEQ ID NO: 14664 - protein, 59 aa, Artificial Sequence
  Synthetic
EEVAERLLEELREDVKRTKEKMKEMLDRVKKKIDDIKRKLEKLLRDNERRIEELKRDAD

SEQ ID NO: 14665 - protein, 58 aa, Artificial Sequence
  Synthetic
SVEEKLKKALEESKRKSKRIKDDDERANREVKKRIEDIVRRLEEVLRKVLKDVTKDIK

SEQ ID NO: 14666 - protein, 56 aa, Artificial Sequence
  Synthetic
EDEVTRDVKRLEDHNTRLEKKVKESVERLKEKLEELRKRVEKIERDLEKLLEDVRT

SEQ ID NO: 14667 - protein, 60 aa, Artificial Sequence
  Synthetic
KAEDVLRRVKEEHERIRREIKRVIDDVRRKHKEILDRLREEIKRVEELLRKILEDVERDG

SEQ ID NO: 14668 - protein, 56 aa, Artificial Sequence
  Synthetic
EEVVKELEDNVKRNEEDAKRTVEKLRKNLEDNRREVEKIVRDLRRLVEKAREDVKR

SEQ ID NO: 14669 - protein, 56 aa, Artificial Sequence
  Synthetic
DLKEILDEARKLIEDLRKKAEEILEESKRLLDDLKRKADEILTRYDELTKRLSTKV

SEQ ID NO: 14670 - protein, 56 aa, Artificial Sequence
  Synthetic
LEELKKRLEELIREVEKDLRRIKKESEDRVEEIERRLRRIAEELDKDVRRVEEEAK

SEQ ID NO: 14671 - protein, 63 aa, Artificial Sequence
  Synthetic
SKEETVARRVDEIARELEEKNKKWEDDSRKAVDELRRKLEEWEKRSRDLREKVKDLLRKLKDQ

SEQ ID NO: 14672 - protein, 55 aa, Artificial Sequence
  Synthetic
EELKKKVEKLLEDHRKKSEELLRKDEKLIRDMEREVERLLREDEKVIEDVERATK

SEQ ID NO: 14673 - protein, 63 aa, Artificial Sequence
  Synthetic
SKEETVERDVERIVRRLRELNKEWKKRSEEVKREVDESDKRTAEAVKKLVRDLEETLKDLKDR

SEQ ID NO: 14674 - protein, 55 aa, Artificial Sequence
  Synthetic
EEIKKKLEKLLKEHEDLSRKLLKEDEEEIDRHRRKVREWAEDLRKKLEEAERAST

SEQ ID NO: 14675 - protein, 60 aa, Artificial Sequence
  Synthetic
SEKERAEEELKRIEDELREAIKRSEDRLRRIEKELRDREKRSEEELRRLEEELRRLAEER

SEQ ID NO: 14676 - protein, 55 aa, Artificial Sequence
  Synthetic
RKIIEDLKRLLREFERAVEESNERLRRLLEEFKEKVKESNKRSRELLRRMEEEVR

SEQ ID NO: 14677 - protein, 57 aa, Artificial Sequence
  Synthetic
DDLERLEKEAREILERHKRALDELEKRLRRVLEKHEEDLRRLEETLRELLKKVRKDG

SEQ ID NO: 14678 - protein, 56 aa, Artificial Sequence
  Synthetic
REELEKEVRKLEKKSRDDIRRLEKELRELEKRSRDNIRELEKRVRRVARELDKTAK

SEQ ID NO: 14679 - protein, 59 aa, Artificial Sequence
  Synthetic
DEKEEAEKALREIKKRIEDNVREVRRLNRELREKLRKLIEDYDRLLKELEKRVEDIVRK

SEQ ID NO: 14680 - protein, 56 aa, Artificial Sequence
  Synthetic
ERDLRREEKKLRDELRDLHREHRKSIEDLDREIKKMEDELRRSIEENRKRVEELEK

SEQ ID NO: 14681 - protein, 56 aa, Artificial Sequence
  Synthetic
REKERVKRVVRRVEEELKRNLEEVEEESRRDLRRLEENLERVEEAVRRILKRLDDS

SEQ ID NO: 14682 - protein, 56 aa, Artificial Sequence
  Synthetic
REELEKLIEKIERELKKTHDDSRREIERLRRETKKLHEKSEELIRELEKRLRDAER

SEQ ID NO: 14683 - protein, 60 aa, Artificial Sequence
  Synthetic
SEVEEILDRIRRELERLAREARKTVERNKKELDRIREEVDRSLRRNKEELDRLRREKKDV

SEQ ID NO: 14684 - protein, 59 aa, Artificial Sequence
  Synthetic
EDARRAARELLKRLEDLLREHHDRLRKSDEEIRKLIEDHHRALEESNREIKELIDRMAK

SEQ ID NO: 14685 - protein, 60 aa, Artificial Sequence
  Synthetic
DEAEKLIKDIEDKDEELKEKARELKEKLEERDERTKKLIEELKREADRTLEELKKKVEKA

SEQ ID NO: 14686 - protein, 58 aa, Artificial Sequence
  Synthetic
EVVKRVRDLLKRHEDLTREIKKEVKKMNEKNRELVRRVEETLKKLLEDLKRLLDESRK

SEQ ID NO: 14687 - protein, 60 aa, Artificial Sequence
  Synthetic
SEEEEKVKDIERKLRKHNKEVKDTERENEKRLRELRRTVEEDRKDAERELERIKRVVERG

SEQ ID NO: 14688 - protein, 55 aa, Artificial Sequence
  Synthetic
EELDRLEKELRESIRRAEELLKDSKRRADELIERIKDVLRKVKEKIEKLIEDTRR

SEQ ID NO: 14689 - protein, 57 aa, Artificial Sequence
  Synthetic
SEKEVVEELKKTVDDLKRKSEEAIKKAKEAVDKIRRDSERAIRKNEDTLRKIEEEIK

SEQ ID NO: 14690 - protein, 56 aa, Artificial Sequence
  Synthetic
EDILREIAKRIKDLIEDHKRASKEIERDIRKILEDHKRAAEKIRRDLRRLLEDVER

SEQ ID NO: 14691 - protein, 60 aa, Artificial Sequence
  Synthetic
SLEKMVTDIIRKLEEIARRHKTRSDEIVRRLEEIIKTHEKRSKELMDDLKRLVDEVRKKK

SEQ ID NO: 14692 - protein, 56 aa, Artificial Sequence
  Synthetic
EEDIRRLDEEVKDLERRSREEEERLEREVRELEKRSEETIRRVEKKVRDLADELRK

SEQ ID NO: 14693 - protein, 59 aa, Artificial Sequence
  Synthetic
SEEDVVKKVRKKLEDVHRDTRREIRRLEEETKKLHDETRKTIETIERRLRDLRDRLTKE

SEQ ID NO: 14694 - protein, 56 aa, Artificial Sequence
  Synthetic
SEEVRDVKEKLKRNLEEARKASREDLERLKRNLEKADEDVRRLLEELKRLLDEVRR

SEQ ID NO: 14695 - protein, 60 aa, Artificial Sequence
  Synthetic
SLEEAIEDLRRKLEKLLKDYADLSKEIEDKLRKIHEDSRRLVEKLEEEARRILKEVRERG

SEQ ID NO: 14696 - protein, 60 aa, Artificial Sequence
  Synthetic
EEEVRKEIEDADKRVKDLKRELERDIDELRKRVEELRRRHEEKIKKVAEDVKRREDEARK

SEQ ID NO: 14697 - protein, 61 aa, Artificial Sequence
  Synthetic
SRLEKIKRELDKKLKDHEDDSRDKVRKLRESLKRHEDKSRKEEEEVKKTLKELEDKLRRDG

SEQ ID NO: 14698 - protein, 56 aa, Artificial Sequence
  Synthetic
KRLVDDAKRKIKELEEENERLVKEVEDRNRELDERNKRIIDRIRRLNERVKEEAEK

SEQ ID NO: 14699 - protein, 57 aa, Artificial Sequence
  Synthetic
DEVETVIERDKKLLEDWVDRARKVVKRDEDSLRRDEEENRRVVEENSRTVKELKERI

SEQ ID NO: 14700 - protein, 58 aa, Artificial Sequence
  Synthetic
EVVKRVEEEVKRLNERADELLKRVEKRAEELNEESRRLSEEVERKVRELNREADERVK

SEQ ID NO: 14701 - protein, 57 aa, Artificial Sequence
  Synthetic
SEVEEVVKRNSDTAKEDMDRNEKVVEDNSKRLREWEKAIEEVEKEVDKAMKDLKRRI

SEQ ID NO: 14702 - protein, 58 aa, Artificial Sequence
  Synthetic
KLVEDVRREVEKLNRESEERSKRVKEEVDDLNRKLEKLLRDVKEEVKKLLEEAERETK

SEQ ID NO: 14703 - protein, 57 aa, Artificial Sequence
  Synthetic
DEVRKVVEDNERSVREIKEELKRVVEEDKELVDRWRERLEKVVKDNERSAKKIKDDV

SEQ ID NO: 14704 - protein, 59 aa, Artificial Sequence
  Synthetic
DEMLRRIEETIRRLDEELRRLVEEVKRRIDELNREVEKRIREVEERIKEMDKRLREAVK

SEQ ID NO: 14705 - protein, 57 aa, Artificial Sequence
  Synthetic
DEAEKVVEKDRRLIEKWKEDLKELVRRVREKVKEIKKRVADVVKENEDSVRRIEKEV

SEQ ID NO: 14706 - protein, 59 aa, Artificial Sequence
  Synthetic
DEMLRRIDRRAERLNEDVARVIDEVAKRVTRLLERLEEKLKKIRDDIKKLDEELEEAAR

SEQ ID NO: 14707 - protein, 57 aa, Artificial Sequence
  Synthetic
DEVRELVKENRRSVKENEEELKRILDEDERLIRDWKKKLEEVVRKVAELVREIEERV

SEQ ID NO: 14708 - protein, 59 aa, Artificial Sequence
  Synthetic
DELLRRVAETVKRMDEDLNRTTEEIADTIRRLNEEVAKRIREVERTVERLIEELEEAVR

SEQ ID NO: 14709 - protein, 55 aa, Artificial Sequence
  Synthetic
DEEEELEKDARRVLEELRRELERVVREAKDINRRVEELIREVRERAKRVDDELRK

SEQ ID NO: 14710 - protein, 55 aa, Artificial Sequence
  Synthetic
ERVLREVERVLRELEREADEVLKEDRELLERWKKTVKDVVKENRDSLDELAKEMK

SEQ ID NO: 14711 - protein, 55 aa, Artificial Sequence
  Synthetic
SEEERLREEAKEVLKRLREDLKRVEEDVERVDKRLRELNEDVARKLEEVLKRLRE

SEQ ID NO: 14712 - protein, 55 aa, Artificial Sequence
  Synthetic
EKVLREVKRALDDLRRRVEEVLRKNEKSLRELEEENRRVLKKVEDLLEDIIRRLK

SEQ ID NO: 14713 - protein, 60 aa, Artificial Sequence
  Synthetic
REEDEVRKELERVERRIEDLLREVERTNREVIETSERLTKTVEDDVRRVNTEIDRLLKEK

SEQ ID NO: 14714 - protein, 55 aa, Artificial Sequence
  Synthetic
EELLRELEEVLRRIEEKLKKIDDESKKLAKEDTDRNKRIVDENTRLVEEWDKRAK

SEQ ID NO: 14715 - protein, 60 aa, Artificial Sequence
  Synthetic
SVLEEVRKKVERVIRESRELSERVREHIKRTIDEVKKLTEEVRKIVETLIRRLKELLDRV

SEQ ID NO: 14716 - protein, 59 aa, Artificial Sequence
  Synthetic
DEEVRKILTDLRKAVDEDRRRNEKLLKDSEDAVRRDEKENRDILRELRKAIEEIERRLR

SEQ ID NO: 14717 - protein, 60 aa, Artificial Sequence
  Synthetic
SMVDKVREEARKLIEEARRLSEEVKKIIDELTKRVKDLTRTSHELSKRLEDTIRELLKRV

SEQ ID NO: 14718 - protein, 59 aa, Artificial Sequence
  Synthetic
DEKLREILKRLREELKRDEDRNRELLKRVRDRVKKDEEENRENTKRVREAVEKIERELE

SEQ ID NO: 14719 - protein, 60 aa, Artificial Sequence
  Synthetic
DVLEEVRRRAEEVIREARELSKRSHDRSRELIERVKKLTEESHRLSRKLIRELEERLEKV

SEQ ID NO: 14720 - protein, 59 aa, Artificial Sequence
  Synthetic
DEEVRRILKELRDEVKRDEERNRKNTKDVKDEVDKDRRTNEKNTEDAEREIRRIKEDAR

SEQ ID NO: 14721 - protein, 60 aa, Artificial Sequence
  Synthetic
SVLEDVRRDVERLRREIEELSKRSHERSRRIIERLEELLKRSHDLSKRLRERLEELLKRV

SEQ ID NO: 14722 - protein, 59 aa, Artificial Sequence
  Synthetic
DEEVRRILKKLRDDVKKDEDDNRRNTEEVRKLAKDIERKLKKNTDDVRKDIKAIEDRLR

SEQ ID NO: 14723 - protein, 60 aa, Artificial Sequence
  Synthetic
SVLEKVKELLDRLIRELEELVKTVEEIARRLITEVRELTERSHELSRRLIKELKRLLDDV

SEQ ID NO: 14724 - protein, 59 aa, Artificial Sequence
  Synthetic
DEEVRRILEEITRVLEEIATRLKRILDELRKAVDKDRKDNERNTEEVRKLIEEIKRRLK

SEQ ID NO: 14725 - protein, 59 aa, Artificial Sequence
  Synthetic
SLLDEVRRKVKEVEDRLRKLVKDSHELSRRLIEEVERLTKTSHELSRRLIEELRELLKR

SEQ ID NO: 14726 - protein, 59 aa, Artificial Sequence
  Synthetic
DKDLRDILRKLREVLEEIERRLRKNTEDVKKVVDDDRKRNKDNTDEVRKAIREIEERLR

SEQ ID NO: 14727 - protein, 57 aa, Artificial Sequence
  Synthetic
SEIERLLEEDTKRLRDWEEAIRKNLEDSEREAKKLKDRVKKLLDDARRDIDRLKKER

SEQ ID NO: 14728 - protein, 59 aa, Artificial Sequence
  Synthetic
EEILDEVRRRLKTLNDDVERLLREVHERSKKLRETVRKIVEEVEKRITELRDRVRRAAK

SEQ ID NO: 14729 - protein, 57 aa, Artificial Sequence
  Synthetic
SDIDRLLEEDKKKLDDWRRAIEKNLEDSERRAREIKERLKKLLDEVRREAERLKEER

SEQ ID NO: 14730 - protein, 59 aa, Artificial Sequence
  Synthetic
EDILREIAKRIEDLNKEVEDLLRTVHKESRRLDREVEEIVRRVKEEIDRLIREVREAAK

SEQ ID NO: 14731 - protein, 57 aa, Artificial Sequence
  Synthetic
SEVDKLLEDDRKALEEWERRITKNLEDSKREIDDIRRRLRKNLEDSRRAIKEMKDRR

SEQ ID NO: 14732 - protein, 59 aa, Artificial Sequence
  Synthetic
EEILKRIADEIKRLNDEVKKLLEEVHERSRRLIEELRRLLEEVHRRSRKLIREVEEAAR

SEQ ID NO: 14733 - protein, 60 aa, Artificial Sequence
  Synthetic
SAEEEIEERLKRAIDRDEESVKRSAEEIKRLIEELKKSVDDSARELKELIERLKKLKKDG

SEQ ID NO: 14734 - protein, 58 aa, Artificial Sequence
  Synthetic
KEIKDLLDRVKKEVERSKRKSAKLLKELEDAIKEIEDRSRELLERAREELKRVKDDKR

SEQ ID NO: 14735 - protein, 59 aa, Artificial Sequence
  Synthetic
DETKRVRDLIRELIKRDEESVRRSARTLEELIRRLEESVKRSKKLVEDVIRKLKKLVKD

SEQ ID NO: 14736 - protein, 58 aa, Artificial Sequence
  Synthetic
EEAKKLLEDVEEAVERSKRKSRKLLEDARRALEKVKRDSDKLLEDVREEVERVLRTVK

SEQ ID NO: 14737 - protein, 60 aa, Artificial Sequence
  Synthetic
DELEKIAEELDKLIRDDKKSVDESKRLLEDLIRRDRESVEESERELTELRRRLDELRRRG

SEQ ID NO: 14738 - protein, 58 aa, Artificial Sequence
  Synthetic
REIKELLKRVRELVRESKERSRAVKERLKEEVKESERRSRELLERVRRDLEKIERDTR

SEQ ID NO: 14739 - protein, 59 aa, Artificial Sequence
  Synthetic
SELERIKKELEELIERDKKSVKDTARRLEEMERRLRESVRKSEEDLRRMIEKLEKLVTD

SEQ ID NO: 14740 - protein, 58 aa, Artificial Sequence
  Synthetic
DEARKLLEDVKRLVEESKRESKRLLDEVKKVIDRLRERSEKLLRDVERALREAEERTR

SEQ ID NO: 14741 - protein, 60 aa, Artificial Sequence
  Synthetic
EEDERIRRDLEEAIRRDRKSVEDTREELRKMIEDDERSVRDSEEKLKELIKRLEELVREG

SEQ ID NO: 14742 - protein, 58 aa, Artificial Sequence
  Synthetic
DEIRELLRRVRELVKKSKDDSRKLLEDVKRELERSKEESKRLLDEVKRAIDEIRERDK

SEQ ID NO: 14743 - protein, 60 aa, Artificial Sequence
  Synthetic
SELERIEEELKKLIEDDKKSVDDTRKELDRAIEEDKRSVERSERDLRRMIKKLEDLVRRG

SEQ ID NO: 14744 - protein, 58 aa, Artificial Sequence
  Synthetic
DEIRKLLEEVKKLVEESKRTSEELLKEVDRRLRRSEDESRKLLEEAKKAVKRIEEETR

SEQ ID NO: 14745 - protein, 59 aa, Artificial Sequence
  Synthetic
DELEEIKRRLKELIDRDRESVKRTEDELRELIKRLRKSVDDSRKEAERLIRELERLVKE

SEQ ID NO: 14746 - protein, 58 aa, Artificial Sequence
  Synthetic
DEIRELLERVERALRESKERSRKLLEDVRRAIEKVERDSEKLLKDVEEALERVKRERD

SEQ ID NO: 14747 - protein, 60 aa, Artificial Sequence
  Synthetic
REEDEIRRELKELIERDERSVEETRKELEELIRELEELVKRVEDDLRRLIEKLEDLRRKG

SEQ ID NO: 14748 - protein, 58 aa, Artificial Sequence
  Synthetic
DEARKLLKEVEELLRRSKRKSEELLKRVEELLRKAREDIRRLLEEVKRVIDKVKKDTD

SEQ ID NO: 14749 - protein, 57 aa, Artificial Sequence
  Synthetic
SDVERIIRENERKAKEIKDKVRKVIEDNERSVEEIKEKAERIVREVRKTLEEIRKRI

SEQ ID NO: 14750 - protein, 59 aa, Artificial Sequence
  Synthetic
KEMVERVERLIEEVARRSEELLRRIAKLVEDVNRESERLIREIKELAREVEKELKERAD

SEQ ID NO: 14751 - protein, 57 aa, Artificial Sequence
  Synthetic
SEVDDIIRKNEELLKKIEDDARKILKENEERVEEIKERIKKLIEDDRRKLEEIKRRI

SEQ ID NO: 14752 - protein, 59 aa, Artificial Sequence
  Synthetic
EEALDRIRKLIEKVKRESEKLLEDIKRLIDKVDKDSERLLRTVKKLSEDVEKELKDTTK

SEQ ID NO: 14753 - protein, 57 aa, Artificial Sequence
  Synthetic
SEVDEIIKDNERELDEVRREVEEIDKENKERLKEWVEEAREILDRLRKDLEEIRKRV

SEQ ID NO: 14754 - protein, 59 aa, Artificial Sequence
  Synthetic
REALDRLRRLIEKVVEDSRRLIKKVDELLKKVNKEIEDLVREVKDLVRRVKEELDRRVK

SEQ ID NO: 14755 - protein, 57 aa, Artificial Sequence
  Synthetic
EEAERILKKDDDSVRKIKKEADRIVRENERLAEEIKKEVRKIIEDDKRTLEEIEKRI

SEQ ID NO: 14756 - protein, 59 aa, Artificial Sequence
  Synthetic
EEMLRRVEEDLRRVNEESERLIRRIAKEVKRVTDESKKLLEEVKRISETVIEKMKEDAR

SEQ ID NO: 14757 - protein, 57 aa, Artificial Sequence
  Synthetic
DEVEEILKRDEEALRDIEKKVREVDERNRREVEKIKEKVKEIIKRDKDELDEIRKRI

SEQ ID NO: 14758 - protein, 59 aa, Artificial Sequence
  Synthetic
EEVLKRLEEEARRVNKTSKDLLKEVEDKIRKVNRKSEELLKKVEELSRRVIEEMRRRVK

SEQ ID NO: 14759 - protein, 60 aa, Artificial Sequence
  Synthetic
RELEELIEDLRRALERSREEVTRLLKDLEDANRRSHRHNEELIKRLRKILKEARDRVKRD

SEQ ID NO: 14760 - protein, 59 aa, Artificial Sequence
  Synthetic
EEALKDLRRVVEEVKKRSTDLNREVAKVIEEVKKRSEDLNRELEKLNRDIEERIDRETR

SEQ ID NO: 14761 - protein, 61 aa, Artificial Sequence
  Synthetic
REEEEARKILERLEEELKRSLDEVRDLIEKATKESKDVNEKIRKLLEELKEELRKVVEDTG

SEQ ID NO: 14762 - protein, 55 aa, Artificial Sequence
  Synthetic
EELVKDVERKLKRVAEESRKLVEDLRRRIKESREEIKRLVEDLERVLKEIKEEAK

SEQ ID NO: 14763 - protein, 61 aa, Artificial Sequence
  Synthetic
REEEEALKRIRETSERIKRVVDDLHRRNKKSTDDIKRRVDELHKRNEKIVREVLDVIRRRG

SEQ ID NO: 14764 - protein, 56 aa, Artificial Sequence
  Synthetic
SEVLRELDRRTKELKRRADELVTENRKLSKELEDEIRRLAERNRDAIRKIDKAVKE

SEQ ID NO: 14765 - protein, 61 aa, Artificial Sequence
  Synthetic
DEEERALETIRDTSRRIEERIDDLRRRVEKIVRDIEETIRRLHEENRKIAERVKEVIERRG

SEQ ID NO: 14766 - protein, 56 aa, Artificial Sequence
  Synthetic
SEVLKELEDETRRVKERVDKIIKELEERVEDVERKVRELVKRNEELLKKIKDDADK

SEQ ID NO: 14767 - protein, 61 aa, Artificial Sequence
  Synthetic
SREEDAVRKIRKLVEDVTRETKKMLEDVRRLVETVEKLTDDLLEEVRRLVEEVEDEIRRAG

SEQ ID NO: 14768 - protein, 56 aa, Artificial Sequence
  Synthetic
SELLREVEDLLRRHHETVRRILDEIRRLIERHHRRVREILKELDKLVKDAADEVRR

SEQ ID NO: 14769 - protein, 60 aa, Artificial Sequence
  Synthetic
SEVERVEEEVKRLATEVEKSNRDSLREIEDLNRRDRDISRRVKEEIERLIREVKKLIDDR

SEQ ID NO: 14770 - protein, 60 aa, Artificial Sequence
  Synthetic
EKKVKELLERAKKIADELRKHIKRTLKKVEEEVEKNKRDNDKLLEEARELIKRLDDEVRR

SEQ ID NO: 14771 - protein, 60 aa, Artificial Sequence
  Synthetic
DDLERVRKEIEDLNREDKRRSEEVRREVKKLIEDLEDSNRRSLEEVDRLVETVRELIDRE

SEQ ID NO: 14772 - protein, 60 aa, Artificial Sequence
  Synthetic
KEKVKRLLRTVRELMKKNKRDNDRLLKEAEDEARRVKRHIKESLKRIEEEIRRLKERLER

SEQ ID NO: 14773 - protein, 60 aa, Artificial Sequence
  Synthetic
DELEKVAEDIKKLNKEDRDRSDEVRRAVKELVKEVEKKDKDIKRRAEELIREIKEDIERR

SEQ ID NO: 14774 - protein, 60 aa, Artificial Sequence
  Synthetic
REKVRKLLEDVEREARKNEEDNRKLLKDIREEIRRLADRSRKTLEDAKRLIEKIERDLEK

SEQ ID NO: 14775 - protein, 57 aa, Artificial Sequence
  Synthetic
SEVEEVLKEIEEMLRDLERRVKESDEENRDSLRKIREDVERVDEENRDTLRRIKEKV

SEQ ID NO: 14776 - protein, 55 aa, Artificial Sequence
  Synthetic
EKVMKEVRDVIARLRDELEKVTEDSRRVNKELKKRLEDVVREIRRANEELDERVR

SEQ ID NO: 14777 - protein, 57 aa, Artificial Sequence
  Synthetic
DEVEKVLEEIKRALDDLRKKVEESKREIKEALKRVEKHTRDSDTDNKRTLREIEERV

SEQ ID NO: 14778 - protein, 55 aa, Artificial Sequence
  Synthetic
ERVVEEVRRVLEELRRRLEKVTEDSRRAIERLEREDRRVSKKSKDVNKKLDDDVR

SEQ ID NO: 14779 - protein, 55 aa, Artificial Sequence
  Synthetic
DSARKVEREVEEAARRVERTLEDVTRKVRELHDEVRRRLEEVKRRIEDLHRRVDE

SEQ ID NO: 14780 - protein, 59 aa, Artificial Sequence
  Synthetic
KDTVKRVLDDVARIVKRIEEDIKRVLEESKKLVRDIEKEIRDVKKESRDLVREIREKIR

SEQ ID NO: 14781 - protein, 56 aa, Artificial Sequence
  Synthetic
SSAEEVKRELEERHRDLRRTDEELRKDLDRVHDRARKILEEIEKKIRDMHRKVKER

SEQ ID NO: 14782 - protein, 59 aa, Artificial Sequence
  Synthetic
ERKVKKVRDESNKVVEEIMRHSDKVLERSRRLVEEIRRRLEEVLRTSREVVRRIRDEVR

SEQ ID NO: 14783 - protein, 55 aa, Artificial Sequence
  Synthetic
REVEEVLKEIEEMLKRIEDDVRRVLEEIKDVARRNEDEVRKLLRENEESVEEIKR

SEQ ID NO: 14784 - protein, 55 aa, Artificial Sequence
  Synthetic
RKVVEEVRKLLTDLKRLLEEVVKEVRKRLKELHDRTRTVAEEIRDINKKLKEEVN

SEQ ID NO: 14785 - protein, 60 aa, Artificial Sequence
  Synthetic
SSVDEVRRTIEELIRRVEELVKRSKDHVDETERRVKELVRRSHELTKEVIERVEELLRRL

SEQ ID NO: 14786 - protein, 59 aa, Artificial Sequence
  Synthetic
EDKVRKLVEDLRRALEKIRREIEKSTEESDRVLRRIEEEIRRDSEELKRALREAEEEVR

SEQ ID NO: 14787 - protein, 58 aa, Artificial Sequence
  Synthetic
SEVEELLKEVERLVREVEERVRRLHETDRKLLEDVKRKVEELHREDKKLADEVREAVK

SEQ ID NO: 14788 - protein, 58 aa, Artificial Sequence
  Synthetic
EDVERLRRELEKVAEKIRRLVEANRKTVEDARREIEKLLEENRRELDKVRRDVEREAK

SEQ ID NO: 14789 - protein, 62 aa, Artificial Sequence
  Synthetic
KEVDDLLKEVRRLVREVEKELKRLHDENRKSSEEIARRLEELHKESKELVERVKETLRDLRK

SEQ ID NO: 14790 - protein, 59 aa, Artificial Sequence
  Synthetic
EKVVRDLEREVREALRRLEEILRRDEDDVRRSREELKRIIDENREEVKRVLRELEETLR

SEQ ID NO: 14791 - protein, 60 aa, Artificial Sequence
  Synthetic
SEVDELVERNERLVDEVRRRVEDVARKLEKVSRDSDDLVRRSNEELEDRLRKVEKRVREE

SEQ ID NO: 14792 - protein, 59 aa, Artificial Sequence
  Synthetic
KKKLDEIRERSKRANDTLRKLLEDIRKRVEDSIRRLDELLKRSETRVRDIIKKLEDELR

SEQ ID NO: 14793 - protein, 60 aa, Artificial Sequence
  Synthetic
DEVDELERRNERLAEDVRRKVREVEERLKELSKRSMDIVKDVLRRLKELVDRVEKKVREK

SEQ ID NO: 14794 - protein, 59 aa, Artificial Sequence
  Synthetic
EKKVEEIREKSERVNRDLEDKLRKIEEKVKESEKRLRDLLREIEERIKRAIEKLERDLK

SEQ ID NO: 14795 - protein, 60 aa, Artificial Sequence
  Synthetic
SKVEELTERLRRLSKRSEEEVEKSNKDNDELVRRVLKRVKEVMRELEKLVEKVKEDVRRE

SEQ ID NO: 14796 - protein, 59 aa, Artificial Sequence
  Synthetic
KETLDRIRKEVEDSIERLKKLLDDSRRRSKEANDALRKLLKEIEDTIRRAIEELERARR

SEQ ID NO: 14797 - protein, 60 aa, Artificial Sequence
  Synthetic
SRVEELTEENRRLAKRLKEVVKKVLDELRRRVEEVKERVERSNKKLRDLVREVDERVATK

SEQ ID NO: 14798 - protein, 59 aa, Artificial Sequence
  Synthetic
EEIVRRIEEESKKVNRELEELLRKIEDDIRKAEEELRELVERSKREVDKALDDIDRRTR

SEQ ID NO: 14799 - protein, 61 aa, Artificial Sequence
  Synthetic
KEVDDVKKELDDVDREVKELIKRAHDKNRKVVKEVEDELRRLTEDDKRVADKVRELLKKVR

SEQ ID NO: 14800 - protein, 59 aa, Artificial Sequence
  Synthetic
KDKMKEVEDEVRKVLDTIRKLLKRDEEAVKEALDKVKKMLDDARRHSEKVLREVEDTLR

SEQ ID NO: 14801 - protein, 56 aa, Artificial Sequence
  Synthetic
SEVEELLKEVRELARRIEEEIKKLHRRNEELARRIKETIKRLIDENRKLAEDVRRD

SEQ ID NO: 14802 - protein, 58 aa, Artificial Sequence
  Synthetic
EDAKRIRDELERVRKSIEKLIRDNERFLEKVERDIRKLIEENEDLLRKIKEDVERKEK

SEQ ID NO: 14803 - protein, 56 aa, Artificial Sequence
  Synthetic
DEVRELLETVRKLAEDVERRIRELIKENERLAREVERRIKELHDRNRELAREVEEK

SEQ ID NO: 14804 - protein, 58 aa, Artificial Sequence
  Synthetic
KEAREIERELEKVKDTIRRLLERNEELLEEIARRITKLLEEDKELLERIERRIAEKLK

SEQ ID NO: 14805 - protein, 60 aa, Artificial Sequence
  Synthetic
SEVETLLRELKRLAEEVKKRIEELDRELKKLSDDVRREIERLIRENERLAREVLKEIRDL

SEQ ID NO: 14806 - protein, 59 aa, Artificial Sequence
  Synthetic
EEALREIEKLLRKVEEDVRRLIEKLKKSLEDSARDVDRLVKENERILEEVAREVEKLLR

SEQ ID NO: 14807 - protein, 60 aa, Artificial Sequence
  Synthetic
KEVEDLLRDLKRIVDEVEKRIRKLIEDNKRLADEVRERIERLHKRNKDLAEEVLKRVREL

SEQ ID NO: 14808 - protein, 59 aa, Artificial Sequence
  Synthetic
KEVVKRIKEELDRVREEVKKLIKRNEELLKKVAEDVRRLLEKDKKALEEIKRRVEDELR

SEQ ID NO: 14809 - protein, 56 aa, Artificial Sequence
  Synthetic
DELEELRKRVKENEDEVEKVLRELHKLNEENKEEVDRALEELRKRVRDIEEEIKKE

SEQ ID NO: 14810 - protein, 60 aa, Artificial Sequence
  Synthetic
RKDVVDKVRKVIEEVHKRSRDLAKEAREVNRRVHETTKKLVEDVRRVIEKVEEDVRRKVK

SEQ ID NO: 14811 - protein, 56 aa, Artificial Sequence
  Synthetic
SSLEEADKKVDKNRRDVDRALEELHRRNKRNEEEIRKALKENRETNKRLLEEIRKN

SEQ ID NO: 14812 - protein, 60 aa, Artificial Sequence
  Synthetic
REDAVRRVDKVIKEVHDESKRLVDELRDRNRRVHDETRRLDEESKKINRTVEELIRRKET

SEQ ID NO: 14813 - protein, 61 aa, Artificial Sequence
  Synthetic
DKVEELLKRLEESTRRILKRVEELLRENERLAREVRKTVERLLEENRRLIEEVERRVRRDK

SEQ ID NO: 14814 - protein, 59 aa, Artificial Sequence
  Synthetic
EKLRRELRRLLRESEKKIKEMLDRNKELLDEIERTIRELLKRNEDLLREVRERAKEADK

SEQ ID NO: 14815 - protein, 60 aa, Artificial Sequence
  Synthetic
DEAEDLLRKLKRSTDEIKKTVEKLLRENEKTSRDIEREVRELLRRNKELAERVEEVARRE

SEQ ID NO: 14816 - protein, 59 aa, Artificial Sequence
  Synthetic
EKVRRELERLLRESEKEIRKLLKRNKELLDESRDTIREMLERNKRLLEEVRKKIEKMKE

SEQ ID NO: 14817 - protein, 61 aa, Artificial Sequence
  Synthetic
SEAERLLEELKRSTDEIKKRVEKLLEDNKRTSEEIEEEVRRLLETNRKLIEDVKRKVERDR

SEQ ID NO: 14818 - protein, 59 aa, Artificial Sequence
  Synthetic
ERVRRELEKLLRDSERKIKEMLERNEKLARDSEERIRRMDDKNKDLLRRVKETIERKLK

SEQ ID NO: 14819 - protein, 61 aa, Artificial Sequence
  Synthetic
DEVEDLLRKLEESTRRILERVKKLLEDNKRLIDRVRKEVERLLRDLKRLAKEIDEEVRRDN

SEQ ID NO: 14820 - protein, 59 aa, Artificial Sequence
  Synthetic
ERVIRELEELLKESKKRIDDALRENEKLLREVKRRIEEAERTIKELLEEIKRKIAEEEK

SEQ ID NO: 14821 - protein, 60 aa, Artificial Sequence
  Synthetic
KEAEELKRRLEDLVRRVEEDNRRLLEEHKKLVKDVRKRAKELLETHKKLVEDVTREVRKS

SEQ ID NO: 14822 - protein, 59 aa, Artificial Sequence
  Synthetic
REVLEDLKRDLERARKINEESEKRIKDSDKRVHEEIRRVLEEVKKSDEEVRRRADRERE

SEQ ID NO: 14823 - protein, 60 aa, Artificial Sequence
  Synthetic
REVDELRKELERIVKEVEDVIRDLNKKLKDILKDVKDKSDELNERLKKIVEDVRRLIRDV

SEQ ID NO: 14824 - protein, 59 aa, Artificial Sequence
  Synthetic
DKMVEELERLLDEARRRVEEAIRSNEELLKRIEEESERTVRSNEKLLKEAEEEVRRAEE

SEQ ID NO: 14825 - protein, 61 aa, Artificial Sequence
  Synthetic
DEVEDVERDLKRILKEVKDRSDELIERNRKSTEDMKRRSKELNEELRRIIEDIRRLIRDTK

SEQ ID NO: 14826 - protein, 59 aa, Artificial Sequence
  Synthetic
SKMVERLERLLEEAERTSRETLKRLEDTLRESEKRSRETVRSNEELVKEVTKEVEDAKK

SEQ ID NO: 14827 - protein, 60 aa, Artificial Sequence
  Synthetic
DEVETVLRDNERTTKEAEDDVRRLNEELKEIIKRVREVSKRLIDELRRILEDVERRAREV

SEQ ID NO: 14828 - protein, 59 aa, Artificial Sequence
  Synthetic
SDFVERLRRTLEESKDKARRNVESNRELLERARKDSKRTLEELERLLETVRKSVDEMKK

SEQ ID NO: 14829 - protein, 61 aa, Artificial Sequence
  Synthetic
EREERLEEKLKKSVDDSRELIERVLRKHEKVSDKVRRELERILEDHKRVLEEIKRVLKDRR

SEQ ID NO: 14830 - protein, 55 aa, Artificial Sequence
  Synthetic
ERLKDLLDKAHEEDRRAKEEVKRLLEDTTKKIKEFLDRVERSNEEVERELEKAER

SEQ ID NO: 14831 - protein, 60 aa, Artificial Sequence
  Synthetic
DKDRKIKRIIEEVKKTIRKLLDDVRRINEEVLKELRKLLREVEEINKEILRRLKELVKTS

SEQ ID NO: 14832 - protein, 59 aa, Artificial Sequence
  Synthetic
EKVKKELDDEIRDAERELREAKKDMDRSNEELREEIKRAEERLRRLDEKLREEVEKDRK

SEQ ID NO: 14833 - protein, 60 aa, Artificial Sequence
  Synthetic
SVKEEIKEMLKKIKRHSDEALKKNKETLDRDRKRVEDVIRELKKLLDEIRKRVEDVRRRV

SEQ ID NO: 14834 - protein, 59 aa, Artificial Sequence
  Synthetic
EEIARKVRELLERVLRDDRRVVREVEELNRRMHKKNEEVAKKVRDLLREVRKELEDVDR

SEQ ID NO: 14835 - protein, 63 aa, Artificial Sequence
  Synthetic
REAEELLKELDEIIRRVEEEVKRLLDKVRETTKRIEEEIRKLDEDLKEIIREVEERIRKLKSD

SEQ ID NO: 14836 - protein, 59 aa, Artificial Sequence
  Synthetic
EEVERRIKRLREKVKKKIDELKERVRRLLEESRRKAERVEESNRDLLRELKERLEERRR

SEQ ID NO: 14837 - protein, 60 aa, Artificial Sequence
  Synthetic
SFEEEIKKIADEVEKRIRDAEKRSKDILEKSREVVERAKRRSEKLLRDAEREIKRVMEEK

SEQ ID NO: 14838 - protein, 55 aa, Artificial Sequence
  Synthetic
DEMLRRLKKVTDDVRKRLEDSHRRLEKVTEESRKRADESHEELRKLIEEVREKLK

SEQ ID NO: 14839 - protein, 58 aa, Artificial Sequence
  Synthetic
SSKERIEKILREVKREIEEAEKRSRDILKDSERIMRDVKRTTDDLLRKAEEIIREVAK

SEQ ID NO: 14840 - protein, 55 aa, Artificial Sequence
  Synthetic
EEVLKRLRELIDTVRRVLEESHKRLRELTKRSEEEARRVNEELRELIDRVRREAE

SEQ ID NO: 14841 - protein, 60 aa, Artificial Sequence
  Synthetic
DVEKRIEELRERSDRIIDEARKRSEKLLRESEKMMRDVDKTTEDILREAEEEIKRVLDEK

SEQ ID NO: 14842 - protein, 55 aa, Artificial Sequence
  Synthetic
ERVLKDLERLSKESEDELRRSHEELKRLTEESRETIEDVNRKIKEKIEDVKRKLK

SEQ ID NO: 14843 - protein, 60 aa, Artificial Sequence
  Synthetic
SAEDSIRELLERDERLLEEARKEAKRLNEENERLLERIEETVRRLLEEIKRLLDDIRKKI

SEQ ID NO: 14844 - protein, 59 aa, Artificial Sequence
  Synthetic
EELVKRVEERIKRLHDENRRLVKEVIEEVEKLIRDNEKLAEDIEREIRRLLKELDEAAK

SEQ ID NO: 14845 - protein, 60 aa, Artificial Sequence
  Synthetic
SEVEEIVKEIEKLIKENEEVVREVEKEIRELIKRNREVVERIRKELEKMLRELERLAREG

SEQ ID NO: 14846 - protein, 58 aa, Artificial Sequence
  Synthetic
EARERIKELVRRNERLLREVEKRLKTLSEENKKLLEDAKRELDRILKEVRDLLRETER

SEQ ID NO: 14847 - protein, 59 aa, Artificial Sequence
  Synthetic
SRVERLSAEIKKLIDENRRVAEELLRELEKLLKDNEDVVREVERRIRDSSRKLEELARA

SEQ ID NO: 14848 - protein, 58 aa, Artificial Sequence
  Synthetic
EAREDMDRLVRENERLLKKVEDDLRKLSEENKRLVDRARERLARLLEENERLVDERRK

SEQ ID NO: 14849 - protein, 56 aa, Artificial Sequence
  Synthetic
REAEEALKRVKEILKRIAEEVERVLTEVKKLSEDVKRRVEEVLTRLKRSTEEIERK

SEQ ID NO: 14850 - protein, 56 aa, Artificial Sequence
  Synthetic
KKLVEDVDREIKKLLEEVTKKAKRLNDENKRLLDDVRDKARRVIEESREVLERARK

SEQ ID NO: 14851 - protein, 59 aa, Artificial Sequence
  Synthetic
SSEEEVEKLERKVRAVIRKAEEDLEDSLRKSEKMAKEVTDEIEKSRRKAKAVIDDARRR

SEQ ID NO: 14852 - protein, 55 aa, Artificial Sequence
  Synthetic
EEVLKKVEELIRKVEKVIRTVLEEDRKVSEDSLRKMRKVLKEDEDVIKEVRDRAQ

SEQ ID NO: 14853 - protein, 59 aa, Artificial Sequence
  Synthetic
SMKEEVDRLLKEVKDVIREVRERIKKSEEDVRRVIDDARRKLEELSKRAREVVEEVRRR

SEQ ID NO: 14854 - protein, 55 aa, Artificial Sequence
  Synthetic
EEVLKRVKELIDEVRERIEKVLTDDRRLIERVKREIERVIRENEKVIRDARERLR

SEQ ID NO: 14855 - protein, 60 aa, Artificial Sequence
  Synthetic
DEVEKLLRDLEELDRDIERKVRELLKRNKEVLDDIEREVRRLEKELRRIIKEVADVIRKT

SEQ ID NO: 14856 - protein, 56 aa, Artificial Sequence
  Synthetic
KKEVDKIEKHSRDLIERAKRETDRLLEEAERLMREVVDRVRKILEEAKRLIDEARR

SEQ ID NO: 14857 - protein, 60 aa, Artificial Sequence
  Synthetic
DVEDEARRLEKELRDILREIADDIRKLLEENKELLKESEKDIRRAEKAIEDILDDVRKRI

SEQ ID NO: 14858 - protein, 59 aa, Artificial Sequence
  Synthetic
EKLLTEVSEEVKRLADELRELARRVKEEVKKLLDDNRETTDRIRRTVTELLEELKRKTK

SEQ ID NO: 14859 - protein, 60 aa, Artificial Sequence
  Synthetic
SVDETITEVIKRIEDTLRKVKEDADRLDERNKALLEDSKKKIKEVEEELRRILEEVRRKV

SEQ ID NO: 14860 - protein, 59 aa, Artificial Sequence
  Synthetic
RELVEEVKERAERLLKELEDLIKKVKEEVERLLEENRKTTEDILKRAKDLARELRKRTK

SEQ ID NO: 14861 - protein, 60 aa, Artificial Sequence
  Synthetic
DAKESIEEVKKRLEKSLEDSERESRKTLEENKDLLRRSREEIKKALDRLKDLLRRAEERI

SEQ ID NO: 14862 - protein, 59 aa, Artificial Sequence
  Synthetic
EKLVEEVEREVERLLRENEKTSDEIKKTSEELLKRNEETTRRILEEVERLLKRVKEATD

SEQ ID NO: 14863 - protein, 60 aa, Artificial Sequence
  Synthetic
KVEETATRLREEVKRSDTEVHRENRESEDRNKKSDEEVHKTIRDALKRVKDKLDDVRRRR

SEQ ID NO: 14864 - protein, 59 aa, Artificial Sequence
  Synthetic
DEIVRRVKEEVERLLEEHRRLAKRVRDENRRSTEEHRDLVRKVKREIERLEEELDRAEK

SEQ ID NO: 14865 - protein, 60 aa, Artificial Sequence
  Synthetic
KVEESADRARREVKRSDEEVRKRNTDSREEIKKSDKEVHERIRELLERIRRILDEVRKKR

SEQ ID NO: 14866 - protein, 59 aa, Artificial Sequence
  Synthetic
DEIVRRVEDEIEKLLREHRELVKDVERENRRLLEEHKKLVEEVEREVRRMMKKLRDATK

SEQ ID NO: 14867 - protein, 60 aa, Artificial Sequence
  Synthetic
KVEEEIEKLLRHNDELLKEVEKRAREVEERIKRSDEAVHDSIRKLLEDVKRILDEARRRR

SEQ ID NO: 14868 - protein, 59 aa, Artificial Sequence
  Synthetic
DEIVERVEREVRKLDDDDRRLAERVLRRAEELLKRHKELVERVEREVERLLKELEDAVK

SEQ ID NO: 14869 - protein, 60 aa, Artificial Sequence
  Synthetic
KAEDEARRLERHNKELLKEVRKDNTRSEREIEESDKRAHDEIKRLEEEVEEILKDIERRR

SEQ ID NO: 14870 - protein, 59 aa, Artificial Sequence
  Synthetic
DEIVERVRRTVKKLDEDDDKLVKDVRKENKDLLRRHEELVREVTERVKKLLRDLREASR

SEQ ID NO: 14871 - protein, 60 aa, Artificial Sequence
  Synthetic
DVEDEVRRAEESNRDSDRKVHEEVRRVLKSNRDSDTKAHRDVEEAKRRLKTELKDIERKR

SEQ ID NO: 14872 - protein, 59 aa, Artificial Sequence
  Synthetic
KRLVDKVRTEIKRLNDEHRKVLKKVRDLVRKLNEDHERVVRDVRREIKRLRDELRETAR

SEQ ID NO: 14873 - protein, 60 aa, Artificial Sequence
  Synthetic
DVEDEVRKMKKELDELLKRAEEEVKRVLESNEKSDDEVHKRAREAEEELRRLLDDVRRRR

SEQ ID NO: 14874 - protein, 59 aa, Artificial Sequence
  Synthetic
KKVVKDVEKKIRDLLTKLREVLRRVRREVKKLNERHEDILREVERLIEELRKRLEDTTK

SEQ ID NO: 14875 - protein, 60 aa, Artificial Sequence
  Synthetic
DIEDEVREAIERLKKLLEDSEREVRESIKRLRDLLREIARESEEANERIKRLLEEIERKV

SEQ ID NO: 14876 - protein, 59 aa, Artificial Sequence
  Synthetic
EDVRRRLRELVEKVMREIEDSNRKLRKLSKDSEKAVRDAERRNRKLVREIEDRIRKSLK

SEQ ID NO: 14877 - protein, 60 aa, Artificial Sequence
  Synthetic
EVDKEVRKVLKDIERLLEEIERRVRKSIEDLKTELKKIEDESEKANRELERLLREIKDRV

SEQ ID NO: 14878 - protein, 59 aa, Artificial Sequence
  Synthetic
EDVRRELRELVDKVRKDVERVMKALEDLSRESRREVRRVKEKNRRLVEEVKKRVEDKAK

SEQ ID NO: 14879 - protein, 59 aa, Artificial Sequence
  Synthetic
SEDEDMVRDVKRLIDEVRKLIERVKREVEDLIRRLNELDERVVRTSEELARDVKRLVDA

SEQ ID NO: 14880 - protein, 56 aa, Artificial Sequence
  Synthetic
SEDVERLKEEIKELLDRARRTIEELERRIRENVKRSRKKIEDLVRRHKKILDEARK

SEQ ID NO: 14881 - protein, 59 aa, Artificial Sequence
  Synthetic
REKEEAVKTVKELIKEVREMVERLHRKNEEMIRTVREVVKELNERNKELIKTVRDLRRR

SEQ ID NO: 14882 - protein, 56 aa, Artificial Sequence
  Synthetic
SEDARRLEREVRELLRDVREKVERNKEKVERLKREVRKRVRDDLERVKRLKEEVDT

SEQ ID NO: 14883 - protein, 59 aa, Artificial Sequence
  Synthetic
SEDERAVREVEKLIKRVEEVVRRLNERNRRLIEEVRRIVEELHRRNEDLIRKVRELAER

SEQ ID NO: 14884 - protein, 56 aa, Artificial Sequence
  Synthetic
SREMERLEREVERLLREVERRVKEDEERVRKLLEEVERLVRRNARKVEELLKEVEK

SEQ ID NO: 14885 - protein, 63 aa, Artificial Sequence
  Synthetic
SEKEKLTEDIERIIDKVRREVERLNEENERLIREVRKRVEKLNRENKEAIKRVEEEVRRLRDR

SEQ ID NO: 14886 - protein, 56 aa, Artificial Sequence
  Synthetic
EELVKRLEEKIRELLKRARDLVKEDEDRIRKLLEEIERVNRDDKRKIDKLLEEVRR

SEQ ID NO: 14887 - protein, 60 aa, Artificial Sequence
  Synthetic
KSDEEVRERVERLLREVRRLTREVRRHAKETLDTVAELVDRVRREAERLLREVEELLRRL

SEQ ID NO: 14888 - protein, 56 aa, Artificial Sequence
  Synthetic
ETEVRDVKRKADEIKEEDKRILEEAEKRHKELLEDLKRLLDRIKEEVKRVREDIKT

SEQ ID NO: 14889 - protein, 59 aa, Artificial Sequence
  Synthetic
REEDEARKRLKELLDRITKLSKEVRDLIREMLRELEESIERTKREIDDLLRRLEEIRRA

SEQ ID NO: 14890 - protein, 56 aa, Artificial Sequence
  Synthetic
SDEVERVKREIEEHLRRSEEDIRRVAEEIKKLVEESRRVIEEAKDRVRRLVERVKK

SEQ ID NO: 14891 - protein, 60 aa, Artificial Sequence
  Synthetic
SEEDDARRKVEELLRRDKKVVDEVRDELRKLLEELRRLSEEVEKLIRKLEKELREVRKRG

SEQ ID NO: 14892 - protein, 55 aa, Artificial Sequence
  Synthetic
ETVKKVEDEVRDSLRRAKKIIEDAARAIRKHLEESKRRIEEARKRLEELLKEAED

SEQ ID NO: 14893 - protein, 59 aa, Artificial Sequence
  Synthetic
SREEEAKKEVKRLLDELKKLSDDSRKRIRESHERLKRVIEEVRREAERSHEELERVIRR

SEQ ID NO: 14894 - protein, 56 aa, Artificial Sequence
  Synthetic
EKDVRKVDRDVDEILKRSEDIIRKVKEDSERLLKEVRERIEEMKKRTDDLLKEAEK

SEQ ID NO: 14895 - protein, 60 aa, Artificial Sequence
  Synthetic
RKEETLKRAEEKSKETLERNKRLLERIEEESRKTLEKNKDMLRRVKKRVEDLLREIKRDK

SEQ ID NO: 14896 - protein, 56 aa, Artificial Sequence
  Synthetic
EEELRRVIEDVLRESEKLHREDEELARRVLEESERLHREDEELARRVEKEIRELKK

SEQ ID NO: 14897 - protein, 56 aa, Artificial Sequence
  Synthetic
SLDELAKKAKEDSERSVRTDEKRLEEIARRIKELIKENEDLLREVKKEIDRLIEEI

SEQ ID NO: 14898 - protein, 56 aa, Artificial Sequence
  Synthetic
EEEARKLLEDIKRRSEELHKRNDELAREVEKRIRKLIKENRELAEEVRRRIEELRR

SEQ ID NO: 14899 - protein, 56 aa, Artificial Sequence
  Synthetic
RTDETVKKIEEDSRRSLEEDRKELEEVERRSRESIKENERLLREVAERIKRLIEEI

SEQ ID NO: 14900 - protein, 56 aa, Artificial Sequence
  Synthetic
EKTLKELADRIKERSEELHRRNEKLAREVLERSKELIKRNEELARRVIEEIKKLKK

SEQ ID NO: 14901 - protein, 60 aa, Artificial Sequence
  Synthetic
DVEETLKTVEDESRKTIETLRRSLRKSEEESKRSIDRLRESLERSREEVERLLREIERDK

SEQ ID NO: 14902 - protein, 59 aa, Artificial Sequence
  Synthetic
EEAVEKLKKLAEDVRRESEELRRELEELSKDVRRVSEELERRLRKLSEEVKKRIKDLKR

SEQ ID NO: 14903 - protein, 60 aa, Artificial Sequence
  Synthetic
SVEKILRDVEDTSRRTIEELKRSLEESKKTVTKLLEENKDLLRRIKEDVRRRLEEIKRDK

SEQ ID NO: 14904 - protein, 59 aa, Artificial Sequence
  Synthetic
EEAVERLKELAEEVKRVSKELLEELRKISEEIERRIRRLIEENKELADRVREEIERLKK

SEQ ID NO: 14905 - protein, 61 aa, Artificial Sequence
  Synthetic
DKVDRVIEEARRILERLRKRVTDVVRELEEINRRLKREVDESVKEVDEILKKLEERVRKRK

SEQ ID NO: 14906 - protein, 56 aa, Artificial Sequence
  Synthetic
KELVEKLDREVKRLLKEARELSEENRRRSKKLLDELRKSSERIREKVEDLVRRIRK

SEQ ID NO: 14907 - protein, 59 aa, Artificial Sequence
  Synthetic
SEEEAAKRRIDELLKRLKEVSDKVKEDIDELLKDLERRSREVVEEIKKLLEEVKDRVRK

SEQ ID NO: 14908 - protein, 56 aa, Artificial Sequence
  Synthetic
SERLKRVTEEAKRLHEENKKLLDDVRREARRLNEDNRRLLDEVRKRVEEVLRRIRK

SEQ ID NO: 14909 - protein, 61 aa, Artificial Sequence
  Synthetic
DEDRRALEEVRRVLEEDKRVSKRSRDLIEKVLREVEELIKEVTKRAEDVLRRVREIIKTSG

SEQ ID NO: 14910 - protein, 56 aa, Artificial Sequence
  Synthetic
RELVKKVEDEIKESEDESEDLIRRADEAVKRLRKRVRDVIEKARRDLEKIVTDAKK

SEQ ID NO: 14911 - protein, 59 aa, Artificial Sequence
  Synthetic
SIEKLIEDVRREVERIEEESKKLVKKAREDVKRSHDHSKRLMEEATRRVRDILRRAEEM

SEQ ID NO: 14912 - protein, 59 aa, Artificial Sequence
  Synthetic
KELVDDARRRVEELLRRLEDSLRKSERLVRELLKRSKEVDDRIREEVKRLLEELDDRRR

SEQ ID NO: 14913 - protein, 60 aa, Artificial Sequence
  Synthetic
DTEEILKRIEEEIRRLLEENEKLLRDAEDTVRKSLEEHERILDEVTKRIRKMLEEIARTD

SEQ ID NO: 14914 - protein, 56 aa, Artificial Sequence
  Synthetic
DETLKRLAEEVLREVERLLRENERLIREVERRADKTVKDLEKLIEEVERRIDELKK

SEQ ID NO: 14915 - protein, 60 aa, Artificial Sequence
  Synthetic
DSKEIIDKVREDIKRADEENKRLLEEVRDRIRKLLEENETLLKDSERKARELLEELRRKD

SEQ ID NO: 14916 - protein, 56 aa, Artificial Sequence
  Synthetic
EEDLKRLAKEVKDRIRELLERNRELIKEVEKRVRRLLDENRKSSEEIRKEVEDRKR

SEQ ID NO: 14917 - protein, 60 aa, Artificial Sequence
  Synthetic
SDEERALKLVEDVIRDVKRLNKRDRELIEKVERDIEKLLEDHRRLVDEVRRRVKELEDKV

SEQ ID NO: 14918 - protein, 56 aa, Artificial Sequence
  Synthetic
SELLKEVEERIKKLLKSNKDLLREVEERVRRALERVKRSDEEVHKMARDALRRVRK

SEQ ID NO: 14919 - protein, 60 aa, Artificial Sequence
  Synthetic
SEDEDAERLVEEVIRRVKELLDTHKRLVEEVERKIRELDKKDAELVKEVEKRAEDLRRKV

SEQ ID NO: 14920 - protein, 56 aa, Artificial Sequence
  Synthetic
SELLERAEREIRRLLREVKESDKEVHRRVRRMLEHNKDLLRRARDSIKKVLDEIRR

SEQ ID NO: 14921 - protein, 60 aa, Artificial Sequence
  Synthetic
SEREDAERVIERVEREIRELNRRDEELIRRVEKEIRRMLEEHKTLVKEVTRELDRLRREV

SEQ ID NO: 14922 - protein, 56 aa, Artificial Sequence
  Synthetic
SEDLKRVDKKVRDVLRSNKELLDEARKRITKVLEEVRRSDEEVKRRAEKVLDEVRK

SEQ ID NO: 14923 - protein, 60 aa, Artificial Sequence
  Synthetic
SEEEDAERAVREAAELAKKANKEDEELARRAAELAKKALREHEELVERAARLADEAEKKA

SEQ ID NO: 14924 - protein, 56 aa, Artificial Sequence
  Synthetic
SERAKKAEDDARKAAEDNRRLAKRAKEEARRAAEEVKKSDKEAEERARRAAERVRR

SEQ ID NO: 14925 - protein, 56 aa, Artificial Sequence
  Synthetic
SLERLLEEVTRRSEETVRTNEEILRRAADEVRKAIESNKDLLRKIKKEVDDVKRRL

SEQ ID NO: 14926 - protein, 56 aa, Artificial Sequence
  Synthetic
EESVRTIIEEVERTSREMNERLKKIIDEVRRTIEELNKDLKRILEEIRELVKRLET

SEQ ID NO: 14927 - protein, 56 aa, Artificial Sequence
  Synthetic
SLEETLEEVDRKSKETVKRLKELLDRIRERVEEAIKSNEDILRRIKAEAEEAERRL

SEQ ID NO: 14928 - protein, 56 aa, Artificial Sequence
  Synthetic
ESEVERIIRELERVSRELMELLKKILEEVRKRIKELNDRLEEILRRVRKRIRELEQ

SEQ ID NO: 14929 - protein, 56 aa, Artificial Sequence
  Synthetic
SLEELLERIKRDSDRTVRELEELLERAEEISRRTEKSNEDSLRRSTKEVKEAEDRL

SEQ ID NO: 14930 - protein, 56 aa, Artificial Sequence
  Synthetic
EEVVKKMLDELRDRSEKLLRTLRDIIRRAKERSDDLNRKNKESTEKVREDIRRLEQ

SEQ ID NO: 14931 - protein, 56 aa, Artificial Sequence
  Synthetic
KLEELLKRIAEESKKTVEELEKLLEEVERISKKTVEELEDSLRRSEEDAKEAEERL

SEQ ID NO: 14932 - protein, 56 aa, Artificial Sequence
  Synthetic
EDDVRRILEEVRRLSEELKTRLRKILEDLRRLSEKLKRENEESTKTVRKVIEDLER

SEQ ID NO: 14933 - protein, 56 aa, Artificial Sequence
  Synthetic
SLEELLKRIKERSEETVKRLEDLLKRVREDIDRAIKELKKSLDDSRKTVEDIEREI

SEQ ID NO: 14934 - protein, 56 aa, Artificial Sequence
  Synthetic
EEKVKEIAEEVRRRSEKMLEELKKLVDEVRKRLEDLRKRNEDSTEEMKKRVEEEKR

SEQ ID NO: 14935 - protein, 57 aa, Artificial Sequence
  Synthetic
SEVEKVIKDNKRSVDEIRKTLKRVLERNEKTLRENEKKIRDIIAEVDKRLKDLEREI

SEQ ID NO: 14936 - protein, 59 aa, Artificial Sequence
  Synthetic
DKAIKEIEEEVRRVDDRVRKLVEKLDRDIKEVDDRSRKLTDDLRRKVEEVLRRIKETVT

SEQ ID NO: 14937 - protein, 55 aa, Artificial Sequence
  Synthetic
REVEEIEKELRKIIRDLKELLRELRERLEKLDRDLKDLLRRLREENREILDRLRK

SEQ ID NO: 14938 - protein, 55 aa, Artificial Sequence
  Synthetic
EKVIRDADRMAKELKKDLRKVLEDNRRTVEKLKRDLEEVDKESDEEARKLREEIR

SEQ ID NO: 14939 - protein, 63 aa, Artificial Sequence
  Synthetic
SESEKIEREIRKLIDDSRKNSERIRREIEKLIRDSEETSKEIKKEIEDLLRELKEMLDEIKKR

SEQ ID NO: 14940 - protein, 55 aa, Artificial Sequence
  Synthetic
EEVLRRAKKALEEDKKRNDEVLDEVRKALEEDKKRNDKVLEDARRVIKKIKDELK

SEQ ID NO: 14941 - protein, 63 aa, Artificial Sequence
  Synthetic
KDEETIRRRIEELLKRSEDNSERIRRTIRELLERSKKLSEEVRKRIEELLKRLDEKVKEIRKR

SEQ ID NO: 14942 - protein, 55 aa, Artificial Sequence
  Synthetic
EEVLKEAEKRLREDKKRNDEVLKRVTEAVEEDKKRNDDVLEKVERAIREIARKLD

SEQ ID NO: 14943 - protein, 60 aa, Artificial Sequence
  Synthetic
SEEEKVIRDLERLLEENEEHSRDVERKLRESDKRLREMVKKVSDEIRKLDEEVEELLRRG

SEQ ID NO: 14944 - protein, 55 aa, Artificial Sequence
  Synthetic
EDALRRVKEALERSKKRLDKVLKDHEDSVRELKKEIDDVLKRNEETVREIEKRAR

SEQ ID NO: 14945 - protein, 60 aa, Artificial Sequence
  Synthetic
EEVERVKRELERLLEENDEHSKEVEKRIRDLDRKAEELLREIEERLRRSDERLKRLLERG

SEQ ID NO: 14946 - protein, 55 aa, Artificial Sequence
  Synthetic
ERVLKKVEDDLRESEKRVEEVLRKNEETVRRLKEELRKVLEDHKRTVEELRRRLT

SEQ ID NO: 14947 - protein, 60 aa, Artificial Sequence
  Synthetic
SREEEVEKRIREVLKRLEELLADVERRARELNRRLEKVVRDVKKEIEDLDRKLRKLLKDG

SEQ ID NO: 14948 - protein, 55 aa, Artificial Sequence
  Synthetic
EKVLKDVTDMARELERRLEEVLRKHRKSSEDLKRRIDEVLKRNEETLREIDRRLN

SEQ ID NO: 14949 - protein, 60 aa, Artificial Sequence
  Synthetic
SEREKAKRELERLLEEDRKHLKDVERELKELDEEDERHLREVEKELKELDDRAKEALDRR

SEQ ID NO: 14950 - protein, 55 aa, Artificial Sequence
  Synthetic
EEVLKEVKRLSEKSKTDLEKIVRDNKRSSDDSRRELERVIRENEETLRRLAERIK

SEQ ID NO: 14951 - protein, 60 aa, Artificial Sequence
  Synthetic
KEEEEAKKELDDLLRRLKDLYRRIREELERLDRRLEEAYRRIKEDLKRLDEELRRLLEKD

SEQ ID NO: 14952 - protein, 55 aa, Artificial Sequence
  Synthetic
EKVIRDVRKASRDTEREIRKVAEDNRKSSEDSRRKLEDVLRKNKETLDRLRDELR

SEQ ID NO: 14953 - protein, 60 aa, Artificial Sequence
  Synthetic
DEKETVEEELRRLLEELKKHIEDTERKLRKLDTDLEDVYRRIEEELRRLLEELKKMLDDR

SEQ ID NO: 14954 - protein, 55 aa, Artificial Sequence
  Synthetic
EKVLRDVEEALRRAKKRSDDVVRENEKSSRRSEERLERVLRDAKRVLKELKERID

SEQ ID NO: 14955 - protein, 61 aa, Artificial Sequence
  Synthetic
SELEEVLKRVAEVVERVSREDEKVNRKNDAAVKKVTKDDRKVLEDLERKLRELEKDAKDRG

SEQ ID NO: 14956 - protein, 59 aa, Artificial Sequence
  Synthetic
EDVIRRLEKEVRDVLKDWEEKSKEAEEKNKTVNKRWEDESRRLKKKVDRLIEKIKEDLR

SEQ ID NO: 14957 - protein, 60 aa, Artificial Sequence
  Synthetic
RSEELLREIEERIKRLKEKNEELVKEIRRRARELEREDDRAKKEIDDLARKVEEKIRRTI

SEQ ID NO: 14958 - protein, 55 aa, Artificial Sequence
  Synthetic
DDVVREVRKLIEELDRHLERLVEEVRRVVKELLEISKEILDRVREVITRLREEVK

SEQ ID NO: 14959 - protein, 59 aa, Artificial Sequence
  Synthetic
SEVEDAVRKIRELAKEIARAIDELLKEHEELIRTVADALEKLVRTSDKLAEDIARVIDG

SEQ ID NO: 14960 - protein, 56 aa, Artificial Sequence
  Synthetic
RELLEELKRILEDLERRAKEIVDRARELNKRAEDEIRRLIEDSKRKLEEIRKRIEE

SEQ ID NO: 14961 - protein, 59 aa, Artificial Sequence
  Synthetic
KEAEEAVKRLRDLVRRVEEETKRLLRESRESLKTLEEITDRLLKRSEESVKEIEKVITR

SEQ ID NO: 14962 - protein, 56 aa, Artificial Sequence
  Synthetic
RELLTEVTKLIKDHHDKVREILRESDKELDRHHKDVERILERSKRELERLEDEVRR

SEQ ID NO: 14963 - protein, 57 aa, Artificial Sequence
  Synthetic
SREELLKEIKKKIDDIKRENEKLLRDIERLIRELEKRDKELLDEARKTSEELVRRAG

SEQ ID NO: 14964 - protein, 55 aa, Artificial Sequence
  Synthetic
RDVVRDVDRILTEWKKESEDLVEEVKELIKRWKDTSEELVRRVRELNERIDRETR

SEQ ID NO: 14965 - protein, 60 aa, Artificial Sequence
  Synthetic
SEVETVEEKVKKVIEDLRRLLKEVRDRNRRIIEEIKRLLERVAEKNKRIVDEIRDLLRRR

SEQ ID NO: 14966 - protein, 56 aa, Artificial Sequence
  Synthetic
EDIIRRIDELFREILKEVKRLNEESKRRLEKLEEDIKRLDDRSREEAEKLRDAVRR

SEQ ID NO: 14967 - protein, 60 aa, Artificial Sequence
  Synthetic
SEVEKVARDVEEVIRTSEDKTRKLEKRNKDIIREIKKLLDDLARENKRIADEIKRKLDER

SEQ ID NO: 14968 - protein, 56 aa, Artificial Sequence
  Synthetic
KRLIDEIRREMERSHRRDEEVNEKSKREADKLRRDVEKLDEDSARELKKLEDEVRT

SEQ ID NO: 14969 - protein, 60 aa, Artificial Sequence
  Synthetic
SEVERVERELDKVITDLRRLLDDLKRKNEELVRRIRELLKKVKERNKKIVTEIDDLLRRR

SEQ ID NO: 14970 - protein, 56 aa, Artificial Sequence
  Synthetic
ERIIRRIKELADRIEERVKELNERVREEVRKLEEDIKKLDDESREEARKLEDKVRQ

SEQ ID NO: 14971 - protein, 60 aa, Artificial Sequence
  Synthetic
SSEEIRREIERESEDTRRRLDRVLEDIERLSRETKEHIKESLERVRREHDRLRRELERKA

SEQ ID NO: 14972 - protein, 55 aa, Artificial Sequence
  Synthetic
EEVRREVRKLIEESRRAIDEVKRRVEELIKESRDRNRRIEERVKELVKENAERIR

SEQ ID NO: 14973 - protein, 60 aa, Artificial Sequence
  Synthetic
KSEEIRRKIEEDSRRTKKELDDILDEIRKLAEKVKKEIEELLRKVRRRHEDMKRRLREKV

SEQ ID NO: 14974 - protein, 55 aa, Artificial Sequence
  Synthetic
EEVAKEVKKLIEESRKLLEELKDTVRRLIKRLKELLEELERRVEELIKENEERIR

SEQ ID NO: 14975 - protein, 60 aa, Artificial Sequence
  Synthetic
RSEDILREIEDLSRETKEKIDEILERIRKLAEEVKRHIDESLKEVRRRHEEADRELDEKM

SEQ ID NO: 14976 - protein, 55 aa, Artificial Sequence
  Synthetic
EEVAKEVRDLIRRSEDLLRRILETVDKLIKELRKLNEDILERVRKLIKKNKDDIK

SEQ ID NO: 14977 - protein, 60 aa, Artificial Sequence
  Synthetic
KSEEIERRIRERSRETRRELEEVDKKVKKRHTELREHLKRSLKKVKEDHDDLKRKLEEKI

SEQ ID NO: 14978 - protein, 55 aa, Artificial Sequence
  Synthetic
EEVEEEVKRLIEESKELIKRLEEEVDKLIRDNKKLNDDILRRVKRLAEENDERIR

SEQ ID NO: 14979 - protein, 60 aa, Artificial Sequence
  Synthetic
SSEDILRDIERIARKLREDLKRVLKRVKELSDDTRREIERLVEEVERIHERLRRELERKV

SEQ ID NO: 14980 - protein, 55 aa, Artificial Sequence
  Synthetic
ERVADEVRKLIAELEKLIRDLKRRVDELIRRSRELLERIRDRVRKLIEENKRAID

SEQ ID NO: 14981 - protein, 59 aa, Artificial Sequence
  Synthetic
SKVEEAKREVDRVIKELREDIKRVEEEVDKLIKDHEKLNKELEDESRKLAERVEKLRRD

SEQ ID NO: 14982 - protein, 56 aa, Artificial Sequence
  Synthetic
EKIVRDIKELLRDLRREVEKVIERIDRLIKRLEEESRRLFEESEKAIRELKRRVDK

SEQ ID NO: 14983 - protein, 59 aa, Artificial Sequence
  Synthetic
KKVEEAKKEVKEMIRRHRERNKEVEKEVKDLARKHEKENRDVAETSKRLAEKVKKLRDD

SEQ ID NO: 14984 - protein, 56 aa, Artificial Sequence
  Synthetic
EEIVKDIKREIEELEDESRRILEEIREDIDRLRRRSEKLFEDSRELIERMKREVDR

SEQ ID NO: 14985 - protein, 60 aa, Artificial Sequence
  Synthetic
DEIEKVRKRAEDLNREDKRLSERAFEESKEVVEEHRRLSDRARRESDRVVEEVEKTLKDK

SEQ ID NO: 14986 - protein, 56 aa, Artificial Sequence
  Synthetic
RKILEEIRKAIDRNRDENRRLVEESKKELDELRKEDEELVERSKRKLEELDRRAKK

SEQ ID NO: 14987 - protein, 60 aa, Artificial Sequence
  Synthetic
SRIETVKDELRRIAEDVRRALEEIEERLKDLNRRDEELTKRIEDTSRDILRRVEEVLRRN

SEQ ID NO: 14988 - protein, 56 aa, Artificial Sequence
  Synthetic
EKILKEVADRLRELKRRAERLIEEVTRLLKENEKRNKEVVDTSREALREIRDRVRK

SEQ ID NO: 14989 - protein, 57 aa, Artificial Sequence
  Synthetic
SKEDILREIEKRIRKIEKEAEELLRESRKILEELEERDRRLLERVKREIDRLLEETG

SEQ ID NO: 14990 - protein, 59 aa, Artificial Sequence
  Synthetic
EELLRRVERELKKLIDEVRKVLKDNFDRNRELAKEWEDLSRELFKRAKELIEKVEEASR

SEQ ID NO: 14991 - protein, 57 aa, Artificial Sequence
  Synthetic
SKEDILREIKKRIEEIERDARRLLEESKRILDELRKTDEKLLRESEERVEELERKSG

SEQ ID NO: 14992 - protein, 59 aa, Artificial Sequence
  Synthetic
EELLKRVMEELRELIERVERELRRNARENRELARKWKKLSEENKKKNDDLIREVDEASR

SEQ ID NO: 14993 - protein, 60 aa, Artificial Sequence
  Synthetic
DEKERIEEEIRRILEELERKVDEAREEIKRMDEELKRRIEEIARRSRELDDELRERVDKD

SEQ ID NO: 14994 - protein, 55 aa, Artificial Sequence
  Synthetic
EEVRKEAERVLRKIEEDIDRVLRENEDSVRKLRTEIDRVEEENRRSAKRIRERLK

SEQ ID NO: 14995 - protein, 59 aa, Artificial Sequence
  Synthetic
DEVRDVVTRIRDLLRRIKERLEELTERIRRLLEKIHKTTEDLARRNRKLIDEIRKEIDK

SEQ ID NO: 14996 - protein, 55 aa, Artificial Sequence
  Synthetic
EDVKREVKELLDKIREDLERVREEAKRSNEENRKRLEEVVEESERLLEELKRRST

SEQ ID NO: 14997 - protein, 55 aa, Artificial Sequence
  Synthetic
DEVREVLKELKKVLREIEKAVRDVLEEDREMHERIARKVKKVLDENKKSLDDLRR

SEQ ID NO: 14998 - protein, 59 aa, Artificial Sequence
  Synthetic
EKKLKEIADKIRELLERLKDRLEKIAREIRDVNRKLDEDLEDIVRRIRDVDKKLDDKTK

SEQ ID NO: 14999 - protein, 63 aa, Artificial Sequence
  Synthetic
SVLEEIEREVEEIRRRIEKVLKELNDDDRRVIEDSKRLNEKLEKEVRDIERKARDLLRKLKDT

SEQ ID NO: 15000 - protein, 59 aa, Artificial Sequence
  Synthetic
REELEKLKRRLDEELDRVREKVEENIRRTDKAVEDSERENERLKRELDEKVKRIRDELR

SEQ ID NO: 15001 - protein, 55 aa, Artificial Sequence
  Synthetic
SDEEDVERLVKELIDRVRKTDAELERKVDEVIRELKEVIKRIEDHSRDSIRKLRN

SEQ ID NO: 15002 - protein, 55 aa, Artificial Sequence
  Synthetic
RELIKRLRDAVRESEKENKRINERLRRVIEKAKRDLEKILEEDRRVLEEMAERAK

SEQ ID NO: 15003 - protein, 56 aa, Artificial Sequence
  Synthetic
SEVETIKREIDKLMKELTEKIKRIKEEDDKVHEELKRAVDRSRERLEEVLKELRDR

SEQ ID NO: 15004 - protein, 59 aa, Artificial Sequence
  Synthetic
EKEIRDLMREIREVAERAKKRVDELLERIRRINTKLKEELKELHKRTEDLIKKAKEEVN

SEQ ID NO: 15005 - protein, 56 aa, Artificial Sequence
  Synthetic
KEVEEIDERLKRVLEELRRMLEESRKEDERVHDELRKEAEKIKRELDKAVEELRAR

SEQ ID NO: 15006 - protein, 59 aa, Artificial Sequence
  Synthetic
KKVIDDLLRKIEKLIREMKKRLKDLHEETKRINEELERRLRDLERRVRDLLRRAREEAN

SEQ ID NO: 15007 - protein, 56 aa, Artificial Sequence
  Synthetic
SEIERIKEEDEEVHKRLKEINDRINKEDKDVHDKLRDEARKIEERLRRVMEELRAN

SEQ ID NO: 15008 - protein, 59 aa, Artificial Sequence
  Synthetic
EKVIRKLLEEIRRINEELERRNRKLMKDIREINERAEEKLRRLAEEIEELIKKLKEEVK

SEQ ID NO: 15009 - protein, 56 aa, Artificial Sequence
  Synthetic
SEVEEIKREDDKVHEDLKKAADDIRKRDEDVNRKLTEAIEEIRREVDKALEDLERR

SEQ ID NO: 15010 - protein, 59 aa, Artificial Sequence
  Synthetic
EEVIRRLMEKIRRINAELRKALKRLLEEIEDINRKLEEEVKKILEEIRRVLEELRRRAN

SEQ ID NO: 15011 - protein, 61 aa, Artificial Sequence
  Synthetic
SEVEELVKELRRLIEEWDRRSKRLMEELKELAERIDKTTKELLKELEDLVEKIKRELDKKG

SEQ ID NO: 15012 - protein, 55 aa, Artificial Sequence
  Synthetic
ERVAEEVKRAIERAKRESDKIERDVRELNRRNREILKKIKKRVEDVLRKLRKDLE

SEQ ID NO: 15013 - protein, 59 aa, Artificial Sequence
  Synthetic
DEVEELKERLRRLAETIARRIRELVERLRDSARKIEKRVRELAKKLRDSVREITKVIKD

SEQ ID NO: 15014 - protein, 55 aa, Artificial Sequence
  Synthetic
EEIREEVEKAVRDLEELLKELKRESEETIRRIEKLVRDLERESEEAVRRLKEEKD

SEQ ID NO: 15015 - protein, 59 aa, Artificial Sequence
  Synthetic
SEEEKLKKELEDLARRIEKRLRELVEELERSVREIERRIEKLHKELEESVDRIKKVVDK

SEQ ID NO: 15016 - protein, 55 aa, Artificial Sequence
  Synthetic
DEIRRRVEEVVRRLEKIVKELEERSREVLKRLREEIEKHKKRSEETKERIRTRAT

SEQ ID NO: 15017 - protein, 59 aa, Artificial Sequence
  Synthetic
SEVEELLKRLEDLIRKIEERLKELVKRLKESAKEIEERLEELHRRLKESVDRIREEIEK

SEQ ID NO: 15018 - protein, 55 aa, Artificial Sequence
  Synthetic
EEIKKEVKKALERLKKIVEDAKKVSEETMERIRKLVEEHKDTSRKTVEDLERATK

SEQ ID NO: 15019 - protein, 59 aa, Artificial Sequence
  Synthetic
DEVERLMEELRRLLEEVRKRIEDLIRENRKLVKEIKDRLEKLLRDNERLAREIEEVIRS

SEQ ID NO: 15020 - protein, 55 aa, Artificial Sequence
  Synthetic
ERIREEVKRAIEKLKELVEDSNREVTEALKEIEDLLRKLKERSEELLRRIKARTD

SEQ ID NO: 15021 - protein, 60 aa, Artificial Sequence
  Synthetic
KEVDELDEELKKHAERIDRELERLDRENEKHVEDVRRELERLREENERHARRIEDEVKKR

SEQ ID NO: 15022 - protein, 59 aa, Artificial Sequence
  Synthetic
RKTLEDIRRKVEKSLRELEKKLEEIDKKNRDTLEEARRELERIRRENEEVIRRLDKRRR

SEQ ID NO: 15023 - protein, 60 aa, Artificial Sequence
  Synthetic
KEVEELVRKLREHVRDIKRKLEELLKENEDHARRAEDRLRELTKENRDHVKEMEDVLRRD

SEQ ID NO: 15024 - protein, 59 aa, Artificial Sequence
  Synthetic
KDTLERLEREVRKSIKELEDKLREIRKRNKEVIDKLRDILEKIKKENREALKRLRDTEE

SEQ ID NO: 15025 - protein, 60 aa, Artificial Sequence
  Synthetic
SEVEKLTEELRRHVEEIERDLDRLRKENERHAKKIKDELKRLLEELEEVARRIEAELERD

SEQ ID NO: 15026 - protein, 59 aa, Artificial Sequence
  Synthetic
KDMLRRIEEEVERSIRRLEELLERIRERNEKVIEDLKELLKRIRDRAEEVKDRLRRTRK

SEQ ID NO: 15027 - protein, 60 aa, Artificial Sequence
  Synthetic
SEVEKLKKELEDHVRDIEKKLRDLMRENEEHAKRARERLKKLLEDNEENVKDIEDKVRKK

SEQ ID NO: 15028 - protein, 59 aa, Artificial Sequence
  Synthetic
EDTLRKIREDAKRSEKKLEEILRTIRKRNEKVIRDLRRLLEELRKRNREAIERLRKELE

SEQ ID NO: 15029 - protein, 60 aa, Artificial Sequence
  Synthetic
SEVERLAEELRKHVEEIKKELRKLKEKLEKLARDIERELKRLRDENKKHADDIRDKVEKR

SEQ ID NO: 15030 - protein, 59 aa, Artificial Sequence
  Synthetic
KDTLRRIEEEVKKSERELREELKRLEERVRRVIEKLEDLLRRIEKENEEVKRDLERRRK

SEQ ID NO: 15031 - protein, 60 aa, Artificial Sequence
  Synthetic
SEVDELKRRLDEHAKDIRDKLRKLVKELREHAKRAEDELRRLLKENEDNAREIRELVKTL

SEQ ID NO: 15032 - protein, 59 aa, Artificial Sequence
  Synthetic
EKTLRDIKRAVEKSIRDLERILEELRKEVEDTIKRLEDILREIRKRNKDVIDDLRRRMK

SEQ ID NO: 15033 - protein, 60 aa, Artificial Sequence
  Synthetic
SEVDRLVRELDKHVEDIERTLKKLREENEKNVEEIKRTLKKLVDELRKLAREIIDTVDKN

SEQ ID NO: 15034 - protein, 59 aa, Artificial Sequence
  Synthetic
EKTLRDIKRRVDKSLEDLKRTLEEIKRENERTLEEIKKILEDMEREVRDIERKLREKEK

SEQ ID NO: 15035 - protein, 60 aa, Artificial Sequence
  Synthetic
KEVEDLVRELEKLIEEIKRRLEELDKELKKHVEDAERRIKKLLDENRENAERILEKLRRD

SEQ ID NO: 15036 - protein, 59 aa, Artificial Sequence
  Synthetic
EELLRRAKERVREALEDLRRILEEIRRKVEETIRRLEKLLKELRDRNRRVLEELERTLK

SEQ ID NO: 15037 - protein, 60 aa, Artificial Sequence
  Synthetic
REKEEIKREVEEAKKRLEDLLREIAEEVKRALERLRELNERNNDRARRVLKRLTDELRRV

SEQ ID NO: 15038 - protein, 55 aa, Artificial Sequence
  Synthetic
DRLSERLRRLVREIEETLKELLKALRRLLERIREVSEELHRRSEELVERILRKLK

SEQ ID NO: 15039 - protein, 60 aa, Artificial Sequence
  Synthetic
REKEDIEEKVKRVLERLERLNRENNKESERLLRRLEELNKRNNEAVKELLDRLREILKRV

SEQ ID NO: 15040 - protein, 55 aa, Artificial Sequence
  Synthetic
DRLMEELKRLAREAERVSEELHDRTRRLAEEIEKVSKELHKKSEKLAREIKKRLD

SEQ ID NO: 15041 - protein, 60 aa, Artificial Sequence
  Synthetic
KEAEELIKELKDLAERIRRENRRLLEELKKLVEEIRRRIRELIERSEDSVRKIEETVKRK

SEQ ID NO: 15042 - protein, 55 aa, Artificial Sequence
  Synthetic
EKAERELKKISEDDERSIKELEDLLRKVEEDIRRLLDELRDIMKKTKEKVDELRR

SEQ ID NO: 15043 - protein, 60 aa, Artificial Sequence
  Synthetic
DEAERVKRELERLVKEIKEENRRLLRELRELSKRSREVLERLLRKLEDLVRKIREVLERL

SEQ ID NO: 15044 - protein, 59 aa, Artificial Sequence
  Synthetic
KKVLDEIEKEAEEIKRENKDFNRRIEREVRESKREIEEVVKRIREIAERVDRDIDRTRR

SEQ ID NO: 15045 - protein, 60 aa, Artificial Sequence
  Synthetic
DEEREVKERLRDLTRRIRETIKRLLDKNKDLARRIREVNKETSEELERLARDIERVLEEL

SEQ ID NO: 15046 - protein, 59 aa, Artificial Sequence
  Synthetic
KKVLDEIREAAERVKREIEELLKEVHRINTELNKDNTELNKRNREIVERVKRRIDERAR

SEQ ID NO: 15047 - protein, 60 aa, Artificial Sequence
  Synthetic
DEVEEVKKALEDLAEKIRDLNRKILEKNKKLADDIRRLNEKLLRELRKLVEEIERVLRKL

SEQ ID NO: 15048 - protein, 59 aa, Artificial Sequence
  Synthetic
KELLDEIRRRVEEVKKDNERVNKEIEELNRKLDEDNERANREIRDTVEKVRRRIDEEEK

SEQ ID NO: 15049 - protein, 61 aa, Artificial Sequence
  Synthetic
SEIEEIEKEIRRVLEEIERLLRTLKKINDDVKRESEKLVRDDKKKIDDALRELRKLAAERG

SEQ ID NO: 15050 - protein, 59 aa, Artificial Sequence
  Synthetic
DEVVRRAEKLLKEIRDTVETALKELEDKNERSERENKRVAEESERKLRKIKEEVDKAAE

SEQ ID NO: 15051 - protein, 60 aa, Artificial Sequence
  Synthetic
RKVEEIKKRLKELKERLEESVKRIKDRLRKLEEDNRRLAEEVKKRLEELLKRLEDLVKRR

SEQ ID NO: 15052 - protein, 59 aa, Artificial Sequence
  Synthetic
EKAVKELEDELRRIEKTSRDVLKELEDILRRLREESKRVADELRELLRRVKEKVERETK

SEQ ID NO: 15053 - protein, 60 aa, Artificial Sequence
  Synthetic
SEDDRIRERLKELVDRNDELVKRIKRALDELLRELRKSVEDIKRTLDDLARKLEELARRR

SEQ ID NO: 15054 - protein, 59 aa, Artificial Sequence
  Synthetic
REVVEDLKRILRELEKRSEDVLRELKKKLDDVEKESRDVLRELTEKLKKIEEDVRRAEK

SEQ ID NO: 15055 - protein, 60 aa, Artificial Sequence
  Synthetic
REVEEIERRIRELLETNREIAERTTEEIKRLKKELEDSLEEIKKRLKELVDELRKLATDR

SEQ ID NO: 15056 - protein, 59 aa, Artificial Sequence
  Synthetic
EEAVRRLEELVREIEDRSERLNKENEDELKKIEETSRKALKELEDRLREVKKEVREAER

SEQ ID NO: 15057 - protein, 57 aa, Artificial Sequence
  Synthetic
DSDRELEKKIRDSLKRLEEALRELEERLKRSLEDDERVHEELRRRAERIRETIKKRL

SEQ ID NO: 15058 - protein, 59 aa, Artificial Sequence
  Synthetic
SELVKRMKERVDELHKRTEELLERLKEELKKLHDETRDINRELKKRLEDLERKIEEAAK

SEQ ID NO: 15059 - protein, 57 aa, Artificial Sequence
  Synthetic
KEAEELRRLIEESKRTDKKVHEDLKEEVRKIEEEDDKAHEELRKEVERIKKKIDDDM

SEQ ID NO: 15060 - protein, 59 aa, Artificial Sequence
  Synthetic
SELIKRLKDEVKKLHDETERINRELKKELDDLLRRVRKINKELKEELKKLERKIEEAAR

SEQ ID NO: 15061 - protein, 57 aa, Artificial Sequence
  Synthetic
SSREELEKRIRESEKRDREMHERLRRTAEKIEKEDKEMHDRLREKAERIEERIDKEV

SEQ ID NO: 15062 - protein, 59 aa, Artificial Sequence
  Synthetic
SELIERIAERIERLNRDTERINRELEEKLRRLLKRIREINTELDKRLKELLDRIEEASR

SEQ ID NO: 15063 - protein, 57 aa, Artificial Sequence
  Synthetic
SSEEKIEKASEDNERKVKEVLREIEELSKKDKTDVERVLRELEKRLEEIKREVDRRD

SEQ ID NO: 15064 - protein, 56 aa, Artificial Sequence
  Synthetic
EEDLKRELDEIDKRTEELARELRELMREIHERTKRLADDLRRAIDEIRKKIEEDAR

SEQ ID NO: 15065 - protein, 59 aa, Artificial Sequence
  Synthetic
DELEDLLRRHRELVKRSLERLKDLLERNRELIEDSERRAEELLRELRRLIEEIKKVLDE

SEQ ID NO: 15066 - protein, 59 aa, Artificial Sequence
  Synthetic
KKVLEELKRSNDEANERHKTVLRRLEEENKRANDSHRKIKEELKDLLRRVDETVKEKRR

SEQ ID NO: 15067 - protein, 59 aa, Artificial Sequence
  Synthetic
SRLEELLKTHKKLVEDSVDEVRRLLERNRKLIEDSKERLKELLRTNEELIRTLKEVLDR

SEQ ID NO: 15068 - protein, 59 aa, Artificial Sequence
  Synthetic
EEVLRRLKESNKKANEDHRRLNEENKDLNRRANEEHKKVNDRNKELLDRARRTADEKRR

SEQ ID NO: 15069 - protein, 59 aa, Artificial Sequence
  Synthetic
DEVDELVKTHERLVEESERRIEELLERNRRLIERITERAKELLKENKRLIEEITEVLKR

SEQ ID NO: 15070 - protein, 59 aa, Artificial Sequence
  Synthetic
KDVLERLKDSNRKANERHKRMNEENKRLLEDVERRIKELNKRNEDLLREAEKRVRDERR

SEQ ID NO: 15071 - protein, 60 aa, Artificial Sequence
  Synthetic
SELEELLKTHKKLVEDSVERVRDLLRENKRLIEESEKEIRKLLDELRELIERIIELVERG

SEQ ID NO: 15072 - protein, 59 aa, Artificial Sequence
  Synthetic
KEVLERLKKSNKEANDEHRRLNDENRELNERANRKHKEVEDRLKDLLRRAEEKLTEDAK

SEQ ID NO: 15073 - protein, 60 aa, Artificial Sequence
  Synthetic
DEVERLITKHRKLVEDSRRRVEELLRRNAELIKTSKRRVEELLERNRRLAEELRRLLKEG

SEQ ID NO: 15074 - protein, 59 aa, Artificial Sequence
  Synthetic
DEVLRRVEDSNRRANETHKDLNRKNKELNEEANRTHEELLRRNEKLLREIEDTVDRETK

SEQ ID NO: 15075 - protein, 60 aa, Artificial Sequence
  Synthetic
SEVEKLLKELEDESRKSEDDNRRLLEELRRLSEESLRDLRRLLEDLKRLAEEIEREVRKR

SEQ ID NO: 15076 - protein, 59 aa, Artificial Sequence
  Synthetic
DELKKRVDEVLETSRELLRESKRKIEEIARRSEEELKRVKDEVDDTARRIKRKIEEAEK

SEQ ID NO: 15077 - protein, 57 aa, Artificial Sequence
  Synthetic
DSERRLDEILERAREVNEESSRRLDKLLRETEEKNRKSTEELRKIVEDLKRTVKDES

SEQ ID NO: 15078 - protein, 56 aa, Artificial Sequence
  Synthetic
AETVIRRIEKLLEDLKRVDDKILEEHKDLSKKLDDVDREIKERIKKLIKDLKDTAR

SEQ ID NO: 15079 - protein, 57 aa, Artificial Sequence
  Synthetic
DSEEELKDILRKAKEDNDRSSDKLRRLLEETEKRNRDSTKRLEELLEETEREVRRRS

SEQ ID NO: 15080 - protein, 56 aa, Artificial Sequence
  Synthetic
AETVKERIKKLLKDLREVDREILERHKKMSDDLKRVDEEISKTHKELSRRLKETAR

SEQ ID NO: 15081 - protein, 57 aa, Artificial Sequence
  Synthetic
SKEEDLKRILEEAEKTNKESSDRLRELMDRTRRENEESSRTLKEIVKDADRRVAEII

SEQ ID NO: 15082 - protein, 56 aa, Artificial Sequence
  Synthetic
VERVKEDIERLLDELRKVDREILETHKKLSEELRRVDEEIIKRVKDLIRTLEKAAE

SEQ ID NO: 15083 - protein, 57 aa, Artificial Sequence
  Synthetic
SSEERLRTILREIEKTNRDSSKRLRDLLRETKRENKESSDELRKLLEETRDEVEKRR

SEQ ID NO: 15084 - protein, 56 aa, Artificial Sequence
  Synthetic
SDTVAERIRRLLEELKRVDEEILKTHKDLSDRLRELDEEIKKTHEKLSEELRRAAN

SEQ ID NO: 15085 - protein, 60 aa, Artificial Sequence
  Synthetic
KEVEEILETHKEIARELREVAEEIIRDHERILRDLEKKIRELRRTHERMVEELDRVAKEG

SEQ ID NO: 15086 - protein, 59 aa, Artificial Sequence
  Synthetic
KDALDKLRDSDRRVHEDVRRMLKRLDDSDKRVHDRVRKVLEDLKRSNDELRRTVEERER

SEQ ID NO: 15087 - protein, 60 aa, Artificial Sequence
  Synthetic
SEVEKILEDHKRIVDELEKEAKKIEETHTELVKRLREEVEKLKEELRRLLEELKDMARRG

SEQ ID NO: 15088 - protein, 59 aa, Artificial Sequence
  Synthetic
EEALRRLKKSDEEVHRRVREILKRLEKSNRDLNDDSRKVEEELKRILRRIEEEAKRTED

SEQ ID NO: 15089 - protein, 61 aa, Artificial Sequence
  Synthetic
SEAERLLDELRRLLEEIKRRIEELLEESKRSLEEVEKRSKELLDRLEDLLRKIKEEIRKDG

SEQ ID NO: 15090 - protein, 59 aa, Artificial Sequence
  Synthetic
EEVKERLERLRERIKREIDRVIRELRELDKRAKEVSKRTKEELEKILEKVRRVIEEVKR

SEQ ID NO: 15091 - protein, 61 aa, Artificial Sequence
  Synthetic
DDVDRLLDELRELIDRIRKDLERLLKESRDSLEELRRRSEELLKKLEEEIREVVERIRREG

SEQ ID NO: 15092 - protein, 59 aa, Artificial Sequence
  Synthetic
DELKRRAEKLLEDLRRVIEEIKRRLDKVNDEVREVSKETTDRLDDLVRKARELIRRVEK

SEQ ID NO: 15093 - protein, 61 aa, Artificial Sequence
  Synthetic
SEREKLLTDLRDLLKKVVDTLRRLNEELKKSIEESKETLERLNRTLKKLLDEVKKKLEDDG

SEQ ID NO: 15094 - protein, 55 aa, Artificial Sequence
  Synthetic
DELRKIVEEIRTELDRVRETNERILKEVRDEHRRVDKTNTDIERDIERVIKEVET

SEQ ID NO: 15095 - protein, 61 aa, Artificial Sequence
  Synthetic
KKDEDLKKLLKDNEDVMKKAADEVKRLNDENRDLMRRVAEKIEDLLRRLEKLLRDILRRRG

SEQ ID NO: 15096 - protein, 56 aa, Artificial Sequence
  Synthetic
SKTVKDRIKRLTDELERVNRELSEEHKRVLDELRKRNKEILDRLKELLKRLKEEAD

SEQ ID NO: 15097 - protein, 60 aa, Artificial Sequence
  Synthetic
SSEEELERLLEELRRITEEAKERMERSSKELEDVSREAEKRLEKSSRDLDKTVRDIKRRI

SEQ ID NO: 15098 - protein, 56 aa, Artificial Sequence
  Synthetic
AEDVKRRVRELIEEHKRLNKELLDESRELLKTHAELVKRILDESRRLLEELEKAAR

SEQ ID NO: 15099 - protein, 60 aa, Artificial Sequence
  Synthetic
SEREDATRRLRDIIRRLRDLIRRLTEESEESIKEIRERIERIIRTSEESLKELEERIRRN

SEQ ID NO: 15100 - protein, 55 aa, Artificial Sequence
  Synthetic
EDLERLREEIEDVVRKAEKRLDELHDEIRRTIEDAERRLDESNERAEKVVRDAEK

SEQ ID NO: 15101 - protein, 60 aa, Artificial Sequence
  Synthetic
SDEERALEKIRRLIEDLRRMVREMLERSKKSLEEHKELAREILRRSRESLERLKDVARRN

SEQ ID NO: 15102 - protein, 55 aa, Artificial Sequence
  Synthetic
RELDKLREELEEVVRRVEEKLDDSDRRANEVTREIEKTLDDLHREAEEVVKEIRR

SEQ ID NO: 15103 - protein, 60 aa, Artificial Sequence
  Synthetic
SVEETLRRLLEESERVNRRVKEDLDRIRRESEEVNKRAEEMAKELLDEIRKDIDRVRKRN

SEQ ID NO: 15104 - protein, 59 aa, Artificial Sequence
  Synthetic
EELAKEVIKTLRKLIEESKRNHEDLRRELRELIEESKRDHERLLRRLRELIKRIRDTTK

SEQ ID NO: 15105 - protein, 61 aa, Artificial Sequence
  Synthetic
DEIEDLLRRAEKLIRDLKRKNDKLLKESEELLERLRERAKEVLDESKKLLEELRELVRRRG

SEQ ID NO: 15106 - protein, 59 aa, Artificial Sequence
  Synthetic
ERAARDVERLKRRNKKVVEDSEDLARKTNKKSEELLREIRKRVEDSNRETKEILDRVRK

SEQ ID NO: 15107 - protein, 60 aa, Artificial Sequence
  Synthetic
DEDEELLKRLRDLIREVRDRVRRLLEEDKDSLRRIRERVEELLRRSEESLKDLEKKIREG

SEQ ID NO: 15108 - protein, 55 aa, Artificial Sequence
  Synthetic
EELKKIADKVEEVLREVEKELDKSRRTSDEILKKVEKAVRDLDRRVKEVIDRARR

SEQ ID NO: 15109 - protein, 60 aa, Artificial Sequence
  Synthetic
SEAEELLKRLERLLRESKKDLERLRKELKDLLEESRKDVTRLLDEIRRLLEEIKRRLDKR

SEQ ID NO: 15110 - protein, 59 aa, Artificial Sequence
  Synthetic
EEVKRMIEKLKKESEEVIRKAKEDLDRVTKESRRVIEEVERRLDELRERLREVVERVKT

SEQ ID NO: 15111 - protein, 60 aa, Artificial Sequence
  Synthetic
DEAEKLLKELRDLLEESRKDLERLLKELEDLLEESKRDLERLLEEITELLKRIKETVERR

SEQ ID NO: 15112 - protein, 59 aa, Artificial Sequence
  Synthetic
EEVKRKIDRLEEESRRVIEEARKRLEEVEEKSKKIIDDARRALDRIDKELRRVVEETRK

SEQ ID NO: 15113 - protein, 60 aa, Artificial Sequence
  Synthetic
SVEETARRLLDENRKLLEEAERIHTEINERNKELLKRADDLHRRVLEDLRKLLDKVAKEI

SEQ ID NO: 15114 - protein, 56 aa, Artificial Sequence
  Synthetic
ADTVVKRIKKVIDELEELNRKSKKELKEVIEDLERRNRDSIRRAEDLLRRLEEEVR

SEQ ID NO: 15115 - protein, 60 aa, Artificial Sequence
  Synthetic
KDEETVEKLLRELEELLKEAEERAKDLNRRNKELLDEADRRHEELLRRLEDLLRDVRRRI

SEQ ID NO: 15116 - protein, 56 aa, Artificial Sequence
  Synthetic
SDTVSERIRKVIREIERLIKEIVKEIEKLIRDLEKRNRESLKEIKDLLKKLKDEVD

SEQ ID NO: 15117 - protein, 60 aa, Artificial Sequence
  Synthetic
SRKEKLLTELKEILKRLKEEVEKIVKESEKSIEEHHRRSERLKRESKKSLDDLAKILERS

SEQ ID NO: 15118 - protein, 55 aa, Artificial Sequence
  Synthetic
EELEKIRREVEELLRRAEEELRRLNREIEENHKRVKRELEKIDKEMKDLLREAKR

SEQ ID NO: 15119 - protein, 60 aa, Artificial Sequence
  Synthetic
DRKERLKERLERLLKEHHDRSRELLRTSEESIRRHHEESRRLLRRSKESLDRLRDELRRL

SEQ ID NO: 15120 - protein, 55 aa, Artificial Sequence
  Synthetic
EELRKLERRARENHKRVREALERLNRRIEENHKRVRRRLEDLDRAAEELLREAKR

SEQ ID NO: 15121 - protein, 59 aa, Artificial Sequence
  Synthetic
SRKEDLKRRLEEIIKRLEEVVRRILRTSEESLKDHHEASKRLLEESEKSLKRLEEELKR

SEQ ID NO: 15122 - protein, 55 aa, Artificial Sequence
  Synthetic
EELRKIEERIRELAKRAREELDKLDKEVRKNHERVKRRLEELDRRAKELVREERR

SEQ ID NO: 15123 - protein, 60 aa, Artificial Sequence
  Synthetic
SEKEKLLKEIERLIEELRRVVKKAVEDSKESIDRHHERSRELLRRSRESLKDLERRLKDS

SEQ ID NO: 15124 - protein, 55 aa, Artificial Sequence
  Synthetic
RELEELEKRVRELERRIRETLTRLNEEIEKNHRRVEERLRDLNREAEKLAEEAKR

SEQ ID NO: 15125 - protein, 60 aa, Artificial Sequence
  Synthetic
SEKEDLSRRLAELLKEHHDRSKKLLDESRDSLRKHHKASRDMLRRSDESLKRLDRVRKER

SEQ ID NO: 15126 - protein, 55 aa, Artificial Sequence
  Synthetic
EELDRIRKEVKKNHDRARRALEKIDKEAKENHERVREALRKLNEDLEKLEREKRK

SEQ ID NO: 15127 - protein, 60 aa, Artificial Sequence
  Synthetic
REKEELIKRLKRLIDELRRVVKTLLADLERLLKEHHDRSRRILEESKRSLEELEKTLRRS

SEQ ID NO: 15128 - protein, 55 aa, Artificial Sequence
  Synthetic
DELRKLKEELEDLARKARKEIEDIKEKLRRNHERVKKALEDLNRTAEELLDRARQ

SEQ ID NO: 15129 - protein, 59 aa, Artificial Sequence
  Synthetic
SREEKLLKELKDIIDTLRRRVEEILTESEKSLRDHHRESRKIVEELRKLLEDLRRLLER

SEQ ID NO: 15130 - protein, 55 aa, Artificial Sequence
  Synthetic
RELDKIEEEARELVKRAEEKLREIDKRARDNHKRVRDELKRILDELKKLIDERRK

SEQ ID NO: 15131 - protein, 61 aa, Artificial Sequence
  Synthetic
SVEDSIDKIDKELEKNSERTKRTIDRIREESRRLIEEIKDRVRRLLREAERTIEDVKRKLK

SEQ ID NO: 15132 - protein, 59 aa, Artificial Sequence
  Synthetic
RRVVEELRERLKRLLEKHHDLMRRLTEDLKRLLEESERDARRLVKELEDALREIREDTR

SEQ ID NO: 15133 - protein, 59 aa, Artificial Sequence
  Synthetic
SREDKVRELEERLKRLNERLNREVKKVNEDNRRLLKRAEDTARRLAERIRRLLERVDRE

SEQ ID NO: 15134 - protein, 56 aa, Artificial Sequence
  Synthetic
DEELERRVEELLKRNEKLIREVKKRLEELLRRNEELIRRILEEVEKLLKDLEDKVR

SEQ ID NO: 15135 - protein, 60 aa, Artificial Sequence
  Synthetic
RREERVKEALERIRRLNKRINERVEEVNRENKRLLDEAKRTHEELEKEADRLLDDVRRKI

SEQ ID NO: 15136 - protein, 56 aa, Artificial Sequence
  Synthetic
EEELEKEIRKVLETNRKLAEDVRRDLERLLRRNRRLIEESKKEVEKLLKELEEDVR

SEQ ID NO: 15137 - protein, 60 aa, Artificial Sequence
  Synthetic
RRDDKVRKLEKELRDSNRKANDESKKLRDELRRLNEEANRRVRELERRIERLLEKVKDDI

SEQ ID NO: 15138 - protein, 56 aa, Artificial Sequence
  Synthetic
EEELKKRVEEALEEHRRLVEEVRRRVERILERNDELIKRIEETVEDLLRRLEEEVR

SEQ ID NO: 15139 - protein, 61 aa, Artificial Sequence
  Synthetic
SEIDEIVKEVERLLEKLKEDSRRTVEEVKKLLDELRKHSEDSVREIEELIERLRREIERDG

SEQ ID NO: 15140 - protein, 56 aa, Artificial Sequence
  Synthetic
EEKLRRLEEELREILKRSEDLARKLDEDLKRILERTRREIKRLEEDLDRLDEEVRR

SEQ ID NO: 15141 - protein, 61 aa, Artificial Sequence
  Synthetic
SESDEIIKEVDELIKRLRKHSKETVKEIEEILTRLEERSRKSVKEIEDEIRKLEDIVRKRG

SEQ ID NO: 15142 - protein, 56 aa, Artificial Sequence
  Synthetic
EEKARTLERKLDKILEETKREAEELKKRLDELVEKTRRLIEELKRRLKELLDRAET

SEQ ID NO: 15143 - protein, 61 aa, Artificial Sequence
  Synthetic
DESRKIVRDVEELIKRLEEHSRETVKRADRVLREDHKKSRDSVREIEKLIRDVKDKIDKRG

SEQ ID NO: 15144 - protein, 56 aa, Artificial Sequence
  Synthetic
EEEVRRLKKELDDLLEETKDLIRRLEEKLDKNVKETEDEIRRLIEELKKILEDATR

SEQ ID NO: 15145 - protein, 61 aa, Artificial Sequence
  Synthetic
REIDEIVKEIEKILRELKKRSDETVREIERLIEEDHRKSRKSVRDIEKLIDDLRKDVERRG

SEQ ID NO: 15146 - protein, 56 aa, Artificial Sequence
  Synthetic
EEKLRKLEEELRRLLEESKREADRLKKELRDNLKTTDELIKELKERLDKLKEDIER

SEQ ID NO: 15147 - protein, 61 aa, Artificial Sequence
  Synthetic
DESDRIVEEVRRLIKTDHDNSRRSVRKIEELIARDHKKVKEIVDEIRRLIRELEELIRRDG

SEQ ID NO: 15148 - protein, 56 aa, Artificial Sequence
  Synthetic
KEKLDRLEEEIDKNVKRTREEIERLKRELDKNLEDVRRLAKELEDELRKLDEDAKR

SEQ ID NO: 15149 - protein, 61 aa, Artificial Sequence
  Synthetic
SEIDRIIEDAERLLRELERNSDRSVEEIEKLIRDDHDNSRRTLEKIEKVIRELRKDVKDRG

SEQ ID NO: 15150 - protein, 56 aa, Artificial Sequence
  Synthetic
REKVKRLEEELRKILKKTREKAEELKRRIDRNVEETRRRARELKEELDRLLKEART

SEQ ID NO: 15151 - protein, 59 aa, Artificial Sequence
  Synthetic
DESRKVIKEIEDLLEEWKRRSERMIRESEKLIEELRERVDKILEDIDRLIRTLDELRKA

SEQ ID NO: 15152 - protein, 56 aa, Artificial Sequence
  Synthetic
EEEAKRLKDELEEILKESEDLSRRTKKELEDLLREVEKEIKKLEDKLKKLLDETDK

SEQ ID NO: 15153 - protein, 59 aa, Artificial Sequence
  Synthetic
SETEKVIREIEKLIDDIRKESERSIEESRKLLKELEEIVEKAIRDSRRLLEDLRRLVED

SEQ ID NO: 15154 - protein, 56 aa, Artificial Sequence
  Synthetic
EEKADTLRRKLEKLLEDTKRMSEKTKKEIEDLLKRVRELSEETKRRLDRILEDVER

SEQ ID NO: 15155 - protein, 59 aa, Artificial Sequence
  Synthetic
SESDKVVKEIEELLRELRKRVEEIIRESEALIETLKKRVDDAVRESRKLIKDLRELIER

SEQ ID NO: 15156 - protein, 56 aa, Artificial Sequence
  Synthetic
REKAKKLREELRKLMEEVRRLSKETKDKLDELLKTVEELSKELRERLKRLLDEAET

SEQ ID NO: 15157 - protein, 59 aa, Artificial Sequence
  Synthetic
SESDEVAKRIKELIDRLEERSRRSIRESDRLIKELEKEIEKAVRESEKLIRDLEELIRR

SEQ ID NO: 15158 - protein, 56 aa, Artificial Sequence
  Synthetic
EEKMRTLEEDLKRLLEETRDMSRKTKEKLEELLKRVRDLSKKLAEDLRRLLEEVRR

SEQ ID NO: 15159 - protein, 59 aa, Artificial Sequence
  Synthetic
SETDEVIKTLEELLERIKRRVEELVKRNKDLIKALEEEVRRIIKESKKLIDDLAELAKE

SEQ ID NO: 15160 - protein, 56 aa, Artificial Sequence
  Synthetic
KDKADRIREEIRKLEEEVKRLHDELKKELDDLLRRVEEDSKRTKERLRKLLTDVKK

SEQ ID NO: 15161 - protein, 60 aa, Artificial Sequence
  Synthetic
SEVDDLIRRLEKLLEDIKRRVEELVRRDEKITKDWERESERLIRELEELLKTIADLVRRR

SEQ ID NO: 15162 - protein, 56 aa, Artificial Sequence
  Synthetic
KKKLDEIRKRLEEILKRVRELLERLDRENEDLARKSKELADRIRKELKRILDEVRR

SEQ ID NO: 15163 - protein, 60 aa, Artificial Sequence
  Synthetic
DEVDELVKELEESLRRSREEIERLVREDEELTKTIREEVKKLVKTDEDLSKKIEDTVRRR

SEQ ID NO: 15164 - protein, 56 aa, Artificial Sequence
  Synthetic
KDKIKELKERNDKLLEEARRLAKELKERNDTLLKEVREELRRLRERNDRILKEAKK

SEQ ID NO: 15165 - protein, 60 aa, Artificial Sequence
  Synthetic
DEVDKLIRDLEELIRRIRKRLKELVDRDRELTREIRRRIRELIEESKEALERIDKRVKER

SEQ ID NO: 15166 - protein, 56 aa, Artificial Sequence
  Synthetic
KDKIKKLKDDLDRLLKEAEDRLRELEERNKRLLDEARKEIEKSDRRLEEILERVRR

SEQ ID NO: 15167 - protein, 60 aa, Artificial Sequence
  Synthetic
DEVDELIKTLKKLLEDIRERVERLVTDSKRSLDEIRETVRDLVRRDKELLKRIEDTVRER

SEQ ID NO: 15168 - protein, 56 aa, Artificial Sequence
  Synthetic
KDKLEKIKRDLEKILTEVREALRELDERLKKLAEEAKRLLEELRKRNRDILEKVRK

SEQ ID NO: 15169 - protein, 60 aa, Artificial Sequence
  Synthetic
DEVDKLIKEIEESLRRSEKEVRDLVRESERSLKEIEKRVRELVKRDEDLLKEIEEVVRKK

SEQ ID NO: 15170 - protein, 56 aa, Artificial Sequence
  Synthetic
EEKLKRLRKENKDLRDRVEEELRRLDKELDELLETVRRLLDELRKRNKKLLDEARK

SEQ ID NO: 15171 - protein, 60 aa, Artificial Sequence
  Synthetic
RLEEEIERLRREVEELIERSKDLIRRSHTKSRKLIEDVKRELDRLRREVEELIKRAEDRT

SEQ ID NO: 15172 - protein, 55 aa, Artificial Sequence
  Synthetic
DRVVREAEKLIRKIAEDNRKALEESDELIRRSEKDVRDMVRRAEELIEEIKRRVD

SEQ ID NO: 15173 - protein, 59 aa, Artificial Sequence
  Synthetic
SKDEEVERLKEELDRLLEEVRRLSEESKKRNDELLKRAEEIIEELKKELDEIREEVERR

SEQ ID NO: 15174 - protein, 56 aa, Artificial Sequence
  Synthetic
KDTVVRRAKKVIDELRKDVERVKRESDEVLKELEKLNREIEREVRKLLKELRDTVR

SEQ ID NO: 15175 - protein, 59 aa, Artificial Sequence
  Synthetic
RSEEEARKLERENKKLVDDARKLSEESRRRNDKLVEEARRIAEELKRELDRLLEEVDRR

SEQ ID NO: 15176 - protein, 56 aa, Artificial Sequence
  Synthetic
TKTVVDRVKKLLDDLREVNREILRESDKVLRDLKRLNDEIKREVEELLERLEREVR

SEQ ID NO: 15177 - protein, 59 aa, Artificial Sequence
  Synthetic
SAEEDAERMKDRNRRLLEKVRRLSEESKRRNDKLVEDAKKLSEDTRRKLEDIARKVRKR

SEQ ID NO: 15178 - protein, 56 aa, Artificial Sequence
  Synthetic
KDRVSEEIDRLLRDLERRNREILKESKEVLDRLKKLNEEILKESEDLLRRLEEEVR

SEQ ID NO: 15179 - protein, 60 aa, Artificial Sequence
  Synthetic
SEIEKVVKDVDKLLKELEDHTRKSLEDSKRLLDELRKHTEDTSREVKELLERLEEVIRRN

SEQ ID NO: 15180 - protein, 56 aa, Artificial Sequence
  Synthetic
KEDADRLRERLDRILEESERLSRETKEELDRLLEDSKRKIRELEERLKKLLDDAER

SEQ ID NO: 15181 - protein, 60 aa, Artificial Sequence
  Synthetic
DDSDKVLKELEKLLEDLERHTRESLRESDELLKELKEHTKTTLRRSERLLRELKRLVDEN

SEQ ID NO: 15182 - protein, 56 aa, Artificial Sequence
  Synthetic
EKDVEEVRRKVEELLKDSERLSKETKERLRDILRDSRRLSRETKEELKRILKEVRD

SEQ ID NO: 15183 - protein, 60 aa, Artificial Sequence
  Synthetic
RESEEVIKEVEKLLEELKENTKRTLKESRDLLKTLEDHTRETKKTVEKMLKELEDKVRKR

SEQ ID NO: 15184 - protein, 56 aa, Artificial Sequence
  Synthetic
EEEADRLRRELKKILDRSRELSRKTKEDLKKLLKESEDIIRELDRRLEEILKEVER

SEQ ID NO: 15185 - protein, 60 aa, Artificial Sequence
  Synthetic
EEIERVIKEVKDLIEELRRNTERTLRESEELLKTLKKISDDSKEEVERMLRELRELVKSN

SEQ ID NO: 15186 - protein, 56 aa, Artificial Sequence
  Synthetic
KEDADRLRREVDKLLEESKRLSEETKRELDRILEETKRTLERLKEELDKILEEVER

SEQ ID NO: 15187 - protein, 60 aa, Artificial Sequence
  Synthetic
SEKEKLVEEVRRIIERHKRVTEELLKELRRILKEWEDVSRDIERRVREILERLERAARDG

SEQ ID NO: 15188 - protein, 55 aa, Artificial Sequence
  Synthetic
KDLEELKKELEDSARRSKKLADDVREELKTLLRESERIIKELRKELEKLLREVEK

SEQ ID NO: 15189 - protein, 60 aa, Artificial Sequence
  Synthetic
TLEEVLKEVKRRVERVNEEDKRVLDESRKRAKEINDEDRRLLEESKRKAEELLERLRRKD

SEQ ID NO: 15190 - protein, 56 aa, Artificial Sequence
  Synthetic
EDRLRREAERILREIRELSRELKRKNEELLRTIRRVSEELRKKNEEILERVDREIK

SEQ ID NO: 15191 - protein, 60 aa, Artificial Sequence
  Synthetic
SAKELLDDLRKKIEDNVRETEKLLRRLREKVEKIEREIKELVRKLREDLERLLEKVKRRG

SEQ ID NO: 15192 - protein, 55 aa, Artificial Sequence
  Synthetic
KEVVDTVRELIERDHKKSRDSVRRVDELIDRARKDVRRVVEEVRKDLEKLDEDVK

SEQ ID NO: 15193 - protein, 59 aa, Artificial Sequence
  Synthetic
REVEEVLKDLKRLIDEAKKRVEDAIREIDRLIREWERLNREMLREIKKSNDEVRELVKA

SEQ ID NO: 15194 - protein, 56 aa, Artificial Sequence
  Synthetic
EEAVRDVERRLEKLLKEIKDLIDRLKEKVDRVKREVERSIEELKRHNEEVLKEVRK

SEQ ID NO: 15195 - protein, 59 aa, Artificial Sequence
  Synthetic
KEVEDVLEELDRLIETWARLNRELVERIRRLLEEWREENRKVVEEVRRSNETLRELVER

SEQ ID NO: 15196 - protein, 56 aa, Artificial Sequence
  Synthetic
EEVVRRVKDKLREVKREVEETARELRERVDDLLRKVEESVTRLKRHNEDLLREVER

SEQ ID NO: 15197 - protein, 59 aa, Artificial Sequence
  Synthetic
SEVEEVLRDLKRLLEEWKKRNEDLVRDVERLLREWKEANDRALKKSRDSNKELERLARD

SEQ ID NO: 15198 - protein, 56 aa, Artificial Sequence
  Synthetic
KEMVERVRREIKRLEEEVKKTITDLKERLKKLKEDADRSSRESEEHNKKVVEDVRR

SEQ ID NO: 15199 - protein, 59 aa, Artificial Sequence
  Synthetic
REVEEVLKELDRLIDELRKEVEKIVREVERSNDEWRRRNKELVDEVRRELDRLRKLVDD

SEQ ID NO: 15200 - protein, 56 aa, Artificial Sequence
  Synthetic
KEVVDDVKRKLEDLKRRVDELVRRLEEHNKDLRRKVEESAKDLRRKLEELRERVER

SEQ ID NO: 15201 - protein, 60 aa, Artificial Sequence
  Synthetic
SEKDEVRKTIERLLKEVEKMIRRVLKEVEDLLRELKKRTEKLKRELDESHRRVKEVIERR

SEQ ID NO: 15202 - protein, 56 aa, Artificial Sequence
  Synthetic
RELLEEVERALKKLKEDVDKVIEELREKLKRHHEDVKRAIDRVREESKRLKDEAEK

SEQ ID NO: 15203 - protein, 60 aa, Artificial Sequence
  Synthetic
REDEEVVKTLRELLREAKERTDRLLRELREIIKTMRKRLRDIEEDLRRSHREIEKLIRDR

SEQ ID NO: 15204 - protein, 56 aa, Artificial Sequence
  Synthetic
RELLEEVRKELERHHREARRAVEEVKKLIDDLMREVRKLIDEVRKDSERLRREVER

SEQ ID NO: 15205 - protein, 60 aa, Artificial Sequence
  Synthetic
DEDEEVKRRLEKLLEDADRVTEKIRKDLKETHDRVKRAIDELKKELEKSHRTIKEVIERR

SEQ ID NO: 15206 - protein, 56 aa, Artificial Sequence
  Synthetic
RELVEEVRDRLRKHHKKVRDIVDDVDKRSKDLERTARRVIEDVKEKSDRLKEEVDR

SEQ ID NO: 15207 - protein, 56 aa, Artificial Sequence
  Synthetic
EDEERVKEKLKRLLEKAEEALRRSKRRNEENKKEHERVLKEIDERLKRLEEKVRRG

SEQ ID NO: 15208 - protein, 56 aa, Artificial Sequence
  Synthetic
REDIERLLKELDDRIRRIIEELKRSDEELHKENRRKIKELEDLVREADKRIEDKRK

SEQ ID NO: 15209 - protein, 56 aa, Artificial Sequence
  Synthetic
DDEKEIKDRLDDNKRKDDEMTKRAEDELRKNLETTKEALRDIKRKLDRLREKVERN

SEQ ID NO: 15210 - protein, 56 aa, Artificial Sequence
  Synthetic
REELEKIVRDLHKRNKEVIDDIRRLIDELHKRDRETIKRLEEIVRRADEKIKEKAR

SEQ ID NO: 15211 - protein, 56 aa, Artificial Sequence
  Synthetic
SDEERIEERLKRNEETDKRATDENEKRNDDLLRRAKEALDRNRERNDELRDKVRKE

SEQ ID NO: 15212 - protein, 56 aa, Artificial Sequence
  Synthetic
REELSKLVKELHDDNREKIKDSDRSDDDIRREIERMIRETNKSDEDIARAIDESAR

SEQ ID NO: 15213 - protein, 57 aa, Artificial Sequence
  Synthetic
SERERVEERLKELAKRVEDAIRRLKKDLERTKEEHKEADRRVKEKLKRLKEEVDRAN

SEQ ID NO: 15214 - protein, 56 aa, Artificial Sequence
  Synthetic
DTEVEELLKDVKRKIEEMIKELKRLNDELNKRSEEMIRRNDDLIKRLEEEIRKDSK

SEQ ID NO: 15215 - protein, 59 aa, Artificial Sequence
  Synthetic
SSEDEVRKTVDELRERSERTIRDLERVDRELKKEHEELIKELREIVKELREKVKRASKE

SEQ ID NO: 15216 - protein, 55 aa, Artificial Sequence
  Synthetic
KRIEEELRKLHKENKEAVERSERTNRDILRRNDEADKEIEKELRELIEKLERDRK

SEQ ID NO: 15217 - protein, 57 aa, Artificial Sequence
  Synthetic
SEKEDLKEKLKRNEEEHRRAVEEIRKRLDENRRRHEKVIKEIEDALKKDEDDVDKEN

SEQ ID NO: 15218 - protein, 56 aa, Artificial Sequence
  Synthetic
KDELTREIEKLHRTNREMVRDLRETLKRLHEENKRLVDELRRLLEELHRRTREASR

SEQ ID NO: 15219 - protein, 57 aa, Artificial Sequence
  Synthetic
SEEEEVRKALERLRRELKRVLERSEELLKEWEDRLRRVLEESRRLLERWREELEKDG

SEQ ID NO: 15220 - protein, 56 aa, Artificial Sequence
  Synthetic
REELKEILKRLEDTLREIEKEAKRLNDELARVLEEIRRKSERENRRLKELIDRLRK

SEQ ID NO: 15221 - protein, 57 aa, Artificial Sequence
  Synthetic
SDRERLEEMLKRLKEELEKVRRDNERSLEEIKRSVDRVLEEHKRTLEELKREVDRAN

SEQ ID NO: 15222 - protein, 56 aa, Artificial Sequence
  Synthetic
GEEADEVVKRLADVLEKAREDLKRSDKRLRDSNRESRKELEKINRDLRRKLEEAKR

SEQ ID NO: 15223 - protein, 57 aa, Artificial Sequence
  Synthetic
KDEERLETVLREIETRAEKVARDHRDSLRRIREELERVLKENKDTLKRIREELEKTN

SEQ ID NO: 15224 - protein, 55 aa, Artificial Sequence
  Synthetic
EEVKRVLKELRDLLEEIRKRLEDINRDLKRKLDEIEEELRRSDEKLKRDLEEARK

SEQ ID NO: 15225 - protein, 56 aa, Artificial Sequence
  Synthetic
SDEDKLREDLRRLEEELKKVLDDHRKSLKEIEDSLRRVLEENKRTLEKLKRDAEKA

SEQ ID NO: 15226 - protein, 56 aa, Artificial Sequence
  Synthetic
GEEAKKVVKALEDVLREIRERLKRINDELRERNKKSSDELRKSDERLKRELDKMRK

SEQ ID NO: 15227 - protein, 59 aa, Artificial Sequence
  Synthetic
DADKELEKLLREWEKRSEELRKRLEDINRRWEEESKRLKKELKDINADLRRKVEELRRD

SEQ ID NO: 15228 - protein, 59 aa, Artificial Sequence
  Synthetic
SDVIRRAKEELDRIEKKDRDVLDDNRRLIETWRREDKKVNDDNRRSNEELKRELDKTRE

SEQ ID NO: 15229 - protein, 59 aa, Artificial Sequence
  Synthetic
SAEEELKELLERWDRDSKRAEEELRRLLEESRERSEKVLRDLKRLLDEMEDAVRKLKRD

SEQ ID NO: 15230 - protein, 59 aa, Artificial Sequence
  Synthetic
SEVIERFKDVLRRIEKRNKEVIDRAKEVIDEDEKRNREVIERVERKVERLRKEVEDREK

SEQ ID NO: 15231 - protein, 63 aa, Artificial Sequence
  Synthetic
EEKERMREVLKRLEEEAKKVLDDNRRAVEEIEKKDREVHKRNRDLLERWREEMEEILRKARER

SEQ ID NO: 15232 - protein, 56 aa, Artificial Sequence
  Synthetic
EEELKKIIERAREELEKVRRELEEHLKRWDEISKKLSKDLERHNEEVARTLKRSRD

SEQ ID NO: 15233 - protein, 60 aa, Artificial Sequence
  Synthetic
SVLEEFKKRIEELHRRDRKVLEDHRRRLKEWEEELKRVLDEHRESLKRIKERVDRVKKDL

SEQ ID NO: 15234 - protein, 56 aa, Artificial Sequence
  Synthetic
SDALRELLREWDKLSKELEKELRDLNREVERSIREAKKKLEKANEEMRRTLEKDRK

SEQ ID NO: 15235 - protein, 60 aa, Artificial Sequence
  Synthetic
STEEDAERALEELKEELRRVEKENRDSLKRIREKLKEVEDEHRKTLEELKKELDDVMRKI

SEQ ID NO: 15236 - protein, 56 aa, Artificial Sequence
  Synthetic
KDSLKRLLDEARKKLEELKRRLEKLDRDLDESLKRLKEDLDRLDRELRRLLDELDK

SEQ ID NO: 15237 - protein, 60 aa, Artificial Sequence
  Synthetic
SVEEEARKALDDLRRRLEEVTRRHRESLKELREELDEVRKENEKSLKKIKDDLEAVRRRI

SEQ ID NO: 15238 - protein, 56 aa, Artificial Sequence
  Synthetic
EEELRRLLKKLEDDLRRLKKRLDELDRRLRELVKRLLEDLKRLDDELKKLLEETER

SEQ ID NO: 15239 - protein, 57 aa, Artificial Sequence
  Synthetic
SAEEELKRLLEEHKKESEDVKRRLRDLLRELEDIHRRMTERLRELLKRLDDILRRRN

SEQ ID NO: 15240 - protein, 55 aa, Artificial Sequence
  Synthetic
EEILKKLEEISRRVREKVKKELDELKELIRRHARKLEKILEEIRRLIEDLERRAR

SEQ ID NO: 15241 - protein, 61 aa, Artificial Sequence
  Synthetic
SEAEEVLKRIRDILETLRREHERILKEIRELNEEFKKEVEKALRKIKRELEELEKDAEREG

SEQ ID NO: 15242 - protein, 59 aa, Artificial Sequence
  Synthetic
ERVEKKIEELLREIRKVNDEVHKRIRKLLEDHRRTVDEARRRIEELLRRLKKTLDDIDK

SEQ ID NO: 15243 - protein, 57 aa, Artificial Sequence
  Synthetic
SDKDELKRLLDDHERTSTRARESLEKLSREHRKTSREVEERLKRLVDAIRDTARRVD

SEQ ID NO: 15244 - protein, 59 aa, Artificial Sequence
  Synthetic
EEVVRRILRELRELNERAKEMLERILRKLEELNREYKKKVREILERIKELLRDLRRKAN

SEQ ID NO: 15245 - protein, 61 aa, Artificial Sequence
  Synthetic
SADDEIRKLKKEAEDILRKAREDRERLKEKNRKIDEDMRRTLKKLHEETRELEKKVRREKG

SEQ ID NO: 15246 - protein, 55 aa, Artificial Sequence
  Synthetic
EELVKEIRELLRRLEEKIEELRRRYEKKLEELKRKVDELIRRYKRKLERVAEEVK

SEQ ID NO: 15247 - protein, 60 aa, Artificial Sequence
  Synthetic
SEEEELVRRVEEKIKASEKHARELVEETRKKLDESRKKWKDLARRSRRLLEELKDKVDKG

SEQ ID NO: 15248 - protein, 55 aa, Artificial Sequence
  Synthetic
EELRRLEKELRDLNKRVKEESRKLEEDLKDIHERAKEDSKRLKRELEKIKEEVER

SEQ ID NO: 15249 - protein, 59 aa, Artificial Sequence
  Synthetic
DAERILRELEERLKRLLDEHREISKELRKRNKDLLKEHKERSKRVKEELKELVKEVEDG

SEQ ID NO: 15250 - protein, 56 aa, Artificial Sequence
  Synthetic
IEELVKEVEKLIKELREKSREVEREVDKMIRDNARKSEKIVRDAKRLLEKLEREVR

SEQ ID NO: 15251 - protein, 59 aa, Artificial Sequence
  Synthetic
RSEDILRELRERVKRSEERHEKISRDLERKNRELLKEHRERSEKLKRELEELVKRVEDR

SEQ ID NO: 15252 - protein, 56 aa, Artificial Sequence
  Synthetic
AEDLARRVDETIKDHERHSEEVKRDVTEKIKENEKLSRDIVRRVEKLLRDLEREVR

SEQ ID NO: 15253 - protein, 59 aa, Artificial Sequence
  Synthetic
SREDILRDLRRRLEELLRRHKRISDELRKRNKKLLDDAEKRAKELREELEKLVREAERR

SEQ ID NO: 15254 - protein, 56 aa, Artificial Sequence
  Synthetic
IEELVKRVDKLIKELKRKSEEVMKRVDELIRRNERLIREIVKEVEKLLEDLEREVR

SEQ ID NO: 15255 - protein, 59 aa, Artificial Sequence
  Synthetic
SAEETIERLKEEIEKLLREAEEILRRLRERNRRLLEEHKDISRKLEEELRKLMEKVRRG

SEQ ID NO: 15256 - protein, 56 aa, Artificial Sequence
  Synthetic
VEELVRRVRELIKRLRDMAKEIEERVDETIRRNRRLSEKVARDVERLLRELEERVR

SEQ ID NO: 15257 - protein, 59 aa, Artificial Sequence
  Synthetic
DAERILKELEERLDRLSEEAKKILDELRRENEELLREHDERVKKLKEDLKRLEKKVEDG

SEQ ID NO: 15258 - protein, 56 aa, Artificial Sequence
  Synthetic
VEELVKRVTKLIEDLRRLAKKISDEVRKLIEENRRASKRVEDEARELLKRLEDAVR

SEQ ID NO: 15259 - protein, 56 aa, Artificial Sequence
  Synthetic
SEIEKMVKDVRDLLKRLKDEVKKISERWEDSLRKLKKRSEDTVKRVKEILEELRRR

SEQ ID NO: 15260 - protein, 56 aa, Artificial Sequence
  Synthetic
RDALRELERELDKLRKEIKKELDRLRKENREVNERHKELSKRLEEELERVKRELDT

SEQ ID NO: 15261 - protein, 57 aa, Artificial Sequence
  Synthetic
DEVRELVKTVKKVLDDIRREVEETLRRYEKLVEDLKRRSDKSVKDVDDEIKRAEEEG

SEQ ID NO: 15262 - protein, 56 aa, Artificial Sequence
  Synthetic
EELIKRLREEAEKLIRRAKEEHERLEEESKRLLEENEELLDRLDKKVRTLLDKLEK

SEQ ID NO: 15263 - protein, 60 aa, Artificial Sequence
  Synthetic
SEEDRVRETVKKLLEDHRRKTEKVTEDVRRLLKENREKVEDAVDKARKLLKRLEELRREG

SEQ ID NO: 15264 - protein, 55 aa, Artificial Sequence
  Synthetic
EKLKRIEEELRKSRERTKRLLEEIRKELEDSKKEVEDLLRRLREELKRLKDEIER

SEQ ID NO: 15265 - protein, 63 aa, Artificial Sequence
  Synthetic
SEVEELVKRAEELIRELKKLSEDSVRELEKLLDEYRKTTEKLKRELEELLKEVEDVVRKLRDQ

SEQ ID NO: 15266 - protein, 56 aa, Artificial Sequence
  Synthetic
EKLLRKIEEDVRRLKETNERLLKRVDEELKRLDEESRRVLKEAKERLKELKDRERK

SEQ ID NO: 15267 - protein, 57 aa, Artificial Sequence
  Synthetic
DEVEKVLDELEKVIREVEERIKTTNKRLREVVERVERRIDKSDRELEEMIERVERKL

SEQ ID NO: 15268 - protein, 56 aa, Artificial Sequence
  Synthetic
SEEVRKEVRRLDKRVKEIVEESRKLVKELAERVEEIVEESKRLVEKLAREVDETRR

SEQ ID NO: 15269 - protein, 57 aa, Artificial Sequence
  Synthetic
SEIEKALKEAREAIEDAKKKIDDTDRENEKASRDAERRIDKSDKEAEEAVRRAEEEA

SEQ ID NO: 15270 - protein, 56 aa, Artificial Sequence
  Synthetic
KDEVTKAARKAADDAREAAERSRKLAEENARRAKKAADDSRKLARELAKEAKKAAD

SEQ ID NO: 15271 - protein, 57 aa, Artificial Sequence
  Synthetic
KELEDVLDTVRRAIERVKRESKKINDELEKELKKVKDELDKSHEEVRRAVEDVARKL

SEQ ID NO: 15272 - protein, 56 aa, Artificial Sequence
  Synthetic
VKDIEKLVRDVVRRAEKVVDDDRKLVRDIVRDAKRVVRDSERTVRDIVKKADENTK

SEQ ID NO: 15273 - protein, 57 aa, Artificial Sequence
  Synthetic
SKLEKILKDLERAVREVARELERTHRELEEAVKKVKKRLEDTNRRLTEALKRVKDKL

SEQ ID NO: 15274 - protein, 56 aa, Artificial Sequence
  Synthetic
VSEIKKLVDDIVRRLRKVVKDSEREVREIMKRADDVVRTSEKTVEDIVKEAEDDAR

SEQ ID NO: 15275 - protein, 57 aa, Artificial Sequence
  Synthetic
SELEEAAKRAREAAKKAKEALKRSLKEAEDAAREAEEDLKRSNDKNRKATREAEERA

SEQ ID NO: 15276 - protein, 56 aa, Artificial Sequence
  Synthetic
AEEAKKAADDLARKAKEAADESKRLSEELAKKAKEAAKTSDKLAKENAEEAKKAAK

SEQ ID NO: 15277 - protein, 57 aa, Artificial Sequence
  Synthetic
DELERVLEDLKRVMEEVERKLRESNKELEKAVRRVEELLKRSNEKNRKVTREVREKA

SEQ ID NO: 15278 - protein, 56 aa, Artificial Sequence
  Synthetic
AKDVEDLVRRLMEKLERIVEESERLSDELRRRAEEVVKTSEDLVRENAKRVDDAAK

SEQ ID NO: 15279 - protein, 57 aa, Artificial Sequence
  Synthetic
DELEEIEKKLRDVVREVEEKLRETNRRLREVVKRVEERLKKSNEDLRRAVRKVEESV

SEQ ID NO: 15280 - protein, 56 aa, Artificial Sequence
  Synthetic
AKDVEKLVKELMEEAEKIVEESRERVDRLMKRLDDIVRESERLSKELADRADEVEK

SEQ ID NO: 15281 - protein, 58 aa, Artificial Sequence
  Synthetic
RELEEILRTLEEMIERVKEKHERSKRELEKVITEVKEELRRSNEELRRVIEEVERKLG

SEQ ID NO: 15282 - protein, 56 aa, Artificial Sequence
  Synthetic
VDEVRKVVEDIVREAEKSVRENEELVKAIMRELKRVVKEAEELSEEIVRRLEERTR

SEQ ID NO: 15283 - protein, 61 aa, Artificial Sequence
  Synthetic
KELEDVKRRLEKVHRDVNEASKEIVTRLREVHKRANDESKKIIERLDTVLREVARRLADRR

SEQ ID NO: 15284 - protein, 56 aa, Artificial Sequence
  Synthetic
AEEVERRVRELEKDVRRLVEDIRRLVEELMRNAKEIVDTAEKLVRELERKLEEVVR

SEQ ID NO: 15285 - protein, 61 aa, Artificial Sequence
  Synthetic
DEVEDIIRRLEKFHREVNEESKRIIEELERVHREVNRKSEEIVRKLEKVLDEVREKAKRRS

SEQ ID NO: 15286 - protein, 56 aa, Artificial Sequence
  Synthetic
AEEVEEVVRRLVRHAEAVVERIERLVEELVRNAEKLVEEVKRKADRLVEEADRTVR

SEQ ID NO: 15287 - protein, 57 aa, Artificial Sequence
  Synthetic
DELEEVKRRLDEVNKRVEDEHRRVEEELRKVLEDVAREHEEVIKELERVLEKVRRAK

SEQ ID NO: 15288 - protein, 56 aa, Artificial Sequence
  Synthetic
SDEARKLVKENERRVEETVRRSEKLVRDAMKKAKDTVRRSAELVKELMDRVERVVR

SEQ ID NO: 15289 - protein, 57 aa, Artificial Sequence
  Synthetic
SEVEKVKKEAREMLKRVTDLLKEVNDRLKEVNKRVREEIRRVIERVREVLKRVAREV

SEQ ID NO: 15290 - protein, 56 aa, Artificial Sequence
  Synthetic
LEDLRRVVEELEKRARDVVEESRRLVDEDRKHVEDVVRRVRDVVRELEERAERITR

SEQ ID NO: 15291 - protein, 59 aa, Artificial Sequence
  Synthetic
SEVEKVVEENKKSVKTVRERVTELVKRNRDSVEEVKRRAEEMVRRNRKSVEEVRELLAR

SEQ ID NO: 15292 - protein, 59 aa, Artificial Sequence
  Synthetic
EEAKRRVDRVSEELEEVLRRVEEELRRVSKDLRRVLDEVKKEVDRVSEDLERVLRKDTT

SEQ ID NO: 15293 - protein, 60 aa, Artificial Sequence
  Synthetic
DEVDEIVRRIEEIVRESEEMAERIVRDIKRVVEKSRKDVEDNVDELRKIVEKVEETAKRT

SEQ ID NO: 15294 - protein, 59 aa, Artificial Sequence
  Synthetic
RDAERKVRDLLRDLERVNTEADEKSKKLIKELEKVNKEAEDKSRKLIKELEDVLREARR

SEQ ID NO: 15295 - protein, 60 aa, Artificial Sequence
  Synthetic
SSVDEIVKEAEKVVEDSREEAREIVERAEEIVRDSARKVDENVRRLEEIVRKVKEVADRT

SEQ ID NO: 15296 - protein, 59 aa, Artificial Sequence
  Synthetic
RDAERKVREVIERLKKVNDEVRKKLDELTRRLEDVNRKANERSTDLVRKLRRVLEEARR

SEQ ID NO: 15297 - protein, 59 aa, Artificial Sequence
  Synthetic
SADRKIEEMRKEIKRSTDEARRLVEELIRKIERSNEKVKRDVEKLIEDIRRVIRRVRED

SEQ ID NO: 15298 - protein, 55 aa, Artificial Sequence
  Synthetic
EELKKKLEDIVREDEKLVEELTRLAEDIVRRDTKLVRELLERAKRVVDRVREEVK

SEQ ID NO: 15299 - protein, 60 aa, Artificial Sequence
  Synthetic
DAEELVRELEERIKRSHERLEELLREVKRLIERSHEELKRLNEEVLRELDRVLDEVRKRK

SEQ ID NO: 15300 - protein, 55 aa, Artificial Sequence
  Synthetic
KDVVRELERIVKENSELAERVFREVEKIVRENTKLAEDSVRELKRLVEELKKRVK

SEQ ID NO: 15301 - protein, 59 aa, Artificial Sequence
  Synthetic
SDVEDVVRKLRELVKTNLKKVEDRVRKLKEEVEENVRRAEKIVRELEEEVERLLKLVAD

SEQ ID NO: 15302 - protein, 56 aa, Artificial Sequence
  Synthetic
REVAEEVERRLERSHRESRKLADEVRRALEKSNRKTRELLRRVDERVEEVREELDR

SEQ ID NO: 15303 - protein, 59 aa, Artificial Sequence
  Synthetic
SMEELVDKVEKELEESSRRSKELLDEVRRLLEESNKKTEDLLREVEELLKDVEREAEEK

SEQ ID NO: 15304 - protein, 53 aa, Artificial Sequence
  Synthetic
VVRDVERLVEENRERVKRIADEMRKLVKENEDRARDVVRRLRELVKRLRERVE

SEQ ID NO: 15305 - protein, 59 aa, Artificial Sequence
  Synthetic
KELEDIARDLERLLRENKKLIKEIVDRLRRLLEDNTRKVKKIVDEVKKLLDDLDKLRKD

SEQ ID NO: 15306 - protein, 56 aa, Artificial Sequence
  Synthetic
KEVADKVREDLERSNDEMRRVIEKIREDLRRSLKEAKERLDEIKERIDRLLDAARK

SEQ ID NO: 15307 - protein, 60 aa, Artificial Sequence
  Synthetic
KLEELLTEVRRRIEEVSRDLERVLREVEEDIKRTSDELDRVNRKVETEIKEVTERAEEKG

SEQ ID NO: 15308 - protein, 59 aa, Artificial Sequence
  Synthetic
EELVREVIERLKELVKKDKKLVEDVLRELKRLVDEDRKLVEDSLRRAKEIVDRARERVK

SEQ ID NO: 15309 - protein, 60 aa, Artificial Sequence
  Synthetic
SIEDVLREVERLLREVIERNRKVHEEVNERSREVERELKRVHDEANRESEEVIREAKRKG

SEQ ID NO: 15310 - protein, 56 aa, Artificial Sequence
  Synthetic
VEELERRAREIVKRVRELVDTHRENLERIVERAKELIKELEENLRDIVREIRERVR

SEQ ID NO: 15311 - protein, 58 aa, Artificial Sequence
  Synthetic
KEVEEVADRSRRVVEESKRRLDDVVRRVKEDSDRLRRDIERMVKRIKEIVKRVREEIG

SEQ ID NO: 15312 - protein, 56 aa, Artificial Sequence
  Synthetic
RKILKELLDRDRKSVKESEDEVKRLLDSNHELSRRIREELKRLLEKVKELVDRVRT

SEQ ID NO: 15313 - protein, 58 aa, Artificial Sequence
  Synthetic
KEVEDVKRKLEKIARDSEEALRRVVDELRKIVTESKKKLDKAVKEVKDDSKRVEETIG

SEQ ID NO: 15314 - protein, 56 aa, Artificial Sequence
  Synthetic
RDIMRKLLEEVKRSIDESKKRVKELVDEVRDSVRRSEEEVERLLRSNHRLSDEVRK

SEQ ID NO: 15315 - protein, 58 aa, Artificial Sequence
  Synthetic
DDVERVIEEVKRVVDDSKRRAEEVVEESRKIVTDSERKVREMVRDVRRIVKEVEERIG

SEQ ID NO: 15316 - protein, 56 aa, Artificial Sequence
  Synthetic
RRIVKKLLEDVRKSVKESKDTVDKLVEENKRSVDRSLRELEKLLKEVEDLIREVTR

SEQ ID NO: 15317 - protein, 58 aa, Artificial Sequence
  Synthetic
DEVDEVVKRSRDVVTESEKRLRDVVRRSKEIAEDSRRRVREVVERLKEIVREVEERIG

SEQ ID NO: 15318 - protein, 56 aa, Artificial Sequence
  Synthetic
RRVVEELLRRDEKSVEDSLRRVEKLVEDNRKTSEDIEREVRRLEEEVRKLVEDVTK

SEQ ID NO: 15319 - protein, 58 aa, Artificial Sequence
  Synthetic
REVDEVVERMKELVATVKRENDEVVKELKKLVKELEDDNRRVVEESKKSVEDLARRVG

SEQ ID NO: 15320 - protein, 56 aa, Artificial Sequence
  Synthetic
RDLVREVEKRVRDIVEESRKLAEETRKKVEDIIEKSKRIAEDTLEKNKEMVERLER

SEQ ID NO: 15321 - protein, 59 aa, Artificial Sequence
  Synthetic
REDELVERLVDKVRRSSKEVRDRAEEMVRRNEKLVRDVEEDLDRLVEENKKLVDSVSRL

SEQ ID NO: 15322 - protein, 55 aa, Artificial Sequence
  Synthetic
KEVVDRLRELVERSEKDVRKVVEEDKRITDKLEKRVREVVKRNEEITDELRERVR

SEQ ID NO: 15323 - protein, 60 aa, Artificial Sequence
  Synthetic
SSIERVAKLVEEVERHVRKSIKDVEKLVRDVERHIEESVKTVSKLVEDVKRAVEELRRKV

SEQ ID NO: 15324 - protein, 62 aa, Artificial Sequence
  Synthetic
EDVERLVREVVKRLEEIVERSERLVREVEERLKEIVERSRRLSKENEDELRKIEKEVRDRVK

SEQ ID NO: 15325 - protein, 55 aa, Artificial Sequence
  Synthetic
KDVEDAERRLKELLDRLKRFVEESVKTSKKIVDDSKRVVEESAKRSRDIVREVKD

SEQ ID NO: 15326 - protein, 56 aa, Artificial Sequence
  Synthetic
REKIEELVKEVDKLIKDVVRRMEKLNREVKKSADDSAREVEELNRRVREVVERVRT

SEQ ID NO: 15327 - protein, 57 aa, Artificial Sequence
  Synthetic
DEVEEVEKELRELVKRSEEVAREVKDRLRKLVEESERVVRESRRKSREIVEEIRKKV

SEQ ID NO: 15328 - protein, 56 aa, Artificial Sequence
  Synthetic
KDEARRLVEEVKRSVEKSVKELEDLVEEVKRSVEESVKEAKELNDRVDETVKRRAT

SEQ ID NO: 15329 - protein, 57 aa, Artificial Sequence
  Synthetic
RSVDEVEKELRELVERITRFVEKSVRDSRKIVEDSKREVEKVKDDLRKIVEEIRRKV

SEQ ID NO: 15330 - protein, 56 aa, Artificial Sequence
  Synthetic
EEDAKRLVKEVAELIKRVVEEMKKLNDEVEESARRSVEEARRLVEEVKRLVDEVAT

SEQ ID NO: 15331 - protein, 59 aa, Artificial Sequence
  Synthetic
EVEELVERVLRELERLVRENKESSDRIKEELRKLVEDNEKSVRDTKRTAEKLVDDLRRK

SEQ ID NO: 15332 - protein, 59 aa, Artificial Sequence
  Synthetic
ERVVRKVREDVKRVERLSKEIVDDSKREVEKVVETSRRIAEKSTDVVRRVKRELEEITR

SEQ ID NO: 15333 - protein, 59 aa, Artificial Sequence
  Synthetic
SMKELIKRVKDLVDEVRKKVERLIEEVSKLVDDVKRHIRELIETVKRLVKEVADLLRAG

SEQ ID NO: 15334 - protein, 59 aa, Artificial Sequence
  Synthetic
EEARRLVEKVERDLKDIVRRVEELSRRNVERLKEIVKESRELVKEVVERLKRIAEEVTT

SEQ ID NO: 15335 - protein, 56 aa, Artificial Sequence
  Synthetic
KEKEDVKRRLEELIRRLEEHSKKVKRDLERVIKELDDEVRRVKERHEDVIRRLKDR

SEQ ID NO: 15336 - protein, 55 aa, Artificial Sequence
  Synthetic
DDVVRRVKELLRRVLEHTRKVVEDVRRLLKRIREKLEEISRKLDELLRRIEEKRR

SEQ ID NO: 15337 - protein, 58 aa, Artificial Sequence
  Synthetic
DREDEVRKDIERIERELRRVVDELRKEVEDSMRKLDEEVKRLEEHIRESVERLEERVS

SEQ ID NO: 15338 - protein, 55 aa, Artificial Sequence
  Synthetic
EKVLRDLKRVVDEVRKELKDVLDRHNKVVREVERKLEEVIDKHRKAVEKVKRDAK

SEQ ID NO: 15339 - protein, 59 aa, Artificial Sequence
  Synthetic
SREEELKKEVERLVREAEKHVEDNRKHVEDSVRELEKLVKELADKARESADRLDKKVKE

SEQ ID NO: 15340 - protein, 55 aa, Artificial Sequence
  Synthetic
ERVLEELKRVVDDIRKKHKDILKRHRDVVRKVEKELRDILREHNEVIREVKDKLE

SEQ ID NO: 15341 - protein, 60 aa, Artificial Sequence
  Synthetic
SEVERILKEAKRRLDEVVERLRKSAETLRRMLERVSRELKKSHDELDRVLRRVEDALRKR

SEQ ID NO: 15342 - protein, 56 aa, Artificial Sequence
  Synthetic
AEELRKEVEDMVRDLERLVREHSDRVRKIVTDLDRLVKEHNEEVRKIVERLDEEVK

SEQ ID NO: 15343 - protein, 60 aa, Artificial Sequence
  Synthetic
SELDEILERLKEVLERVKRKLEESNRRLEEVLDRVLKKLTESVKRLEDELRRVLKELREN

SEQ ID NO: 15344 - protein, 56 aa, Artificial Sequence
  Synthetic
IEEIKKDVERIVRELEDLVRRHEKRVEDIVRELEKIVRDHNERLKEIVRRAEEDVR

SEQ ID NO: 15345 - protein, 60 aa, Artificial Sequence
  Synthetic
RELEEILKRLEEVLERVLRELRKSVERLRKELERVLKELRDSNRKLDKVLREVLEELRKK

SEQ ID NO: 15346 - protein, 56 aa, Artificial Sequence
  Synthetic
AEDLERRVKEIERRLKRLVDEHNRRLREIVRELEEIVKRHKERVEEIVRELKRRVD

SEQ ID NO: 15347 - protein, 60 aa, Artificial Sequence
  Synthetic
SELDDIVRRLDEMLKRVEDELRKSDERLDELLKRVKKELEKSNRDLERALREVLKELEDR

SEQ ID NO: 15348 - protein, 56 aa, Artificial Sequence
  Synthetic
ARELEEEVERIVRELEKLVEEHKEELERLARKLEEIVRRHEERVRRIVKELEDRVK

SEQ ID NO: 15349 - protein, 60 aa, Artificial Sequence
  Synthetic
RELDEILRRLREELKRVREELEKSLKRLEDELRKVEEDLRESNERLERMLERVLRELRKR

SEQ ID NO: 15350 - protein, 56 aa, Artificial Sequence
  Synthetic
VDELRKELEKIAREAREYVKRNKDDLRRIVEELRKIVKKHKDKVEEDVRRLKKDVD

SEQ ID NO: 15351 - protein, 56 aa, Artificial Sequence
  Synthetic
RELEEILKKLEEVVRTVEELHKRTNEKLEKAVDEVRELHRKTNEDLKRAVDEVEKA

SEQ ID NO: 15352 - protein, 56 aa, Artificial Sequence
  Synthetic
KDRLDEEVKRLVEEARRSVEDDDRNIRRLVEEAKDSVRRDEETIKKLVDELREATR

SEQ ID NO: 15353 - protein, 56 aa, Artificial Sequence
  Synthetic
SDLERILKRLREVIKRAEELHRKTNEEDERVVREVIELHRKTNEDLREVIERVARG

SEQ ID NO: 15354 - protein, 56 aa, Artificial Sequence
  Synthetic
KEELRKAVEELEEKLERSVREDKKTSDDSARRAKKSVEDDRRTIEKLVEEAERSRK

SEQ ID NO: 15355 - protein, 61 aa, Artificial Sequence
  Synthetic
KDLEKLLDDIRKVLEEVTRRLKRISDELRRVLEEIKKRLDKDNEDLKRVIDEVKKLLDKKV

SEQ ID NO: 15356 - protein, 56 aa, Artificial Sequence
  Synthetic
REEIEKEIRDVEEELRRAVEENAELVKRVKEDAERVVRDSEKKSKEVAEELKDAVR

SEQ ID NO: 15357 - protein, 57 aa, Artificial Sequence
  Synthetic
SELEKILKELKDASREVEKRLRDILREDKKMLKKVVEELEEILRRLDEEVKKVKERL

SEQ ID NO: 15358 - protein, 60 aa, Artificial Sequence
  Synthetic
REEVVDRAKKEVDDHVKKAEDVVREVEKRSRESVKRLRDIVEELERLVKRLVDEAEREVK

SEQ ID NO: 15359 - protein, 60 aa, Artificial Sequence
  Synthetic
SETEKLLEEVRRIIEEIKKRIDRSLEEVRRSVEEAKRRIEKSLEDVEKSVRRVKKILDEG

SEQ ID NO: 15360 - protein, 56 aa, Artificial Sequence
  Synthetic
DRVLKEVEDLAREVKKRIDEVDKRVAELHKEVEDRLREVDKTVEELHRRVKKRADD

SEQ ID NO: 15361 - protein, 60 aa, Artificial Sequence
  Synthetic
SIEDVEREVKRLIERTKRHNDRVLETIRRLLEETKKHNEKVLREIRELIKRVEDTMRRRG

SEQ ID NO: 15362 - protein, 59 aa, Artificial Sequence
  Synthetic
EETIKRLLDEVREYVRKSEEDSERLLRDVERYVKESKERSERILKEARRLVKEVEDKIR

SEQ ID NO: 15363 - protein, 59 aa, Artificial Sequence
  Synthetic
SIEEVLEEVRDLLRKTKEDTKRILDEIRRLLEETKKRLEEVLREATKLLREVEDLVRKS

SEQ ID NO: 15364 - protein, 59 aa, Artificial Sequence
  Synthetic
EEEVKRLLEKARKLVEESKRESKEILDRARKYVKESLEEIERLLDELRKLIEELRRRIE

SEQ ID NO: 15365 - protein, 59 aa, Artificial Sequence
  Synthetic
SSEEILKEVKELIEESNRASEEVLKEVKKLLDESKKRSDEVLEEVERELKRLEESASRI

SEQ ID NO: 15366 - protein, 53 aa, Artificial Sequence
  Synthetic
VVREMRRLVEEDKRRIKEALDRLRKLVEDDKRRIEEVLREMRELIRELEERIR

SEQ ID NO: 15367 - protein, 61 aa, Artificial Sequence
  Synthetic
KEIEDILERLKETIKEIEDHIRRDLEELKKVIEELKRSLEEWKKRAERLIEELERLIRETG

SEQ ID NO: 15368 - protein, 56 aa, Artificial Sequence
  Synthetic
ERVLREAEERIRRLEEKLKEVNKRSEEMLRRLKEEHERVLREVKELIREIDDKARK

SEQ ID NO: 15369 - protein, 59 aa, Artificial Sequence
  Synthetic
GEDEVLRKVEKLLREVKERAEKSVERVERLLKDVEDKLKESHDRAKRLLEEVKKAADRG

SEQ ID NO: 15370 - protein, 56 aa, Artificial Sequence
  Synthetic
LKDLDRRIEEVVKRLEDEVRRHTKEVEEMVKRLRELVREHTERVKKIVEDLKREVD

SEQ ID NO: 15371 - protein, 59 aa, Artificial Sequence
  Synthetic
SEVEDVERRIREIIERLRRIVERHKEEVKKIIEKLEKLVRDHTERAKRIIERLKEVVDR

SEQ ID NO: 15372 - protein, 56 aa, Artificial Sequence
  Synthetic
EEVLKEVERLLEEVKELVERSHKEAEDLLKRVLDAMKRSVDEVEKLLEELKRRADK

SEQ ID NO: 15373 - protein, 59 aa, Artificial Sequence
  Synthetic
SKVEKVEEDIDKIIRRLEELVEEHRTEAEKTVKKLDDDVRRHNEKVEKIIRDLEEVVRR

SEQ ID NO: 15374 - protein, 56 aa, Artificial Sequence
  Synthetic
RKVLEDAKRLLERVMDEVRRSNEELKKLLEEVKRKLKKSVEDAERLLDEVRKRVEK

SEQ ID NO: 15375 - protein, 59 aa, Artificial Sequence
  Synthetic
SEVEEVDKRIREIVTTLKRLVEEHNDRARKIIEKLRRLVKKHEDEVEEIVRRLDEAVER

SEQ ID NO: 15376 - protein, 56 aa, Artificial Sequence
  Synthetic
EEVLKKVKELLKEVKRRLERSLEELERLLEEVLKLMKESNDKAKELLERVREKVER

SEQ ID NO: 15377 - protein, 57 aa, Artificial Sequence
  Synthetic
DFVERVKEEIKRIVERLKRLVKEHEDEVKRILDELRKLVETHKELSKDSLRKLEEVG

SEQ ID NO: 15378 - protein, 56 aa, Artificial Sequence
  Synthetic
ERVLEELRRLVKEVKERADRSSEKLNELLRKAEEDAKRSSEENNRRLEEVERRVRK

SEQ ID NO: 15379 - protein, 60 aa, Artificial Sequence
  Synthetic
DEERKIEEIIDKSRRDWERLLREAREIIKRSEDEWRELLERIKRLIEETRKRAKDLKKAD

SEQ ID NO: 15380 - protein, 59 aa, Artificial Sequence
  Synthetic
EEIRRLLEEMDKLSREASKRVEDILRELEERSRRMADEVRKLNEENKKLLEEAKKELKD

SEQ ID NO: 15381 - protein, 58 aa, Artificial Sequence
  Synthetic
DKEEIKEKLEELVERVVRELEKLLKELEDLSREVARRIKKIARDLEKLTKEVEEKLRR

SEQ ID NO: 15382 - protein, 56 aa, Artificial Sequence
  Synthetic
EEELERLIKELVDRARKLLEEVKKLIEDHREKLKRVLDEIKDLLRKHKETLDRTDT

SEQ ID NO: 15383 - protein, 58 aa, Artificial Sequence
  Synthetic
SKEDILRELRDRVERIKREIEKIFRDAKRLSEEVKRRIEDLLRKLKKVSDDVRERLAR

SEQ ID NO: 15384 - protein, 56 aa, Artificial Sequence
  Synthetic
EEELKELIKRLVEDAKRILEELKKLLDDHERKARRILERIEKLIKEHEDKARERER

SEQ ID NO: 15385 - protein, 60 aa, Artificial Sequence
  Synthetic
SEVEKLEEEVERSVRDLERELRDSEEKSKELMRRLDELVRRAKDHVRRSVEELRKTLSKG

SEQ ID NO: 15386 - protein, 58 aa, Artificial Sequence
  Synthetic
EEVRRILRDAERVIEEIKRRLEEDHKRLEEVIRRVEEKLRRILDEHDKVVKEIKEALR

SEQ ID NO: 15387 - protein, 60 aa, Artificial Sequence
  Synthetic
SEVEEAEKEVEDIMRRLKRKVEENKRHVDESVKEAEKLLRDSETRTRDIARRLKEELDKG

SEQ ID NO: 15388 - protein, 58 aa, Artificial Sequence
  Synthetic
KELTRILTRLREVIERVKRALEKSHDDHRRAVEEVRKELKRDHDDLRRVIEKVRRDLK

SEQ ID NO: 15389 - protein, 60 aa, Artificial Sequence
  Synthetic
SEVEEAKRRVDDIVRKLEELLKDSRRESERIMRELKRLLEELKRHVEDSVRKLREVLSRG

SEQ ID NO: 15390 - protein, 58 aa, Artificial Sequence
  Synthetic
RELREILRRAKEVIDKIREDLERDHDRLREVIEEIKKTLDRIHEEHRRVVKEVEDTLK

SEQ ID NO: 15391 - protein, 60 aa, Artificial Sequence
  Synthetic
SEVEEAEKEVREIMKELDKLLEDSKRESDDIRRDLDRVLEENKRHVDKSVTDLERVLSRG

SEQ ID NO: 15392 - protein, 58 aa, Artificial Sequence
  Synthetic
KELRRILRELEEVIKRVERTLREDHKELKRVIDRMKEDLERSHEEHERLVEEVERKLR

SEQ ID NO: 15393 - protein, 60 aa, Artificial Sequence
  Synthetic
SEVEEAKKDVERIMRELEKLVRDNKKHVDDSVRKLKKLLDDLRKHVEDSREELERVLRRG

SEQ ID NO: 15394 - protein, 58 aa, Artificial Sequence
  Synthetic
RDLRKILEDLERIIRRVEEELRRSHERHKEVVDRIKKVLDEIHRRHREVVKEVEKELR

SEQ ID NO: 15395 - protein, 60 aa, Artificial Sequence
  Synthetic
KEVEEAEDKVRRIVEDLKRKLEDLERHVEESVRRLEDLLRRSKKKSDDIMEKLTRTLSKG

SEQ ID NO: 15396 - protein, 58 aa, Artificial Sequence
  Synthetic
KELRRILKRMKDAIERVERELRRIHTRHKEAVDRVREELKRNHDELAKVIRKVREDLK

SEQ ID NO: 15397 - protein, 60 aa, Artificial Sequence
  Synthetic
DEVERADEDVERIVRELRRVLEENRRHVKESVERLERLVRKSKKDSKKIMEDLKRVLDRG

SEQ ID NO: 15398 - protein, 58 aa, Artificial Sequence
  Synthetic
TELRKILKKMKDAIREIKRTLDESHREHRRVVEEVKEELERNHKELKEVIDKVAKDLE

SEQ ID NO: 15399 - protein, 58 aa, Artificial Sequence
  Synthetic
DEVEDILRRVREAVERARESLERIHREHKKVVDEVRKALEKVLEDHARVVDEFRRKSG

SEQ ID NO: 15400 - protein, 56 aa, Artificial Sequence
  Synthetic
KDELKKEVEKLEEELKKELKRLKDHVKKSKEDLRRKLEDLKRHVERSVKRAEEEAR

SEQ ID NO: 15401 - protein, 58 aa, Artificial Sequence
  Synthetic
SEVEKVLRDLERAVKEVSERHRRNHEELRKVIKRVKEEHDRIHDEHRKVVEDLKRKIG

SEQ ID NO: 15402 - protein, 56 aa, Artificial Sequence
  Synthetic
REEIKKEVDRLKKELDENLKRLERDSERLKKELEDNLKRLEEHVRRSKEEAERDAK

SEQ ID NO: 15403 - protein, 58 aa, Artificial Sequence
  Synthetic
SDLEEVLKRLEDVVRRLEEELRRIHKEHRDVVRRVTEEHKRILEELKRVVERAREKDG

SEQ ID NO: 15404 - protein, 56 aa, Artificial Sequence
  Synthetic
RDRVTKEVRDLEEELRELLERLRAHVKRSEKKIEENLRRLEKRVEDLKKKIDDRTR

SEQ ID NO: 15405 - protein, 58 aa, Artificial Sequence
  Synthetic
RELEDIKRKHKKVVDDVREKLKESHRRLKEVIEEARRRLDEVRKKLEKVIREILTSAG

SEQ ID NO: 15406 - protein, 56 aa, Artificial Sequence
  Synthetic
IEDLKRYVEEVKRDLDDLIRRSEELVRRIKEDLDRALKELEELVRRIKKKLEEDRK

SEQ ID NO: 15407 - protein, 60 aa, Artificial Sequence
  Synthetic
SELDELRERVERHSRELRRTLEEAKKLVDDHKRTLREVLERIKKRVEDVKRELEKLVRDG

SEQ ID NO: 15408 - protein, 59 aa, Artificial Sequence
  Synthetic
REELKKIIDELRRVNEEAAKTLDEIIKRLEDVNREVNRTSKEVIDRLRKVLEEAERRTK

SEQ ID NO: 15409 - protein, 60 aa, Artificial Sequence
  Synthetic
EELDRIRKEVEDHERKLREVVKDIERKVEEHAKRLKKVIEDDERRVKEWKDTLEELIRRG

SEQ ID NO: 15410 - protein, 59 aa, Artificial Sequence
  Synthetic
KDEVRRVIKELRDVNRKVADALRKVEEKLKRVNDEMNKESKRTLDELDKALEEAERRAR

SEQ ID NO: 15411 - protein, 60 aa, Artificial Sequence
  Synthetic
DLLRELEARVRKHKRDLEEVLKKIEEEVRRHKKKLEDVLEELRRLVEDLMRELKELLEKG

SEQ ID NO: 15412 - protein, 59 aa, Artificial Sequence
  Synthetic
REELKRIIDELREVNERVNDESRKVIKELRDANKEADKKVRDIIRRLEDILRKAAEDTR

SEQ ID NO: 15413 - protein, 60 aa, Artificial Sequence
  Synthetic
KDLERLEKEVKEHKEDLERIVREAEKLVEDHERELEKVLRELEKTVRDVKRELEDLLRRG

SEQ ID NO: 15414 - protein, 59 aa, Artificial Sequence
  Synthetic
KEEVDRVLDELRKVNKKAADDLERVIRELEDVNRRVNERSREIIETLKRVLDEVREKTR

SEQ ID NO: 15415 - protein, 60 aa, Artificial Sequence
  Synthetic
DELRELKRKVDEHTRELERILKEIEDRVRRHKEKLDETVKRDKDRVDEWLRRAEELVRRG

SEQ ID NO: 15416 - protein, 59 aa, Artificial Sequence
  Synthetic
REEVEKIERRLREANKRAADALKKVIDELRRANEEVNRKSEETLKTLDKILEDVERKTR

SEQ ID NO: 15417 - protein, 60 aa, Artificial Sequence
  Synthetic
DDLERLAEEVKRHSEDLDRIVEEIRDRVRRYKEKLDEVVKEDEKRVREWRDRLEKLVRAG

SEQ ID NO: 15418 - protein, 59 aa, Artificial Sequence
  Synthetic
KDELDKIITRLEEANRKAAEDLRRVVEELRKAHEEMNRKSEKTKKDLDEVLEEAERRTR

SEQ ID NO: 15419 - protein, 60 aa, Artificial Sequence
  Synthetic
DDLERLKRRVEEYRRKLEEVLKTIEEEVRRYKKEAEKVLDEDRRRVEDWKRKLDEMVRRG

SEQ ID NO: 15420 - protein, 59 aa, Artificial Sequence
  Synthetic
EEDVRRIIDELRRVHKRANEDSKRVVDELRDVHRKVNETSEETKKRLDKVLKEAEDRTR

SEQ ID NO: 15421 - protein, 60 aa, Artificial Sequence
  Synthetic
KKLDDIRREVERLTDKLEKIVKRIKELVDRYRRKLERVLEEDDRRVKEWKRRMEELLRRG

SEQ ID NO: 15422 - protein, 59 aa, Artificial Sequence
  Synthetic
KEEVDKVLKDLDRALKKAADDLKRVIDELREVHERINRTSERTLTKLDRALEELEKRLR

SEQ ID NO: 15423 - protein, 60 aa, Artificial Sequence
  Synthetic
KELDEIRELVKRHKDKLKKIVDEVKERVDALKRKLKEILDEDRERVKKWVRDMEELVRRG

SEQ ID NO: 15424 - protein, 59 aa, Artificial Sequence
  Synthetic
KEDVDRVIRDLERVNEEANRRAKKVIDELRRVLEEAERTLRKTLEDLDRALEELARATK

SEQ ID NO: 15425 - protein, 58 aa, Artificial Sequence
  Synthetic
DEAEKILEELRKVVRELEEELRRNHEELKRVIEDVERKLRESNRRVEKVIKEVTDEKG

SEQ ID NO: 15426 - protein, 59 aa, Artificial Sequence
  Synthetic
EDVVRELEKLVEELKRRVTEVVETVARDSERLREELRRIVEESKRLVEELKRRAEEASR

SEQ ID NO: 15427 - protein, 61 aa, Artificial Sequence
  Synthetic
SELERVVEDLRRAAKKLADDLKRVIEEHRKYARDNKERLKKVLERLKRLAEELKKELERDG

SEQ ID NO: 15428 - protein, 55 aa, Artificial Sequence
  Synthetic
REVLEDVRRLIEDLERLITELRKENERVIRESEKLSRDIEREVERVIRELEETIR

SEQ ID NO: 15429 - protein, 56 aa, Artificial Sequence
  Synthetic
KEVEDVKREIDKVLEDARRLLKESDDTLKKILDKARRDLEESDRRLKEILDKVRKD

SEQ ID NO: 15430 - protein, 56 aa, Artificial Sequence
  Synthetic
FEELKDTVDKLRREIERRITESRRHVEELRRRVEEMLERSERNVREAEKKLEEDKK

SEQ ID NO: 15431 - protein, 57 aa, Artificial Sequence
  Synthetic
DEVERVEEELKKSDDELRRRMEEVKRALDKDNEDAKRMLDEVKKELEKILRKVEKEV

SEQ ID NO: 15432 - protein, 60 aa, Artificial Sequence
  Synthetic
KKEVVERLDKLVKEHHERNKRIVEEAKRLVEDSREKTRRIAERAKELVRRLKELVDRLSK

SEQ ID NO: 15433 - protein, 58 aa, Artificial Sequence
  Synthetic
DRIEDVKRKVKEIKEKVDRLLEESSKKVDDLNKKVRDLLTESNKRIEDIVRELRELAK

SEQ ID NO: 15434 - protein, 58 aa, Artificial Sequence
  Synthetic
EEAKEVLERLKRILEESRRASEENKKKLEKSHEELKRASDENKRKLERILDELREALR

SEQ ID NO: 15435 - protein, 56 aa, Artificial Sequence
  Synthetic
SAKEKIDKTLKDIYRKHEEVVRRVEKKHRDIHREHEEVVRRVEEEHRRILDELRKA

SEQ ID NO: 15436 - protein, 56 aa, Artificial Sequence
  Synthetic
EEEAKKFLDKLDKEVRDSMKRLEDHVRETKKRVEESVRRLEEHVKRTEEEVRETAT

SEQ ID NO: 15437 - protein, 56 aa, Artificial Sequence
  Synthetic
SVEDEVRRDLKRIYEKHEEAVRRVEERHERSNERLEDVIRKVEDKHREILKKLEDE

SEQ ID NO: 15438 - protein, 56 aa, Artificial Sequence
  Synthetic
EEDVKRVLDKLDEEVKDSVRELEEHVEKNERDVEEIAKDLERHVEETRKEVDKTAK

SEQ ID NO: 15439 - protein, 56 aa, Artificial Sequence
  Synthetic
KVEEKVRETLRRIYERHRKIVKEVEEKHRESNERLRREIERVKRKLDEILKKLEEA

SEQ ID NO: 15440 - protein, 56 aa, Artificial Sequence
  Synthetic
EDRVAEVLKKLKDDVDKSAEELERHVKRNRDEVRKIVEDLDRVLEELRTKVDEEAR

SEQ ID NO: 15441 - protein, 56 aa, Artificial Sequence
  Synthetic
SVEDKVRESLERIYKKHEKVLRDVERTLKEIHEEHREAVERVRRELERIKRKLEEL

SEQ ID NO: 15442 - protein, 56 aa, Artificial Sequence
  Synthetic
DKDVERVLKKLDDDVRKSVKELTDVLKRLREEVKRSVEELEDVLRKLDKEVDDTAK

SEQ ID NO: 15443 - protein, 56 aa, Artificial Sequence
  Synthetic
DVEDRIRKSLEEIYRRHETEVRKIKRKHDESHRRHEKVVREVTEDLERIKRRLEEL

SEQ ID NO: 15444 - protein, 56 aa, Artificial Sequence
  Synthetic
EEDAKRVLDELEEKVRRSVKKLREHVEENEKRVEDSVEELKRILEELRKAVDETTR

SEQ ID NO: 15445 - protein, 59 aa, Artificial Sequence
  Synthetic
SKKDEVEKLLKESERHSKKLVEDAKRLSDESKKHVEELVRRAEEELEKSDRDVKKVKDD

SEQ ID NO: 15446 - protein, 59 aa, Artificial Sequence
  Synthetic
EEVMDRVRRRLERDIRELRKALKRVEDTNEEITRELEKAMKEVKDTSDRILEKLRRARK

SEQ ID NO: 15447 - protein, 60 aa, Artificial Sequence
  Synthetic
SVKDKLKELLKDSKRNSDRLVERAKELLDRSRKHSKELEDRARKLLEDSRRKVEELERAN

SEQ ID NO: 15448 - protein, 59 aa, Artificial Sequence
  Synthetic
REVLEKARRDLERDLRENKKALDEVRRTLEEDSRRLREVLEEVKRISTKIIERLREIRR

SEQ ID NO: 15449 - protein, 56 aa, Artificial Sequence
  Synthetic
SEKEDAEKKLRDILTDLARIVREVEEALKKILDDIRKVSEESKRASDESLKRARDA

SEQ ID NO: 15450 - protein, 56 aa, Artificial Sequence
  Synthetic
GEELEELLRRLEEAVRRIAERLRKLLKELEEKARRLAEESKKLLEKDKEDVKRAAE

SEQ ID NO: 15451 - protein, 56 aa, Artificial Sequence
  Synthetic
SEKERIKEESKKSLDDLRRASERSKEELDRILKRIDEASKRSKEESDRSLKEVKDR

SEQ ID NO: 15452 - protein, 56 aa, Artificial Sequence
  Synthetic
GEELKDVLRELRETNRKLVEDSRKLLEELDRDVERLADESRKLLEDDKRKVREVAR

SEQ ID NO: 15453 - protein, 56 aa, Artificial Sequence
  Synthetic
SDEERIDELSKKSLEDLKRVSDDSKRKLDDILKKIEDASRESEDKLRRILEKARRD

SEQ ID NO: 15454 - protein, 56 aa, Artificial Sequence
  Synthetic
GRELERILEELRTDNDRLAKESDKLVKELEEEVRELIKRSETLLEELRKDVEELAK

SEQ ID NO: 15455 - protein, 57 aa, Artificial Sequence
  Synthetic
DAKERVDDALKKILDDHRRVLKKVEDDHRDSHREHRRVVEEVKRELEKVLKKLRDAG

SEQ ID NO: 15456 - protein, 56 aa, Artificial Sequence
  Synthetic
KEDLDRMLEKLREIVERSRDKLRRHLEKNKREVDDSKRRLEKMLRDLEKKVRDAER

SEQ ID NO: 15457 - protein, 57 aa, Artificial Sequence
  Synthetic
DDEERVKRKLEEVLRKHKEVVDEVIERHRRSHKRHRDMLREVDKKHRRILTELEKAG

SEQ ID NO: 15458 - protein, 56 aa, Artificial Sequence
  Synthetic
VEDLKRVLEDLDREVRESKERARKHVEDNERKVEESKKRADDNLRRLERKIREAAR

SEQ ID NO: 15459 - protein, 57 aa, Artificial Sequence
  Synthetic
SVEETVDEELKKIHETHKRVVDKVRREHEKSHKKHRDILKRVEEVHRRILTDLERAG

SEQ ID NO: 15460 - protein, 56 aa, Artificial Sequence
  Synthetic
KKDLDEMLRRLKRKVDESERDLKKHLDDNKRAVEKSREDAERNLKELRDKIREVKR

SEQ ID NO: 15461 - protein, 63 aa, Artificial Sequence
  Synthetic
REEEEARKVLEELKRDVERNERESKEILDKDKRDVEEWVKELEKMLEESKKLVDDVRKAKKDL

SEQ ID NO: 15462 - protein, 55 aa, Artificial Sequence
  Synthetic
EELKKAVEDIIRTLREVLEKSRKTLKDSNDRLRRALEKAREDSKRSIRRLREELR

SEQ ID NO: 15463 - protein, 59 aa, Artificial Sequence
  Synthetic
SVREDAKRLLEELERAVRELVERLKKLIERHRRASEDTRRELEKLLRELEKAVEELKRG

SEQ ID NO: 15464 - protein, 58 aa, Artificial Sequence
  Synthetic
KALEDVKEALDRILERVKRAIEEARKKLDDVDEHNREVIERVEKEIDRILKDVEDAAR

SEQ ID NO: 15465 - protein, 59 aa, Artificial Sequence
  Synthetic
SVEEEARELIERLRKLSEDTMRRLTELLKEHERLSRETKKEAERLLDELRKKVDDLTRD

SEQ ID NO: 15466 - protein, 58 aa, Artificial Sequence
  Synthetic
EVLERVKRELDRILDHNKKVVDEAERALRRVDKHNEDVLREVEKTLERILDKVKESAR

SEQ ID NO: 15467 - protein, 57 aa, Artificial Sequence
  Synthetic
SVEEKLEKIVRDLERRVRKSEEDLRRMVEEVERTVEKHREELKRVVDTLRKIVRDKG

SEQ ID NO: 15468 - protein, 59 aa, Artificial Sequence
  Synthetic
EKVARDIKDKVREIIRRNEEVLEEVDRRARELIERLERTIEKSERDVERIIRELRERAK

SEQ ID NO: 15469 - protein, 59 aa, Artificial Sequence
  Synthetic
SKEEEAEKLVRDLEDSSRKHKDRLRKLVRDLEELVKEHERDLKRIVEELKKLVDDASRS

SEQ ID NO: 15470 - protein, 55 aa, Artificial Sequence
  Synthetic
KELEEELRRNLKEVREVTEDAKRKLRDILRKVEDASRRVKEMLDKILKRVEEEIR

SEQ ID NO: 15471 - protein, 57 aa, Artificial Sequence
  Synthetic
KLDEDIRKLLKEALDRNKEMLERLKKTLDEALEKVKKLLEDLRRVNKEVEDELRRAG

SEQ ID NO: 15472 - protein, 59 aa, Artificial Sequence
  Synthetic
EDVLREVIRRIRKVIEDTDRTWKRLIDEIRKEVKDVLDKARRLIRESEKLMEDIKRRTK

SEQ ID NO: 15473 - protein, 56 aa, Artificial Sequence
  Synthetic
DMEKRIEKLLKDMLDRVRELHKRVREVNKEVNKRVKELHDEVRKVNEKVNKAVKDR

SEQ ID NO: 15474 - protein, 59 aa, Artificial Sequence
  Synthetic
EEVLARVIERIRKDVEKVLREAEKHIEESRRLARKVLEELRRHIEENRRLLEEVDRRRR

SEQ ID NO: 15475 - protein, 57 aa, Artificial Sequence
  Synthetic
EVEKKVEELLKRIEDDNKRVADRSRKLLRELKKRLEDVVRESRELLRRILKKLKEAG

SEQ ID NO: 15476 - protein, 56 aa, Artificial Sequence
  Synthetic
EDEVADRLRKLRKESEEVVERSDRHLKDLERRIEEMAERSRRHLKRLEDKIREDAR

SEQ ID NO: 15477 - protein, 59 aa, Artificial Sequence
  Synthetic
SMEDRVREMLRTIKRVIEEAHERSKKILDEDRKVLKAVEDAVRDVLTKIKKLLDDARRR

SEQ ID NO: 15478 - protein, 55 aa, Artificial Sequence
  Synthetic
EEVVKRAKKLLEEIEKLARESLERLRDNLRKTEKLLKDLLDEAKRLLEEIKETVD

SEQ ID NO: 15479 - protein, 60 aa, Artificial Sequence
  Synthetic
DIEEEVKKILDEIRERIKKMKRDLERLSKEDEDVLRKVKKDVDEVLKRAEESLRDVKRRG

SEQ ID NO: 15480 - protein, 55 aa, Artificial Sequence
  Synthetic
EEVLRKLEEILRDIKRKADELRKRYRENIEETERLLEELLRRAEELLRRLDETAR

SEQ ID NO: 15481 - protein, 61 aa, Artificial Sequence
  Synthetic
SEAEKLLEDIRRIIKEVKENVERSLEKIKRLIEELEKNARDLVRRIRKLIEDLERKVRRDG

SEQ ID NO: 15482 - protein, 59 aa, Artificial Sequence
  Synthetic
EKVIRDIEKLIEDLKRISEKANEDNKRLIDDMRRISKEVARTIKELIERLRKIVEEARK

SEQ ID NO: 15483 - protein, 61 aa, Artificial Sequence
  Synthetic
SEAEELLERIKKLIEDLKRDAERLLREIEEMIKDIRRHVEEDLRRLREVIKEIKRLVDERG

SEQ ID NO: 15484 - protein, 59 aa, Artificial Sequence
  Synthetic
EEVEREIRRLIEEMKRISEEVRKEIKRLIDELEEIVRRAKEALKKLNEELKRIVDEAKR

SEQ ID NO: 15485 - protein, 59 aa, Artificial Sequence
  Synthetic
SKVEEVLKRLERLIRELKRLMDEVREDNREVLERLERYAERNERENRELLKKLEDVARR

SEQ ID NO: 15486 - protein, 56 aa, Artificial Sequence
  Synthetic
KEELDKMLKTAERVLREIEKDIEKLDRDLKRVVERIRDRSRRLDEAAEEIVRRIED

SEQ ID NO: 15487 - protein, 59 aa, Artificial Sequence
  Synthetic
SKMEEVLKRLEKLLRELEEYVERNERENRKLLEELEDYVRRNEKRNKEILEELRDVVRR

SEQ ID NO: 15488 - protein, 56 aa, Artificial Sequence
  Synthetic
DEELRKALERLRRVVEKVEDISRELDDRLRRVVEKAEEISRRLDEEIKEVVDRAEK

SEQ ID NO: 15489 - protein, 59 aa, Artificial Sequence
  Synthetic
SKVEKVLDDMRRIIEEAERLLEEVKRRHDEIIERVKRYAEENRRRNEELIEDLKRVAEK

SEQ ID NO: 15490 - protein, 56 aa, Artificial Sequence
  Synthetic
KDDVRRLLEELRKVVEDVKRLSKKMNDRIEKIAKEIEEESERLDRTIAEIVKEIEK

SEQ ID NO: 15491 - protein, 59 aa, Artificial Sequence
  Synthetic
DEVEKVLEELRRLLKEDEDIVRELLKRLKELLEDIDRIAKETEKEWRKILREIEELRRK

SEQ ID NO: 15492 - protein, 59 aa, Artificial Sequence
  Synthetic
EDAEREVDRVVRTIEESTKDAREKVKRMADEIERIIKEVEDLNRKLVEEIERVIREVER

SEQ ID NO: 15493 - protein, 56 aa, Artificial Sequence
  Synthetic
DSEETLRELVKTIEDSSRKVKKRNEELARELRRRIEEAREANDRLVETIRKEIREL

SEQ ID NO: 15494 - protein, 56 aa, Artificial Sequence
  Synthetic
REELEKTARKLIEDDEKKARDTEREWEELIRDIERLVRESLEAWKRLREEIRETVR

SEQ ID NO: 15495 - protein, 56 aa, Artificial Sequence
  Synthetic
KSEEELRKLVRELEELIERMERTNEKLLRELKEVLDRARERNEELVRRLEDLIRRL

SEQ ID NO: 15496 - protein, 56 aa, Artificial Sequence
  Synthetic
EEELRKEAEDLIREIEEKVRRSKRNLEELIREIRELVERSEDEWRKLIKRIADAVK

SEQ ID NO: 15497 - protein, 56 aa, Artificial Sequence
  Synthetic
SSEETLERLLREIERVLEEARKRNEDLVRKIREVIKEALERNKRMLEEIKKEIDRL

SEQ ID NO: 15498 - protein, 56 aa, Artificial Sequence
  Synthetic
SEELLRTAKRLLEDIERIVRETLKKWRDLEREIRKLVRESTENLKRIIEEIRERAR

SEQ ID NO: 15499 - protein, 55 aa, Artificial Sequence
  Synthetic
SKVDEVIRDLARLLDELRRHVDDSVRRMDEVVKRSTREADELAKRLDELVKEVEK

SEQ ID NO: 15500 - protein, 56 aa, Artificial Sequence
  Synthetic
KEKIDRIIRELERILEEAKKKHEDVLRRLEDSLRRVAELLKAALDRLREIVDRLRR

SEQ ID NO: 15501 - protein, 55 aa, Artificial Sequence
  Synthetic
SKADDVIRKLRELLEELRTHVEKSIRDLRKMLEDSTRHAKRSIEELERLLEEVRK

SEQ ID NO: 15502 - protein, 56 aa, Artificial Sequence
  Synthetic
EEKLKDLIRKLRDILRRAAEAHKKLIDDARESLERAKREHEKLIDRLKKILEELER

SEQ ID NO: 15503 - protein, 55 aa, Artificial Sequence
  Synthetic
SKVEEVVRTLDELLKRLEEHVKESIRRIKKVIDDSNREADELIRDIDRLLKELEK

SEQ ID NO: 15504 - protein, 56 aa, Artificial Sequence
  Synthetic
KDRVERIIRELRRILEEIRDLHRKLEEELRRSLKEVEDRLRELLKKLEDILRELRR

SEQ ID NO: 15505 - protein, 59 aa, Artificial Sequence
  Synthetic
DEVEDLLRKLKDTIRRLKAHADRDLKKLEEILEKLRRHVEKNLRDLERILKELKDLSRT

SEQ ID NO: 15506 - protein, 59 aa, Artificial Sequence
  Synthetic
EEVAERVRRVIKELRKLLEEIARALEDVNKKAKEINDKADEDSKRVNDELKRIIKEIRD

SEQ ID NO: 15507 - protein, 60 aa, Artificial Sequence
  Synthetic
SEVDELRRRAEESSKKIRKIAEELTKRLKDLLETIRRLMRKIEEDMKRTSEEIKDLIRRG

SEQ ID NO: 15508 - protein, 59 aa, Artificial Sequence
  Synthetic
DRLRDVVKKLHKKNKDILDEIRDIVRRLKEEVDTILKEIKERLEELHKNNERLLREAKR

SEQ ID NO: 15509 - protein, 60 aa, Artificial Sequence
  Synthetic
SAKEKLEDLLRKLKRILDELEKTSREMKERVERIIRELEKTVREVHERIKRLIDEALKRN

SEQ ID NO: 15510 - protein, 55 aa, Artificial Sequence
  Synthetic
EELKKELEDLLRKIEKLIKESEEKWRRLLEEIKREIERLRETYAEILRDVKRRDK

SEQ ID NO: 15511 - protein, 60 aa, Artificial Sequence
  Synthetic
SAEETVRKLLEEIKEIIKRMEDRVREVLEENRKSIEDLEERVRRLHEEVERIIREALEDL

SEQ ID NO: 15512 - protein, 55 aa, Artificial Sequence
  Synthetic
DEVKRELKRILEEIEKLIEELLRRMKESNKKIRKLAEDLTREYKRLLDEIRKRRK

SEQ ID NO: 15513 - protein, 55 aa, Artificial Sequence
  Synthetic
REVEEVVKRAEEVIRRLEKEVEDIVRRVAKHLKDNEDHARRSVERLRRDIEELKK

SEQ ID NO: 15514 - protein, 56 aa, Artificial Sequence
  Synthetic
DELVKEVKKKIDDVLKKAEDLARKLKKEHDEVVARITEAHDEVKKRVEKVLKELED

SEQ ID NO: 15515 - protein, 55 aa, Artificial Sequence
  Synthetic
SKVEDVIREIRELIKRLEKHVKDSVREVRKHIEDNKRKVEKLVKEVEDVIRELRK

SEQ ID NO: 15516 - protein, 56 aa, Artificial Sequence
  Synthetic
RELAEELRRRLDEVLEKATRLHRELEKRHDDVLREAEKRLRDLKREIDKVLDDLRR

SEQ ID NO: 15517 - protein, 56 aa, Artificial Sequence
  Synthetic
EEVERVVKELRDHLAETKKKIDEIIKRLDDHIEENRERVERMVEELRRILKEIRDS

SEQ ID NO: 15518 - protein, 56 aa, Artificial Sequence
  Synthetic
REVVDEVRKEHRDVLREAEELIKRVEKDHEKSHREVKKLIEDVERRLREVLKELRD

SEQ ID NO: 15519 - protein, 56 aa, Artificial Sequence
  Synthetic
KEAEDTIRKVSKHIEDNKRKVEEMIKKLKEHLKETEEKIRRIVKKVRDEVRKLEEN

SEQ ID NO: 15520 - protein, 56 aa, Artificial Sequence
  Synthetic
EKLVRDLKRRHKESHDEARKLIEEVRREHEEVLKRAEDLIRELDKRLKEVLDKLRK

SEQ ID NO: 15521 - protein, 57 aa, Artificial Sequence
  Synthetic
SEAEEVVRRVEKHIRDTEKKIRDIVRRVKEEVDRNSERVREMVERVRKEIEELERAQ

SEQ ID NO: 15522 - protein, 56 aa, Artificial Sequence
  Synthetic
KEVVDELKKRHREVLEEARRLIEELKERAERSHRESKKLIDELREEIRRVLEERRR

SEQ ID NO: 15523 - protein, 57 aa, Artificial Sequence
  Synthetic
SEVEDIVTKLRDKVERHREEVKRIIDTLKKLVEEHKRRVDDEVKKLDDTVKRLREAN

SEQ ID NO: 15524 - protein, 59 aa, Artificial Sequence
  Synthetic
KRVDDLLREVEERLERSNREARKLLEEVKREMEESHRRLKKLLDEVREKVRRVVEELRK

SEQ ID NO: 15525 - protein, 60 aa, Artificial Sequence
  Synthetic
KVEELVKEVDERIKKVLDDLRRALEDVRKKAEDSVRRMEELSEKVKRDLDRVIAKAEEKG

SEQ ID NO: 15526 - protein, 55 aa, Artificial Sequence
  Synthetic
EEVVKRLEEILRRLKETIDRVLERLKRRVEDHDRKVEKRVRENEKAVEDLKRRID

SEQ ID NO: 15527 - protein, 60 aa, Artificial Sequence
  Synthetic
SVEEVLEEARKDIDRLIRRMEEISERAKEKIERLIDELRKISEEANKKNEEVLRELREKG

SEQ ID NO: 15528 - protein, 56 aa, Artificial Sequence
  Synthetic
REDIKREVDRLLEEIRRLIERLRENVKKLLDEIRKLIEELDENVKRSLKKLRDDIR

SEQ ID NO: 15529 - protein, 60 aa, Artificial Sequence
  Synthetic
SLDDILREVRRTSRELNEESRRIVDRAKRESEELLKELETILRDATRRLDDLLRKLDEKR

SEQ ID NO: 15530 - protein, 60 aa, Artificial Sequence
  Synthetic
RETVVKELEDKVREHLRTNRELIERLEKEMRDHLREIKRKIEELERRIRKLVEEVKRRID

SEQ ID NO: 15531 - protein, 61 aa, Artificial Sequence
  Synthetic
DELEDLVRKAEKLVRESEKKIKEIVDDARRLIEDSEREIREIVKKLRELSKRVEEELRRDG

SEQ ID NO: 15532 - protein, 56 aa, Artificial Sequence
  Synthetic
KDLLKELRDKSKRVLEKLRRLLEEINKRSRDVLEKLKRLADEVRESNREVLDRARK

SEQ ID NO: 15533 - protein, 56 aa, Artificial Sequence
  Synthetic
RELEEIVKDAERLVKKDTEDIRDKVRRAEEVVKKDTEDLEESVKRVKDKVKELEDA

SEQ ID NO: 15534 - protein, 56 aa, Artificial Sequence
  Synthetic
EELLREIEERIKRSLDESRKLVREIEKKVDESNERSRKLVEDVEREIEEVLKRLAD

SEQ ID NO: 15535 - protein, 59 aa, Artificial Sequence
  Synthetic
SSEDILREVKKLLDDSLDKLRRLIEKIKEDLDRSVDRHRKLSEEIRRRHERVREAVERR

SEQ ID NO: 15536 - protein, 55 aa, Artificial Sequence
  Synthetic
EDVARKLRELVREHSKEVEDKVRRAARLVEEHTERSDRVADKLRKHIEETKKRID

SEQ ID NO: 15537 - protein, 59 aa, Artificial Sequence
  Synthetic
SKEEILKEITDRVRESRKRTKKLLDDVREELERSHRRLEKLIREVEKRLREVKRKVDES

SEQ ID NO: 15538 - protein, 53 aa, Artificial Sequence
  Synthetic
VVRDLRRLVKEDTDRARKVVRELEREVERDKEEVERIVDKAEKKVRELEERIR

SEQ ID NO: 15539 - protein, 56 aa, Artificial Sequence
  Synthetic
DEVEKAVADLRRLNEEHTRDIDKAARDLERLVKKHTDEVRKLVRDLEKLVKDLKDA

SEQ ID NO: 15540 - protein, 59 aa, Artificial Sequence
  Synthetic
EKLEELLKEVEETTRRSLRRLEELLRKVERAVRESHKELKKLLDEVREKVKKVLEELRR

SEQ ID NO: 15541 - protein, 56 aa, Artificial Sequence
  Synthetic
DEVEKAVRDLEKLNEEHTRRVEKVVTDLRDLVRRHTEEVRKLVDELRELVERLRRA

SEQ ID NO: 15542 - protein, 59 aa, Artificial Sequence
  Synthetic
KKLEKLLDDVRKTTETSHERLKRLLEEVEERVRRSHEELKDLLRKVKELVEKVLRELKE

SEQ ID NO: 15543 - protein, 56 aa, Artificial Sequence
  Synthetic
SEVEKLAKELRDLVREHTKRVRELIDELKKRVEDHTRKVEEIVKRLKKLVDDLRDA

SEQ ID NO: 15544 - protein, 59 aa, Artificial Sequence
  Synthetic
KKLEKLLKEVRELVKRSHDELKKLLDRVREAVEKSKRRLEKLLDTVRRLLEKVVRDLER

SEQ ID NO: 15545 - protein, 56 aa, Artificial Sequence
  Synthetic
SEAEKLVEELRRLNERHTRRVEEVVRRLDEEVKKHRKDVRELVRELRKLVDELRKA

SEQ ID NO: 15546 - protein, 59 aa, Artificial Sequence
  Synthetic
EKLEELLREVEETTEKSHRDLKRLLDRVREKVEDSHKELEELLKEAKDRVDRVLEELRR

SEQ ID NO: 15547 - protein, 60 aa, Artificial Sequence
  Synthetic
SLEDKVRDDVRKLLAEAKKVADDLRKVVEDHRKTVEDVIREIRRRVEEHLKKLKELIDAG

SEQ ID NO: 15548 - protein, 56 aa, Artificial Sequence
  Synthetic
DRVLKRIEEEIRRLLKELREIVKDLERLDRELTDELRKLVEEVRRLSETVLDEARK

SEQ ID NO: 15549 - protein, 59 aa, Artificial Sequence
  Synthetic
SLDEDVAEKMKELEKENKDLLDTIRRLIEELEKHARELLKRIEDLIRELTEDAKRLEDS

SEQ ID NO: 15550 - protein, 56 aa, Artificial Sequence
  Synthetic
RRILEEIRRTNEELTERVRDLVEEMRKTSEELLKEVRKIADEVRRTVEEALKRLEK

SEQ ID NO: 15551 - protein, 61 aa, Artificial Sequence
  Synthetic
DEAEKILRDAKRLVEELSKKLEDNLREIKEVIDRLSEELDRNLKEHRDLIRKLEEDMDRKG

SEQ ID NO: 15552 - protein, 55 aa, Artificial Sequence
  Synthetic
EERAREVEEDIKRAEEEVERSIRESKKRTRDAEREVRESKKKSEDHIREVEKRIR

SEQ ID NO: 15553 - protein, 61 aa, Artificial Sequence
  Synthetic
SELEELLKELKEIVERSADHLRRSNDDLRKIIEEVTKTLEKILEDLKRIVEEVVDRARKKV

SEQ ID NO: 15554 - protein, 56 aa, Artificial Sequence
  Synthetic
EEELKKKLKELKDRAKETNERHRRDVERLMEKLRRDLERLDREVKDLEKKLREEEK

SEQ ID NO: 15555 - protein, 56 aa, Artificial Sequence
  Synthetic
SDREEIKRRVEEEAKKSRENLKETLREVDERVRDSERNLKRHHEEVKKAIDDLRRS

SEQ ID NO: 15556 - protein, 56 aa, Artificial Sequence
  Synthetic
KRILDDVRRLLEELKERYRRIVDEIKKLLERLKEAYKRNLDRVRELIERIEKEIRD

SEQ ID NO: 15557 - protein, 59 aa, Artificial Sequence
  Synthetic
SELEEVKERIERLVRRHKEELEKVRREIEREVKKHEKDLEDLERRSREHIETAERLLAE

SEQ ID NO: 15558 - protein, 56 aa, Artificial Sequence
  Synthetic
DRILEEARRLLDRLREENEKVLKEAEDMLKRLEDENRKMLEENEKLLKELKKEVDK

SEQ ID NO: 15559 - protein, 59 aa, Artificial Sequence
  Synthetic
SEVEEVLKTIEKKDEEHKRELERVKEEVDEDAKRHRERLKKVDRDVKEEIKRLRKLLED

SEQ ID NO: 15560 - protein, 56 aa, Artificial Sequence
  Synthetic
EKILEEIKRRLDELRKRNEDLLRRVKELLDELREENRRLLEDAKRLLEEVLKRARD

SEQ ID NO: 15561 - protein, 59 aa, Artificial Sequence
  Synthetic
SELEEVEKKVREDARRHKEELRRVEEEVKRNAEKHRDELRRVREDIERKIRTLRELLKE

SEQ ID NO: 15562 - protein, 56 aa, Artificial Sequence
  Synthetic
EEILRRVKKLLDELRDENRRLLERVRELLERLREENERVLREVKKLLDEVKREAEK

SEQ ID NO: 15563 - protein, 59 aa, Artificial Sequence
  Synthetic
SEREKLLKELKDNLDESRRRVEELLKRIKENLEEVKDRAKKTLDDLKRDIEELRKLVER

SEQ ID NO: 15564 - protein, 59 aa, Artificial Sequence
  Synthetic
EDVKRRLRDLSRRLAREHEKVIEKLRRLSDELEKIHREIEERLERLSDELRKEADKARK

SEQ ID NO: 15565 - protein, 61 aa, Artificial Sequence
  Synthetic
DEARELLKRLREINEKLKKDVEEIERRLEKYNRDVKRKLDDSIRELKEKLDRLRERIRDEG

SEQ ID NO: 15566 - protein, 59 aa, Artificial Sequence
  Synthetic
EDVRRAVEELVRRHKDTVKKIEESVRRLVEEHKRTVKEALDRSRRIAEEIKRVLDEAAR

SEQ ID NO: 15567 - protein, 60 aa, Artificial Sequence
  Synthetic
SEEEKLLTELKKLNDDLERRVRKSLDEIRRYNEKMREDVRRSDREVREEKKRLDEKLKKD

SEQ ID NO: 15568 - protein, 59 aa, Artificial Sequence
  Synthetic
EEALKKVRELVERHKRTVDEALEKSERLLREHERTVDEVLDRSRRAVEEVKKTLDDARK

SEQ ID NO: 15569 - protein, 60 aa, Artificial Sequence
  Synthetic
REAEEVRRRIEESHEEVRRRARKDERDLEESHKRLEEKAKELKDELRKILKDIDDLAKSN

SEQ ID NO: 15570 - protein, 59 aa, Artificial Sequence
  Synthetic
EDVLRDIEKLVRDNEEALDRILKRTKELVDRNLEAIDRILKEVEELVRRIKELLDRAKK

SEQ ID NO: 15571 - protein, 61 aa, Artificial Sequence
  Synthetic
SEVEEVLERLKRKLDEIERESRESAKKIRREIERIEKEARDSLRRLKKLIKEIEDRVRRDG

SEQ ID NO: 15572 - protein, 56 aa, Artificial Sequence
  Synthetic
REELEKLLKRLEEVVRESEKEIEDLLRRVRELIERIKREHEKILKEAEEVIRRVKK

SEQ ID NO: 15573 - protein, 61 aa, Artificial Sequence
  Synthetic
REVEEVLRELEEHIERSKRKSEESLKEIRRRIEEIEERSRRSLTELKKRIDDIKRRVEKDG

SEQ ID NO: 15574 - protein, 56 aa, Artificial Sequence
  Synthetic
KEDLKRLLDKVTEVHKESAKEIRKLLDEARKVIEDSLRAIRDILRKIKETIDRDKT

SEQ ID NO: 15575 - protein, 61 aa, Artificial Sequence
  Synthetic
EEVERVLEKLKRHIDDSRRKSKRSVDEIRKHIERSKRRSEESVERVKRELERIEEKVRREG

SEQ ID NO: 15576 - protein, 56 aa, Artificial Sequence
  Synthetic
EEELKKLLEEAEKVHRDSKRELRKLVKEARDVHRESMETVKRLLDELEREIRRAET

SEQ ID NO: 15577 - protein, 61 aa, Artificial Sequence
  Synthetic
SEDEEALKKLKEHIDRSREESKRSLDRVKREIERIREEIERDLRRLREELKKIEDRLRRDG

SEQ ID NO: 15578 - protein, 56 aa, Artificial Sequence
  Synthetic
EDELRKLLEDAKRVHKRSKDELKRLLEEAEKVIRDAKRKIKKLLDELRKVLEDARR

SEQ ID NO: 15579 - protein, 61 aa, Artificial Sequence
  Synthetic
DEVRRVLEELKEHIKRSEKRVRENEEEIRRHIEKSKRDSDESLKELARLIKKIEDDVRREG

SEQ ID NO: 15580 - protein, 56 aa, Artificial Sequence
  Synthetic
EEELKKILDEAEERHRRIEERHKDLLRKAEEVHRDSLRRLREILRRAEEVIRREKT

SEQ ID NO: 15581 - protein, 61 aa, Artificial Sequence
  Synthetic
KEVEEDLERLKKHTEDTRKRARDNLERIKEELEEIRKESEDSARKVRRDIEEIKRRVDETG

SEQ ID NO: 15582 - protein, 56 aa, Artificial Sequence
  Synthetic
ERELEKLLKEHEKTIRDIEEEHRRLLKELKDVVRESSRELEELLKEAEDVIRRVKK

SEQ ID NO: 15583 - protein, 61 aa, Artificial Sequence
  Synthetic
DEVREALKRLEDETRKNKKESDKSLERLKEESKKNKDESDKSVKNIEDKIKKLKEDLDRDG

SEQ ID NO: 15584 - protein, 59 aa, Artificial Sequence
  Synthetic
EEVKRALDELVKDHRRVLEESARRIDEIVERHRRLLDDSLRRIAELVRRVEETLREERR

SEQ ID NO: 15585 - protein, 60 aa, Artificial Sequence
  Synthetic
DEVEKALKELEDDLRELKKRSEESLKNVEEEIKRAKKELDESLDNLRKKIEELKRRLEKD

SEQ ID NO: 15586 - protein, 59 aa, Artificial Sequence
  Synthetic
EEVLRKLETIVRKIREELDRSKKKLEKLIEEAKRELERVLKEHEDLVKRVRDVLEDARR

SEQ ID NO: 15587 - protein, 61 aa, Artificial Sequence
  Synthetic
DDVRETLTRLRKETERNKRESDKSLENLKRKSEDNKRKIEESLKNMKRRIDEVKRRAEKDG

SEQ ID NO: 15588 - protein, 59 aa, Artificial Sequence
  Synthetic
EEVKKELDEILRRHKEVLRESERRLEKLLRDHRRRLEEALEEHKKLIDEAEETLKRIRD

SEQ ID NO: 15589 - protein, 61 aa, Artificial Sequence
  Synthetic
SEVEKALKELEDKTRKNKEDSERSLDKLRKDIEELRKKAERSIRNMRDKLRKLRDDVRKEG

SEQ ID NO: 15590 - protein, 59 aa, Artificial Sequence
  Synthetic
EEARRKLKELVDRHEEVLRRSLERLKRLVEEVRRTLEKILRDHERLLDELRRDLEKDRK

SEQ ID NO: 15591 - protein, 61 aa, Artificial Sequence
  Synthetic
DEVEERLRELEETTKENKRRAERSLENVRKKSRDNDKRIKESLDNIRREIKRLRDKVRKDG

SEQ ID NO: 15592 - protein, 59 aa, Artificial Sequence
  Synthetic
REVLEKLKEIVERHEEVLRRIKKKHEDLVREHRKRLEEARKRHEKLVREAEKTLDDVRR

SEQ ID NO: 15593 - protein, 59 aa, Artificial Sequence
  Synthetic
EEVERILDELRRRNEDMRRRSEENERELRKRNTELRKKVEDSLRRLREDLKRIKKLVEE

SEQ ID NO: 15594 - protein, 59 aa, Artificial Sequence
  Synthetic
EEVTKALEELVRRHRKTLEESLRKAEKVLRDHKESLERSEKKLKELMEEVKKLLDDARR

SEQ ID NO: 15595 - protein, 60 aa, Artificial Sequence
  Synthetic
SREDEIRKRLEESLERVKKIIEDIKRRIDESLERIKELLKEIDERSKRSLEKIRRKIERE

SEQ ID NO: 15596 - protein, 56 aa, Artificial Sequence
  Synthetic
EELLRRARKAHEDLLREVKRRIERAEEEHKRLLDELRKVVERSKTEIKKLLDELRK

SEQ ID NO: 15597 - protein, 63 aa, Artificial Sequence
  Synthetic
SRVEDVERKLRRKLEELKEDIERLREESRRSLEELERDSDRNRRESEDSLRRVEERIRRIKDD

SEQ ID NO: 15598 - protein, 56 aa, Artificial Sequence
  Synthetic
RETLRRVEREIERLLRELEETLKRSEEELKRIVDEHRKLLERSKRELEKLVDEVRK

SEQ ID NO: 15599 - protein, 61 aa, Artificial Sequence
  Synthetic
REIEEVLKRVEKVVRDDSRRNKEVLTRNRRKVERWKETLEDVLRRVEKAVRELRKDAEDRL

SEQ ID NO: 15600 - protein, 59 aa, Artificial Sequence
  Synthetic
EDILREVEKKLKELLDRSRELSDEVRKRSDESNKEIKKELDRARDELRRLLERIEEELN

SEQ ID NO: 15601 - protein, 61 aa, Artificial Sequence
  Synthetic
DEIEKVLEEVERVVEEDERRNRKVLEENKRLVDEWDRRVREVLKDVKRRVDELDTRARRDL

SEQ ID NO: 15602 - protein, 59 aa, Artificial Sequence
  Synthetic
KEILDRVKERLERLLEESRELSERVKREIEETNERIARELERVMETLKKLLKDIEDELK

SEQ ID NO: 15603 - protein, 61 aa, Artificial Sequence
  Synthetic
KEAEDVLKKVDTDVTRDDEDNRKLLEDNRRSVEEDERRNRRVLEEVEKRVRDLAERVKRDL

SEQ ID NO: 15604 - protein, 59 aa, Artificial Sequence
  Synthetic
REILKRVTEELERLLAESERLSEEAEERVRRSDDTSRRLSEEVRKELEELLRRIEERLR

SEQ ID NO: 15605 - protein, 61 aa, Artificial Sequence
  Synthetic
REVEEVLKRVKETVEKDREDNTRVLERNRESVKEDDDRNRKVLKRVRDEVRKLLEEAKRDL

SEQ ID NO: 15606 - protein, 59 aa, Artificial Sequence
  Synthetic
EEILKRIEEELKRLLEESRELSKEVEDRVRKSDKKSRDLSEKVKKDLKELTDEIRKRLK

SEQ ID NO: 15607 - protein, 61 aa, Artificial Sequence
  Synthetic
SEIEDILERVREEVDKDRRKNDEVLRENERLVKKDDDDNAKADEDVRRKVTELEKRARREL

SEQ ID NO: 15608 - protein, 59 aa, Artificial Sequence
  Synthetic
EEILKRVAKRLKELLEESKRLSDEVTKRSRDTDEESERLSRKVDKEVKDLLKEIERELE

SEQ ID NO: 15609 - protein, 61 aa, Artificial Sequence
  Synthetic
SEVEEMEERLRKLDEDSRRLSEDVKRRLDKINKEIKDLLDDVRRKLKEMLDKLTKDLRDLK

SEQ ID NO: 15610 - protein, 62 aa, Artificial Sequence
  Synthetic
KRAEDKVRDVLRDNERTLKKDEDDNKRVLDEDEKRLREWEERARRVLEEVRRRLKELVEEVR

SEQ ID NO: 15611 - protein, 61 aa, Artificial Sequence
  Synthetic
REVDKAREDLRRVDDELRKILERVRRELEKLDKESEERSRRLARDLDRLLEELERDLKDNK

SEQ ID NO: 15612 - protein, 62 aa, Artificial Sequence
  Synthetic
REVERKVREVLKDNERTLRELRDTIRKVLEDNDKTLREDVRRNEEVLRRVDETLRELKKRVE

SEQ ID NO: 15613 - protein, 60 aa, Artificial Sequence
  Synthetic
SEVDKVKEDLDEVDKDSRRISREMEERLKELDKRSREISDRVVRELEKILKEIEDLLRDL

SEQ ID NO: 15614 - protein, 62 aa, Artificial Sequence
  Synthetic
KEARDKIRRVLEDNERTLREDIEDNRKVLEDNDKRLKDDERKNREVLKRVDETLKELDERVK

SEQ ID NO: 15615 - protein, 61 aa, Artificial Sequence
  Synthetic
DELRELEERLRRSVEEIKRDLKRIHDENREAVERSERKSKKILEELKREVEDVKRELREKL

SEQ ID NO: 15616 - protein, 59 aa, Artificial Sequence
  Synthetic
EKLVREIERRVRKMEEDVRELVKTIEKRSRDVIKKSEDILKRIKERVEELEKRVRDAVR

SEQ ID NO: 15617 - protein, 61 aa, Artificial Sequence
  Synthetic
DELRELLETLRDEVRKDDKRNEDIHRENRKRVEESRRRSEKILRDLREVVKRLEDELRKKL

SEQ ID NO: 15618 - protein, 59 aa, Artificial Sequence
  Synthetic
EELLKRIEKRVRDMIRRSRTLSARLEDLSRELDERSKRVVEDLKRRIDEAIKELEKEVE

SEQ ID NO: 15619 - protein, 59 aa, Artificial Sequence
  Synthetic
DETEEVAKKIKELIERSRELVKKVKEKIDRLNEEIEKLVREVEKTIKELTDRIEELRKR

SEQ ID NO: 15620 - protein, 58 aa, Artificial Sequence
  Synthetic
EEMKKLLDDLRKAVDESRRRSEEILKENRKRVEKWREDLRRLLEKVKEDLDRIRERLR

SEQ ID NO: 15621 - protein, 59 aa, Artificial Sequence
  Synthetic
SEVEEAKKTLDELNRDIAKKVEDVEREIKRMIEESERLTREVEERIRRLTKKIEDLRRG

SEQ ID NO: 15622 - protein, 58 aa, Artificial Sequence
  Synthetic
ERVKKILEENKRDAERWKRRLKKLLDDVRRLVKEDDDRNEELLREVTERVRRIEEKLD

SEQ ID NO: 15623 - protein, 59 aa, Artificial Sequence
  Synthetic
SEVEKVKEELKKLNKEIADSSDEVDKDIERLIRESRKLTEDVRREIKRLIERIDELRRA

SEQ ID NO: 15624 - protein, 58 aa, Artificial Sequence
  Synthetic
EEAKRILDENKKLVREWEEKSRAVLEKVKKLVKRDDDENKKLLDDVKKLVDEMRERAR

SEQ ID NO: 15625 - protein, 60 aa, Artificial Sequence
  Synthetic
DLEREIRKIIEEAKKELERVNDEIRRIIEEMRRRSEESNKRIREIIERARRRLEELIRRG

SEQ ID NO: 15626 - protein, 58 aa, Artificial Sequence
  Synthetic
EEVKKLLTDLKRLVDEIRKHNKRLLDELRKEVEKSERENRRLLEEVRRTVDEMRERAR

SEQ ID NO: 15627 - protein, 60 aa, Artificial Sequence
  Synthetic
SAEDKARKIAEDAKKEAEDSNRDAHRIAEEAKRRARKINEEARELIERAKKELTRLRREG

SEQ ID NO: 15628 - protein, 58 aa, Artificial Sequence
  Synthetic
EEAKKLLDELRKAAEDIRRNNEEALKDLRRAAEEIRRHNEELLRRAREAAKKARDDAE

SEQ ID NO: 15629 - protein, 60 aa, Artificial Sequence
  Synthetic
SAEEAVKRVEELVRRVKERNKRLVEDVEREVRRVKKRSEETNRRVKKLVERVKEDLDKRV

SEQ ID NO: 15630 - protein, 59 aa, Artificial Sequence
  Synthetic
KDKLEEVLREVRDRLADVERKSERVVEEVERLLREVVRKNEDVLRRIEELLRDVEEKAR

SEQ ID NO: 15631 - protein, 60 aa, Artificial Sequence
  Synthetic
SVEELVREVEKRARKVKRDSDKTNKDSTKLVKEVKDRSRRTNEEVKKEVERVKEDLEKRV

SEQ ID NO: 15632 - protein, 59 aa, Artificial Sequence
  Synthetic
EDKLKEVVDRIRKLLEDVKRENEDVKRRSRELAERVREENDKVSKEIRELLEEVERRAK

SEQ ID NO: 15633 - protein, 60 aa, Artificial Sequence
  Synthetic
SAEEMREEVKRLVDKNRKDNREVEKKSTRLAEDVKRKSEETNRKIREEVERVKKDLEERV

SEQ ID NO: 15634 - protein, 59 aa, Artificial Sequence
  Synthetic
EEKLKEVLDEVRRLIKEINDHSREVSKTSEKLLRDVLKKNEDVLREIERLLEEVRRRIK

SEQ ID NO: 15635 - protein, 60 aa, Artificial Sequence
  Synthetic
REVEEITKEIREMNEESKRLLEEVREKIERLSRESNRLLEDSKREIDEAIRRVEELLDKE

SEQ ID NO: 15636 - protein, 56 aa, Artificial Sequence
  Synthetic
KDIITEIERTNDETEERVRDIERRIKESSDRNDKRAKEISERIKRLLEEVDKKVKE

SEQ ID NO: 15637 - protein, 60 aa, Artificial Sequence
  Synthetic
DLEELVKEVERRVRRNKTETDRLVEEVERSVRENRRRIEELVRRVEKEVRRIKEDLKRKL

SEQ ID NO: 15638 - protein, 59 aa, Artificial Sequence
  Synthetic
KDVLEKVAREIKRLIEESNRLDKEVEDEVREMSKDVNRELERIAEEIEKVLRDVERKLR

SEQ ID NO: 15639 - protein, 57 aa, Artificial Sequence
  Synthetic
SLEELLKEVKKLVEDVHRKNKKNVEDVRRLVERLRKENEENVEEVRREVKKVKEEIG

SEQ ID NO: 15640 - protein, 56 aa, Artificial Sequence
  Synthetic
LEEVRRRVEELVTDVDRSSKENHRRIRKVVREVERTTEENHRRIRDIVRRVREEAK

SEQ ID NO: 15641 - protein, 56 aa, Artificial Sequence
  Synthetic
SEIEKAVRELEELVKDNERKSKKSVEDSERIVKEIRDRVRRVVERVRKVVEDIARA

SEQ ID NO: 15642 - protein, 59 aa, Artificial Sequence
  Synthetic
DDELRKVVERARDLIRKIREESKRSHDRITKLAEDIKRELEKIERRLEKLAEELERKAR

SEQ ID NO: 15643 - protein, 56 aa, Artificial Sequence
  Synthetic
SEVDELRKEVEEMVKRNKDETDKSVKESKEIVDEIRKRIKEVVDEVRRFVEDIRRE

SEQ ID NO: 15644 - protein, 59 aa, Artificial Sequence
  Synthetic
SRALEDVARRLRELLKRINDKTRESHKEIKRLADEIRKKLEDIVRELEKLLREIKERAR

SEQ ID NO: 15645 - protein, 56 aa, Artificial Sequence
  Synthetic
SEVDEVRERLERVVRRIEREVEKSERDSERIVEKNKRDTDRVDREIEKVVKKIRDR

SEQ ID NO: 15646 - protein, 59 aa, Artificial Sequence
  Synthetic
SRALEEIEKRARELLKRITELLRESHERIKRLAEEINKKTEKVVRDIRKLLKEIEDKVT

SEQ ID NO: 15647 - protein, 57 aa, Artificial Sequence
  Synthetic
SEIERLREELERVVRAIERTVTESVRESKEMVDRNKRATEKSVRDSEDMVREIEERG

SEQ ID NO: 15648 - protein, 59 aa, Artificial Sequence
  Synthetic
SRELERVAKEARDLLREIKKLLDESTETIRRLVKEINDETERSHRKITELAKRLKEEAK

SEQ ID NO: 15649 - protein, 56 aa, Artificial Sequence
  Synthetic
DEVRELVEEVERVVKRNKDESKKSEEESREIVREIEKRVEDLVRTVEEVVKEIERK

SEQ ID NO: 15650 - protein, 59 aa, Artificial Sequence
  Synthetic
SRELEKVADTLRKLLKEINEKLERSVRRIRELAKEIKDELRRIEEELRKLAKELDDEAK

SEQ ID NO: 15651 - protein, 59 aa, Artificial Sequence
  Synthetic
DRTREVMERIERLLEDSRRKTDKVRREIRKLLEDVHDKTRRVAKEIRDLLDEIRRLLES

SEQ ID NO: 15652 - protein, 55 aa, Artificial Sequence
  Synthetic
EEVVKKARKKVRENAEEAEEVRRRIRRSVEENRKELRRLEKELKDVLDEIRERVR

SEQ ID NO: 15653 - protein, 59 aa, Artificial Sequence
  Synthetic
RELEEVRKDIERLLKEVEDTNRRAKERVKRLLEEVHDDTRRAVERIRKLLDEIRKLLEG

SEQ ID NO: 15654 - protein, 55 aa, Artificial Sequence
  Synthetic
EEVVKEIEKMLEKIARHARKSDKEAKESVEDNRRRLEKVRKEVEDMLDEIRERAR

SEQ ID NO: 15655 - protein, 59 aa, Artificial Sequence
  Synthetic
DREKEVADRIRKLLEEIREESERVAKEIRELIKEVHKRTKEVAEEIRRLLKEVEELLRN

SEQ ID NO: 15656 - protein, 55 aa, Artificial Sequence
  Synthetic
EEVVKEIERRLRENERKLRELEKEIKKLVEDNRTRLRELEDEIRRVLKKITDEVT

SEQ ID NO: 15657 - protein, 57 aa, Artificial Sequence
  Synthetic
SELEKAVEDSRRLDRRVEETLRDVTRRVRETNKEVEDMLEEVRERAERLLREIEEKL

SEQ ID NO: 15658 - protein, 59 aa, Artificial Sequence
  Synthetic
EDELRKVIDENRKSVETIEEELRRVEKEDEDTLREIEEKLRKAIEELEKKLKEILDRLR

SEQ ID NO: 15659 - protein, 59 aa, Artificial Sequence
  Synthetic
REREELVERVRELLKEVEDRDREMVERSERLNERIRERDKEVEDRSRKLDEDIERLLRA

SEQ ID NO: 15660 - protein, 55 aa, Artificial Sequence
  Synthetic
EEVLKEVKDAVDTLKKHSEDVIRKDEESVRDLRRHSEDVLRKNKEMVDDIKAKAE

SEQ ID NO: 15661 - protein, 63 aa, Artificial Sequence
  Synthetic
DEEDKLREVLKDVERRVREMLRENNELIREVAETSERLLRENNELIERVRKEVTRLLKELEKV

SEQ ID NO: 15662 - protein, 55 aa, Artificial Sequence
  Synthetic
REIVETIRKILREIEEHAERNKTRLEEENKKVREHVERNKKDLEETLKEVEDRAR

SEQ ID NO: 15663 - protein, 63 aa, Artificial Sequence
  Synthetic
SKEDKLREELKEVEKTVRELLKRNNELIERVREEVERRLEENNRLIKEVKDRIDDLLRKLKDD

SEQ ID NO: 15664 - protein, 55 aa, Artificial Sequence
  Synthetic
REIVKTIKEILDEIRRHLERNKDRLEKELTRVRETAEKNKRDLEKVLEDVDRKAK

SEQ ID NO: 15665 - protein, 60 aa, Artificial Sequence
  Synthetic
DEAEKLEREVRKELEENREELERSTEESERLLKHNEDELRKSEEESKKLLREVEKELRRV

SEQ ID NO: 15666 - protein, 59 aa, Artificial Sequence
  Synthetic
KRVLDEVVKEIRRLIEEVKRTTKEMNKKIRKLFEESNRKLEEAHRDIRRKAERVKRELK

SEQ ID NO: 15667 - protein, 60 aa, Artificial Sequence
  Synthetic
KELDEIREEVDRVLRENERRLRTVKKEARDVLEHNRKRLEELRRKIEEVLKEIEEELKRV

SEQ ID NO: 15668 - protein, 59 aa, Artificial Sequence
  Synthetic
EEVLRRVLERIRRLIERVKERTKRMTDDMRRLIEESNDKLRRAEERIRKLLEEVKRTLK

SEQ ID NO: 15669 - protein, 60 aa, Artificial Sequence
  Synthetic
KKVEDIKREAEKVIKESEESIRRNERELDEVIKESERSIRRNERELERVLKELRDSVARL

SEQ ID NO: 15670 - protein, 55 aa, Artificial Sequence
  Synthetic
DRIREELKKVADEIRETNKRIHEESKRVVDEVRRTNEEIHKRSAKVVKDIKDKIK

SEQ ID NO: 15671 - protein, 60 aa, Artificial Sequence
  Synthetic
EEVERITEDAKRVIDESRKTIKRNEDDLRRVIEESRETVERNRKRLEEVLRELEERVRRL

SEQ ID NO: 15672 - protein, 55 aa, Artificial Sequence
  Synthetic
KRIEEELKRVAEEVKKINEDIHRRSKEEVDRVREINEKIHRDSERVAEEVRRRIK

SEQ ID NO: 15673 - protein, 57 aa, Artificial Sequence
  Synthetic
EELERLKEEVEEIVRRLKRELERIEEEIAKMVRDSEKSLEEDEREVRKVVEELRRRG

SEQ ID NO: 15674 - protein, 59 aa, Artificial Sequence
  Synthetic
EEILRRVKEEVEKVARDIKAIIEKVAREVKEVLDRIREVNKRAHEETRKVADEIEKRAK

SEQ ID NO: 15675 - protein, 56 aa, Artificial Sequence
  Synthetic
DEVERIAKELTDVLDRIRKAVETDKEEIKRVLKEIEEAVRTNEEKLKDALRKIREG

SEQ ID NO: 15676 - protein, 59 aa, Artificial Sequence
  Synthetic
ERALERVEEKARELVRRVDELLRRSHERTKELAERVRRLLKKSDEETERLARDVERKIK

SEQ ID NO: 15677 - protein, 56 aa, Artificial Sequence
  Synthetic
SEVERITERLKEVLKEIKELVETNSEKLKRVLEEIKKAVEDNTRTIKKVLEEITRA

SEQ ID NO: 15678 - protein, 59 aa, Artificial Sequence
  Synthetic
EEMLKRVEDEARRLTERVRKLIEDSDRETEKLVRRVRELVKRSHEKVKELVDRVRKRIE

SEQ ID NO: 15679 - protein, 56 aa, Artificial Sequence
  Synthetic
SEVERIAEEVKRVLEKIRRDVEENRKRIEEALKRIEKELRDNERRLREVLDEIRKR

SEQ ID NO: 15680 - protein, 59 aa, Artificial Sequence
  Synthetic
EDALRAVEEEIRKLEDEVRRLIETSHKEVEDLAKEVTDLLRESNERTEDLRREVDAKRR

SEQ ID NO: 15681 - protein, 64 aa, Artificial Sequence
  Synthetic
SDEERLLRTITRVLEENKKSVDDDLKKNEDVLDENRRRVERWEEALRELLKRVEDKVKDLKKDG

SEQ ID NO: 15682 - protein, 56 aa, Artificial Sequence
  Synthetic
TDEIRRVLEKVKEELDRTDEKSRDLSRKVRDRIRESNREIEKLLEEVRERLERETK

SEQ ID NO: 15683 - protein, 64 aa, Artificial Sequence
  Synthetic
READELRTRAEKALRDNRESVERLKRELDRVLKENERTVRELKERVKEVLKDVDKKVKDLKKEG

SEQ ID NO: 15684 - protein, 56 aa, Artificial Sequence
  Synthetic
REEIRKVLEDVRREVEETDDRIRKVLERARRESEKVDRELKKELERVRKELEEETK

SEQ ID NO: 15685 - protein, 59 aa, Artificial Sequence
  Synthetic
DRERRVLEELRKLSEDSKRLLERIRERMRRLAEETKRRARDILREVEELSRRVKELLDG

SEQ ID NO: 15686 - protein, 55 aa, Artificial Sequence
  Synthetic
EEVKDDVRRSSEEVKEEVERLIREAKKSTDEVRELLKELEKRLRESIEESKRKAE

SEQ ID NO: 15687 - protein, 57 aa, Artificial Sequence
  Synthetic
EEVKRMEDRLEEVAKRADEESKKVMDELEKIVRDVLRESKRLTEELRRIADRVRKEL

SEQ ID NO: 15688 - protein, 59 aa, Artificial Sequence
  Synthetic
KKELDRIEKRVREIKKRSEDSVRTIRERVRDAKRKLERSVEEDKREVKEIKERLEREAR

SEQ ID NO: 15689 - protein, 57 aa, Artificial Sequence
  Synthetic
SEVDDLKRKLDEVVRRAKEESKEISERLEEIVRDAERLLKELHEEDERIVDRARKEI

SEQ ID NO: 15690 - protein, 59 aa, Artificial Sequence
  Synthetic
RDKLEKIRDAVRKVKEELERSLEKDRKRVTEIEEKLKKLVEENRRTSKRVKEELEEKVR

SEQ ID NO: 15691 - protein, 60 aa, Artificial Sequence
  Synthetic
RELEEIKKRVEDIMRRIEDLLRENEKKIDKVRKDIRKSLEENKRKVEEVRKDLKRLLDER

SEQ ID NO: 15692 - protein, 55 aa, Artificial Sequence
  Synthetic
EEVKKEIERLAKKLEEELERSNRESDRLVREARKHNEESDRRSEELARRVRERLR

SEQ ID NO: 15693 - protein, 60 aa, Artificial Sequence
  Synthetic
KREEDVKRDLKRVADESRKSDEDIKRRLDRLVKEIRELHKKTTDELKKVADEVRDRLRKV

SEQ ID NO: 15694 - protein, 55 aa, Artificial Sequence
  Synthetic
DELREDVKRVEDENRTSLREIKRAIEKVLDESRKLVEENRRRAEKIIKEVEDTLR

SEQ ID NO: 15695 - protein, 60 aa, Artificial Sequence
  Synthetic
REEEEVTEELKRLADKSRKSDEDIERTDRRVTEEIERLHEETTRELEKVRRDVDRELKKV

SEQ ID NO: 15696 - protein, 55 aa, Artificial Sequence
  Synthetic
DELKKEVRKILEENKRSLERIRRHSTRVEEKSRKLIKENDDRLKKVIEDVRRKLK

SEQ ID NO: 15697 - protein, 60 aa, Artificial Sequence
  Synthetic
SEKDKVTKELEDVARESRESDKEIKRELDEVVEESERLLREIRRRLEKVAEEVRRALEKV

SEQ ID NO: 15698 - protein, 55 aa, Artificial Sequence
  Synthetic
EELKRRVEEIIRENEESVRRIAKRADDSNREIERLVDEIRRRAEEAIRRVTEKVR

SEQ ID NO: 15699 - protein, 60 aa, Artificial Sequence
  Synthetic
KEEDDVRRKLEKVVREIDKLHKESTERDRKVREDSEETDRRIKEELKKVVKEVRDRLREV

SEQ ID NO: 15700 - protein, 55 aa, Artificial Sequence
  Synthetic
EELKDEVRKATEKSEDLVRRNEEHSRRVIEENERTLKDIADEAERVIKEVEDRLR

SEQ ID NO: 15701 - protein, 60 aa, Artificial Sequence
  Synthetic
REDEEVTKELEEVIREIEELHERSTRKLKEVVDRSRELLDRVRRRLKEVVDRIRELLERV

SEQ ID NO: 15702 - protein, 55 aa, Artificial Sequence
  Synthetic
EELRKRVEEAIRKSEELVKENTERAKKSNEELERRVRELEERAKRAIEEVKEKIR

SEQ ID NO: 15703 - protein, 60 aa, Artificial Sequence
  Synthetic
SREEDVDRKLDEVIERSRRIDEEILRRDKEVVDEIRKLHKESTDRLKEVVDRVDKELKEV

SEQ ID NO: 15704 - protein, 55 aa, Artificial Sequence
  Synthetic
EELKKKVTEAIEENRESVEEIRRHSEEVKKESEKRVKENRDRARRAEERVEEMLR

SEQ ID NO: 15705 - protein, 60 aa, Artificial Sequence
  Synthetic
DREREVKKRLDEVRERIERLLRRVEEESRRVAEEIRRLIEEVRRRNKKVTEEIRELLKRL

SEQ ID NO: 15706 - protein, 55 aa, Artificial Sequence
  Synthetic
KELREELKKLERKIEKVAKEIHDHDKEVTERLEDLLRRITEHARKSDREIEETAR

SEQ ID NO: 15707 - protein, 60 aa, Artificial Sequence
  Synthetic
DEEEKITRDLEKVEDEIRRLLEEVRRLSKKVKEEITKLLEDVNRESEKAVRKVRETLKRL

SEQ ID NO: 15708 - protein, 55 aa, Artificial Sequence
  Synthetic
ERLRKRVTDVIRKLEEVLKDIHRHDKEAIEEAERRLEDNHRRNRRVLEELKRRAD

SEQ ID NO: 15709 - protein, 60 aa, Artificial Sequence
  Synthetic
SEEETVEELVRRAEEKSRRILEDSKKKVRDIERENDEILKRSRDRVKKAEDDLRRVVEKR

SEQ ID NO: 15710 - protein, 55 aa, Artificial Sequence
  Synthetic
ERILRELERVVEEIDREHERTKEELKKVADESRKAHRESERDLERVIREVRERLR

SEQ ID NO: 15711 - protein, 60 aa, Artificial Sequence
  Synthetic
SEVERVRKTVEEIKEKNERILKTSKDEVRRILEESERMLEESKKRVDEVREEAADVVRKR

SEQ ID NO: 15712 - protein, 55 aa, Artificial Sequence
  Synthetic
DRILEKLEEAAKRSDELHKRSRDDLRRVAEEIKKLHEETRRKLKKVVDEIRKKLK

SEQ ID NO: 15713 - protein, 61 aa, Artificial Sequence
  Synthetic
STLEEVRERVDRVKKKLKKLLEEVTEINERSKKEIDEILKESEDRVRKVKEDLKRVVKEDK

SEQ ID NO: 15714 - protein, 59 aa, Artificial Sequence
  Synthetic
EEVLERVLRELEELTRRVEKEIRDLLKRIEDSSRRVRELATESRKKLEDLVREIKERLT

SEQ ID NO: 15715 - protein, 59 aa, Artificial Sequence
  Synthetic
SSEEKVREEVERVREEITRLLRENEDTVRRVDEKAEKALRENKERVDRLREEVRKLLEK

SEQ ID NO: 15716 - protein, 59 aa, Artificial Sequence
  Synthetic
DDFVRKVTEELKKVTDRIRKLLEESRKHTERVRREAEKLLKEIKDETKKVEEEVRRRAK

SEQ ID NO: 15717 - protein, 59 aa, Artificial Sequence
  Synthetic
SSREKIKDDLRKAVEENRRLLREVRELLREMLERDERILREIERRLDEARKRLEEVARN

SEQ ID NO: 15718 - protein, 58 aa, Artificial Sequence
  Synthetic
RAVEELKKELRRLEEESRRAVEDLKRLLDELKERTDRVVKKLDETLRKLKEDVDRKAK

SEQ ID NO: 15719 - protein, 60 aa, Artificial Sequence
  Synthetic
REIDELRKELDEIRKRIEKVIEELKRHLDEVDKRAEDLAKELDDLTKTIERDAERRIRED

SEQ ID NO: 15720 - protein, 59 aa, Artificial Sequence
  Synthetic
DKVIREVEERVKRIKEDVDRVLEDNSREVERVKRKVDKMLKRNKDEADRIRKKMDDDLR

SEQ ID NO: 15721 - protein, 60 aa, Artificial Sequence
  Synthetic
SVIERLKEELKKIEEDARDMAKKLNKETEDILRRARKLARELEKHLEDVKRKIDELIKED

SEQ ID NO: 15722 - protein, 59 aa, Artificial Sequence
  Synthetic
KKMIEEVERDVRRIKKEVDRLLEENTERIEEIKKEVDELLKRNTDEVEKVKKKVDEDRK

SEQ ID NO: 15723 - protein, 59 aa, Artificial Sequence
  Synthetic
KIEEDLERSLKKSEDELKELRDRLRKSNKEVTDDAERIKKEVEDSNREVEKRVRDLERR

SEQ ID NO: 15724 - protein, 59 aa, Artificial Sequence
  Synthetic
SEEARKVLEENEEVVRRIVKKVEDILDDHRRVVKEVRDRIERLLKEHKKIVEDADKDLT

SEQ ID NO: 15725 - protein, 60 aa, Artificial Sequence
  Synthetic
REEEEVAKKLERAAEESRRLHEESKRDHERATDEIRRKAEATLRELKRVIDEIERLADER

SEQ ID NO: 15726 - protein, 55 aa, Artificial Sequence
  Synthetic
EEIRRRVETLERENRKAEEESRDKVRKSERRLEELNKRHEDLVRELEERLERKRK

SEQ ID NO: 15727 - protein, 60 aa, Artificial Sequence
  Synthetic
DEEEKVLRELEEVIRTSRRLHKRSLEELDRVLEESKALHRESKRALEDVTREITKLADDR

SEQ ID NO: 15728 - protein, 55 aa, Artificial Sequence
  Synthetic
ERIRKLVDDLRKENEKALRESKKRVEEIRRRNEEAIKDSKKDVEDLERDLERKRK

SEQ ID NO: 15729 - protein, 60 aa, Artificial Sequence
  Synthetic
SDEERVLEELKKVIKESRDLHKESLDDLRRVIEKSRRLHEESLERLRRAIEEIERLMDER

SEQ ID NO: 15730 - protein, 55 aa, Artificial Sequence
  Synthetic
EEIRDLVRTLEEDNKRMEERSRRTVRKLEKENDDARKESERLVEELERRLEEKRR

SEQ ID NO: 15731 - protein, 60 aa, Artificial Sequence
  Synthetic
RDVEEVKKRSDTTLKRIEELIRRVNERSKKSIKEIRDRAKEVEDEVRELARKIEEDARRR

SEQ ID NO: 15732 - protein, 59 aa, Artificial Sequence
  Synthetic
DEVVRELEKINDKSRKRVEDAVRSNEKLLEDSERDIRRVIERLKKLLEDLKRKLEEIER

SEQ ID NO: 15733 - protein, 60 aa, Artificial Sequence
  Synthetic
SDAERVMEESRRTIEKIKKDAKEMNERSRKTVDEIRERLERLLRELERIAEEIRRELEKR

SEQ ID NO: 15734 - protein, 59 aa, Artificial Sequence
  Synthetic
EEFVRELKKLNDKSRKDVEDLKRSNEEINEDSKRKVEEIIRRLEELLKEIRRELEDVER

SEQ ID NO: 15735 - protein, 60 aa, Artificial Sequence
  Synthetic
SVEEDLKRLVDEIRRRVEKVKRDLERIVDENRKRVEESKEESKKSVEEIERRVREAAKRI

SEQ ID NO: 15736 - protein, 59 aa, Artificial Sequence
  Synthetic
EKVADEVRKRLRKMIRDLEEVAREVKRELERLHEETERSSRDAKRRSDKMARDLERTEK

SEQ ID NO: 15737 - protein, 60 aa, Artificial Sequence
  Synthetic
SSEEKLRELVKRIKRRVEEIIRRLEESVERDRDEVRRSKERLEALVEEIRRRVDDIEKRI

SEQ ID NO: 15738 - protein, 59 aa, Artificial Sequence
  Synthetic
EKAVREVEEELRDMERKLEKVAEEVTRRSKEVTEKLRESSDRVEKELRRIIEELERVAK

SEQ ID NO: 15739 - protein, 60 aa, Artificial Sequence
  Synthetic
SVREDLKRLVKEIEDEVRKSKKDLDDSVREDKREVRESKEDSKRSVKRSEEEVRKIKKRT

SEQ ID NO: 15740 - protein, 59 aa, Artificial Sequence
  Synthetic
EEVAKRVRELLEEIMRRLRKTSEEARRRSKKITDDLRESSKKVREDSERLRKRLEEEAK

SEQ ID NO: 15741 - protein, 60 aa, Artificial Sequence
  Synthetic
DAERKITRLLEEIRRESKRSSEEIKKSLKENEDEVRRVVEEIRKRLREIEKEVKEVLDRL

SEQ ID NO: 15742 - protein, 59 aa, Artificial Sequence
  Synthetic
EKLVEEVLREVKRIIEENRTLSERVKEHNEKSHRESEELAKRVKELLKEIERDIRRLEK

SEQ ID NO: 15743 - protein, 55 aa, Artificial Sequence
  Synthetic
SDAERVLKESKESLEELERRVTEALKRSRDSLRRLKEVADEARRRLEEVLERIAR

SEQ ID NO: 15744 - protein, 59 aa, Artificial Sequence
  Synthetic
SEVKERLKRSLEETEKRVREVEERLKKTVEDTRKVVEDIERELERLLREVEEVVRRIEK

SEQ ID NO: 15745 - protein, 55 aa, Artificial Sequence
  Synthetic
EEAERMLRESEASLRRIEKIVREALEASRRTVEELKKVVERVLREVRKLIEEIEK

SEQ ID NO: 15746 - protein, 59 aa, Artificial Sequence
  Synthetic
DEVRERLKKTVEDSKRVVEKAEEDLRRSLEDTERLVREASRRLRDLLRELRRIVEEIKR

SEQ ID NO: 15747 - protein, 55 aa, Artificial Sequence
  Synthetic
SEDEKALRESKKTTDEIRKRVTEMEKRSREVVKEIRDIIERVLREVRRVLEEIRK

SEQ ID NO: 15748 - protein, 59 aa, Artificial Sequence
  Synthetic
SEAKKRLKDSLDRTRKTVEEMTRRLEKTVKETEDLLREARERLEELLRELERVADEKRR

SEQ ID NO: 15749 - protein, 55 aa, Artificial Sequence
  Synthetic
SEDEKVLRDSRKVLREIEEVVKEVLKRSKKLVEELEDIARRVLKESEDSNKEARD

SEQ ID NO: 15750 - protein, 59 aa, Artificial Sequence
  Synthetic
DEVERRLRKTVRDTKEVVDRAREKLERTVRTTEETVKEIEKRLEESLRRSREDVKEREK

SEQ ID NO: 15751 - protein, 60 aa, Artificial Sequence
  Synthetic
RVEDALRKLLDDVRRLVEEAERRLRTSNDKSRRLVEEAKRRLEESNERSEKLVRDVRRRI

SEQ ID NO: 15752 - protein, 59 aa, Artificial Sequence
  Synthetic
SKVVEEVLKELEELIKTAKKIIEDVLRASEDTIRRLEEIIRKVEEDSKRIIEEIERAAR

SEQ ID NO: 15753 - protein, 60 aa, Artificial Sequence
  Synthetic
SAEDKLRKLLDDARRTVKEVEERLKKLNKKLEEDVKRVKRELRESNKKSRELVEKVKREV

SEQ ID NO: 15754 - protein, 59 aa, Artificial Sequence
  Synthetic
SEVVEEVLEELKKLIETVKRRAKEVLDRSEETIREIRKRAEDVLRESERIIEDIERMTR

SEQ ID NO: 15755 - protein, 60 aa, Artificial Sequence
  Synthetic
KVEKRLTDLLKTVADEVKRVEDELRETVRESKEVVDKSRRDLERTVEESEKTVKDAERRV

SEQ ID NO: 15756 - protein, 59 aa, Artificial Sequence
  Synthetic
EEVVKKVEKEIRELLERLKEEADRVRERSKKILTDLKKSSEDVKRESERMLKKLEDEIR

SEQ ID NO: 15757 - protein, 60 aa, Artificial Sequence
  Synthetic
SVEERLEDLLREVTETLDTSRRRLEKLDREVDKKVKEVEKRLRETLKESEDTVRDVERRV

SEQ ID NO: 15758 - protein, 59 aa, Artificial Sequence
  Synthetic
EEVARRVEKELEDILRKLRKSSEEAERRIEEMLRRLDKVVKEMLKRSRDLLRTLEETTK

SEQ ID NO: 15759 - protein, 60 aa, Artificial Sequence
  Synthetic
SIREDVERLAEELDRKSREIATRAKRELDEILRKDKEISDRARKELEEILKKLKEIADRD

SEQ ID NO: 15760 - protein, 59 aa, Artificial Sequence
  Synthetic
KEVEKRLDDALKRNAEEVEDVKRKLKDVLREVERTVRESEKDLRRVLEEVERAVREIRR

SEQ ID NO: 15761 - protein, 55 aa, Artificial Sequence
  Synthetic
SEVDEVLKRSRDVLKRIDEIVKKVLTDSKRVLEDLRRIVKEVLDESKKVLEEIRK

SEQ ID NO: 15762 - protein, 60 aa, Artificial Sequence
  Synthetic
AEEVERAMRKSSDDLRRKLEEVERRLRKSSEESKKVLKDAEREIRRSSDELRKVLEDIRR

SEQ ID NO: 15763 - protein, 55 aa, Artificial Sequence
  Synthetic
SEVEDVLTKSRKVLKEIEEIARKVLEESKRVLEEIRRVVEEMERRSEDVLRELRR

SEQ ID NO: 15764 - protein, 60 aa, Artificial Sequence
  Synthetic
ADEVRDEVRKSSEELRRVLEEAEERIRRSSKESKELLKRVKERIEELSRRLEKVLREIEK

SEQ ID NO: 15765 - protein, 59 aa, Artificial Sequence
  Synthetic
DAEDELKKAEDRLRKSDEEAKKSIEDVKRELRRLLEESKKEIEKLIEELRRLLERAKEK

SEQ ID NO: 15766 - protein, 59 aa, Artificial Sequence
  Synthetic
EEVVERVLRKVERLLEENERLVKEVEDELRKLLEDLKRSSKKVRDEVKELAKRLRDEVR

SEQ ID NO: 15767 - protein, 59 aa, Artificial Sequence
  Synthetic
SAEERIEEVKERLRRSDEEAKRKIDRLVEELRRLLEESKKEAEKVKKELRKLLEEVKRK

SEQ ID NO: 15768 - protein, 59 aa, Artificial Sequence
  Synthetic
EEVVKRVEDELRRLLEENKKLVDDILDEVRRLLEELEKSSRKVKEDLDRLLEELRREDK

SEQ ID NO: 15769 - protein, 59 aa, Artificial Sequence
  Synthetic
SAAEEVKKRITDLLRKDEEVVKRASEAVERLLEDDKRVVEDVRREIEEILRTLEKVTRE

SEQ ID NO: 15770 - protein, 56 aa, Artificial Sequence
  Synthetic
KDDVKRAEDEVRKSHKKVEDDLRRLKEEVERSLKDTEDKARRAKEEVERLLRESER

SEQ ID NO: 15771 - protein, 59 aa, Artificial Sequence
  Synthetic
DEDDRVRKEVEKMLRDDDRIVKEIEKRLKDLLDRDRKVVREVRELVEELLRRLEKVIKD

SEQ ID NO: 15772 - protein, 56 aa, Artificial Sequence
  Synthetic
EEDVDRLRREVDKSNKDTKKILDEVRKEVEDSLRKTKKIIDDALRRVDELLKEAER

SEQ ID NO: 15773 - protein, 56 aa, Artificial Sequence
  Synthetic
SVEERVEDIKRSNEESNKRLREEVEKIKEELKEINKRVEDTVREIEKRLEELLRRV

SEQ ID NO: 15774 - protein, 59 aa, Artificial Sequence
  Synthetic
ERVVEEIDKIAKEVNTRNKKVVDEIRKRAEEVKEESKESLKRLRKIAEEVLEELKKRAT

SEQ ID NO: 15775 - protein, 56 aa, Artificial Sequence
  Synthetic
DLAEEVRKDVEDLERTNEKVVRDIRKLLEDLNREHKRVSDEIRKRIEELKEKLKRI

SEQ ID NO: 15776 - protein, 56 aa, Artificial Sequence
  Synthetic
DDDVRRIKKRAEDSHDRVKKELDRIAKSNEELLRKTEEEVRRLLEELEEILRRTRK

SEQ ID NO: 15777 - protein, 59 aa, Artificial Sequence
  Synthetic
DEVEEALRRVEESNRRVKEEVERAVERVKRSDDDVRRLVEEMEREVRKLIDDIRRLAEA

SEQ ID NO: 15778 - protein, 56 aa, Artificial Sequence
  Synthetic
KDEITELKKHSERLLEEAERLVRDLKRHSDELLEEVEERLRRLREDLKRLLDEVET

SEQ ID NO: 15779 - protein, 59 aa, Artificial Sequence
  Synthetic
SAVEKAVRDVERTNEEIRRVVEEVRKEAEKTHRDIRRVVEEARETAERLLREIEELAKK

SEQ ID NO: 15780 - protein, 56 aa, Artificial Sequence
  Synthetic
EEAVKRLKDENKKTLDEVREIVKRLAEENKRLLEEVEKTVRDLKRELEKLLREVAK

SEQ ID NO: 15781 - protein, 60 aa, Artificial Sequence
  Synthetic
KEVEDVVKEIEEVLDRLRKEVKKIKEDSDRLNEEIEKVVTDLVKELDRLLREIDDLIRKL

SEQ ID NO: 15782 - protein, 59 aa, Artificial Sequence
  Synthetic
DRARKTLEDLKRRIEELLRRVDETNERLKRHSDDLLRDVKRRLDEVRERIDRLLDKAER

SEQ ID NO: 15783 - protein, 61 aa, Artificial Sequence
  Synthetic
DEVDEAVKRLREILRRIREIVEKVRKESEDVNDEIRRIVEEVTKRSEDALRELRELIRRNK

SEQ ID NO: 15784 - protein, 59 aa, Artificial Sequence
  Synthetic
ERVREELRKVEEDIDRLLKEVTELNERLKRHSEKLLRDVTRENRRSKEAVTRILEEARR

SEQ ID NO: 15785 - protein, 60 aa, Artificial Sequence
  Synthetic
SEVEELLDRLREVNKRIREEVRKVTEESKKAIEEIKRIVDDMVDKVRKILEKLKELIRDN

SEQ ID NO: 15786 - protein, 59 aa, Artificial Sequence
  Synthetic
DKAREDLRRVKEHSERLLREVTKLNKDVEKELKELLDEVRERLKDLKRRIDKILEEAER

SEQ ID NO: 15787 - protein, 59 aa, Artificial Sequence
  Synthetic
SVRERVKDEMEKVLRDDKEVSKRVTDEARKVLEEHRKITDEVRRRSKELIRELKKVRDE

SEQ ID NO: 15788 - protein, 59 aa, Artificial Sequence
  Synthetic
EEVRRTVDEVRRRIDKSLEESKKLVEDISREITELLRRTTERNKESKREVDKILEDARK

SEQ ID NO: 15789 - protein, 59 aa, Artificial Sequence
  Synthetic
SIVERAEKELRRLLKEDEEVSDRVRKEVKRLLKEDKEILDDVRRRIEKILREIEEVARR

SEQ ID NO: 15790 - protein, 59 aa, Artificial Sequence
  Synthetic
EDVRRIIKEIKERVKKSLDESREIIERAKREVDKSLEESKKVAEDAKRRIERLLREVER

SEQ ID NO: 15791 - protein, 60 aa, Artificial Sequence
  Synthetic
SEVEKVVREVEKLIREIERHSKEVNKRSKEDIDRIREKIERAIRRVEELIRKVKEVTERG

SEQ ID NO: 15792 - protein, 55 aa, Artificial Sequence
  Synthetic
EDLDRIRERLERLKKRTKELLERDEREVERVERELEELIRDIRRKIEKLKRDIEK

SEQ ID NO: 15793 - protein, 59 aa, Artificial Sequence
  Synthetic
SDLEDVIKKIEELLRRVEERLRDAVRKIEELLRASDERLREINEESRELLRRVKELKDA

SEQ ID NO: 15794 - protein, 56 aa, Artificial Sequence
  Synthetic
RKLVDDIRKEVERIVEEARKLLERIKREVKESSERAERLHEEDRKRVEDALREVKK

SEQ ID NO: 15795 - protein, 59 aa, Artificial Sequence
  Synthetic
KEAEDVLEKAKRLLKRSDEVVEEANDESRRLLDKIRKLVDTVNEESKRLLDRVRELREA

SEQ ID NO: 15796 - protein, 56 aa, Artificial Sequence
  Synthetic
KDAVRDVEREVRRSSKRLKELHEEDKRRVRKILERLKRLHEKDRRDLEKVMKEVED

SEQ ID NO: 15797 - protein, 60 aa, Artificial Sequence
  Synthetic
DDLDEVIKDIERLLKESDDDVERVIREIKKLLDEVRKRVRDANEDSKRLLREVERLAEAG

SEQ ID NO: 15798 - protein, 56 aa, Artificial Sequence
  Synthetic
ERLVREIERRVRKSSEDLRRRLEEIRERVEDIERELRKLHEEDKKRVEDILTEVRR

SEQ ID NO: 15799 - protein, 60 aa, Artificial Sequence
  Synthetic
SEKERVVEEVRKKLEEIRRRTEEMIERVERLLDEIRRRNKELVERNKELNKRIAEIVRDR

SEQ ID NO: 15800 - protein, 56 aa, Artificial Sequence
  Synthetic
SELARDIKRKLEKILEDSERLVDEIRKRIEKIKRESDETVRESRESSRRLLEEVKR

SEQ ID NO: 15801 - protein, 58 aa, Artificial Sequence
  Synthetic
SEVERLLEDNRRTIREDEERNKRVVDTWRELTRRLEERIEKVLTDNKKTVEDLVRKRG

SEQ ID NO: 15802 - protein, 56 aa, Artificial Sequence
  Synthetic
DDELRKDLERLDEESKRASEKLEEEVRREIKRSKELIEEVERKVEEIDKRADERLN

SEQ ID NO: 15803 - protein, 58 aa, Artificial Sequence
  Synthetic
SEVERVLEKLKRDVEKNERDNRRVLKKLREDVKKDADDNRKVLEDLRRAVEELRREVG

SEQ ID NO: 15804 - protein, 56 aa, Artificial Sequence
  Synthetic
TKDLVDEARKVLETSKRLSDELKKEVEKMLRESREMSKRLKEEVDRILKEVRDKAR

SEQ ID NO: 15805 - protein, 57 aa, Artificial Sequence
  Synthetic
DELEEVIDRNRKSLKEIEERNKKVIEDLRRAIKEIEDRLKEVLDRVKKRIEDIERRV

SEQ ID NO: 15806 - protein, 55 aa, Artificial Sequence
  Synthetic
EELRKKIEDVDRKVRKESEDLKRELKKLLDEIRRKVRELEERAKRVEEEVDREAK

SEQ ID NO: 15807 - protein, 57 aa, Artificial Sequence
  Synthetic
SELEEVIRDNERSLKEIEDKNREVTKTVREEIKRIAKKLKEVLDRNRETVRDIERRV

SEQ ID NO: 15808 - protein, 55 aa, Artificial Sequence
  Synthetic
DELRRRIKEVDKEVEEKSEKLKREVKAVLDRVEKLAEEIRKKVEDVDRTVEEKAR

SEQ ID NO: 15809 - protein, 59 aa, Artificial Sequence
  Synthetic
KEMEDLEREVERVLKRLEELVRELLETVRRTLTRLKRKLDEKKKELDKVNEDLDRVTRE

SEQ ID NO: 15810 - protein, 55 aa, Artificial Sequence
  Synthetic
ERVVKKLEDAIEEIKRKLEKVHDEHRRTVEKIEEDIRRVEEEHRRTIKEIKEKLK

SEQ ID NO: 15811 - protein, 59 aa, Artificial Sequence
  Synthetic
SESERLAKEVEKKLKDAERLVKELHEEVDRMNRDLERKLREISERAKKTTEDVERVAER

SEQ ID NO: 15812 - protein, 55 aa, Artificial Sequence
  Synthetic
EEVIKKVRKDIEEITRKLERSNREHERTLREIKKRAEKVHEDHRREIDRIREELK

SEQ ID NO: 15813 - protein, 59 aa, Artificial Sequence
  Synthetic
RESEELEREVERVLRELEELVKRLHDDVRRVDEELDRKVRDLHKKVRDVLRRVEKLVRD

SEQ ID NO: 15814 - protein, 55 aa, Artificial Sequence
  Synthetic
DRVVDRLRRKIEEIARRLRKSNEDHRRSLKEIKDKLEESNERLRRALEEIAERLR

SEQ ID NO: 15815 - protein, 60 aa, Artificial Sequence
  Synthetic
SEKDEVITRVETELRRVKTEDRDVARRVKEELEDLKRRLERVIEDNERTLRELKKELKER

SEQ ID NO: 15816 - protein, 55 aa, Artificial Sequence
  Synthetic
EDVVRELEKLLRDWEKRSREVEEKLRRLLDELRETLKEIEKELRRLDKEIKERLR

SEQ ID NO: 15817 - protein, 60 aa, Artificial Sequence
  Synthetic
DREEKVKRRVEEELDRVRRTDDRVLKRVEERLREDEKRNEEVIRRNEKTLRELEKRLRDN

SEQ ID NO: 15818 - protein, 55 aa, Artificial Sequence
  Synthetic
EDVVRELEELLKRWKETSERVKRELTDLLRKSEETSKEVTKTLRELDKRIEDELR

SEQ ID NO: 15819 - protein, 59 aa, Artificial Sequence
  Synthetic
SREEDLKRKIDEVDKEWKKLTKKLEEEIREVEKEWRKLSKELERKIREVEKRLKEAKDR

SEQ ID NO: 15820 - protein, 55 aa, Artificial Sequence
  Synthetic
EEVIKTLRERVKDIHREDKEIIDRLREKAERIKEHDRKLLEDLKRTLDKLRREME

SEQ ID NO: 15821 - protein, 59 aa, Artificial Sequence
  Synthetic
DEREEIKKELDRIIRESEELVKKIKDVIRKLIEESKRLVEKIREDIKRSNDKLDEVTRR

SEQ ID NO: 15822 - protein, 55 aa, Artificial Sequence
  Synthetic
EEVKRRAEDLLRRSDEKSKRIAEEAERRLDRSDEESEKILRDNEDMVRKWREKEK

SEQ ID NO: 15823 - protein, 59 aa, Artificial Sequence
  Synthetic
DETEKITKDLEDLIREDEKLVKDARDTLAKSNEDSRRLVEDLRRLIKESNEELERVVRE

SEQ ID NO: 15824 - protein, 55 aa, Artificial Sequence
  Synthetic
EDVVRRLERLSEESRERLERILRDNKRRLDKSLEDSKRLVEKNDRDLKKWKEDRR

SEQ ID NO: 15825 - protein, 59 aa, Artificial Sequence
  Synthetic
DERETVREELKELIERLRDLNRKIEELLRRSNEEIRRLVEEIRRRLKEMNDEIRRVLKK

SEQ ID NO: 15826 - protein, 55 aa, Artificial Sequence
  Synthetic
DKVLKEAKELLDASEKHLRDLIETNERVLKRWEEELDKIAEENERVLRKWEEEAK

SEQ ID NO: 15827 - protein, 61 aa, Artificial Sequence
  Synthetic
SEREEVLKKIREMSKRDNEKNKRILDDVRRLSKEDNKDNDRLVEEHRRKITELEDRVRKEG

SEQ ID NO: 15828 - protein, 55 aa, Artificial Sequence
  Synthetic
EVLREVEELSRRDEKRSKEILEEVSKLSKDDEDRSRDLLRKAEEENRRLEEKLRK

SEQ ID NO: 15829 - protein, 61 aa, Artificial Sequence
  Synthetic
SEKETVLEDIRRMSKEDNEKNERIVERARRILEKIEEKNRRVKEEAKKMLERIKKLVKDRG

SEQ ID NO: 15830 - protein, 55 aa, Artificial Sequence
  Synthetic
RVVDEVRKRSEEDERRSRELLEEVRRAVKRVEDKSRTTVREIRERVKEVKKRLDD

SEQ ID NO: 15831 - protein, 60 aa, Artificial Sequence
  Synthetic
SEVEDVVRKVRKLVEKSTRDNKRVLEKVRKLVKESSDKNKKVLDEVEELIERLREKLERI

SEQ ID NO: 15832 - protein, 56 aa, Artificial Sequence
  Synthetic
RDALEEIRKRVEDNKRRSDESLEEIRRLVEENKRRSEKTLKEIREKAKRLKDEIDR

SEQ ID NO: 15833 - protein, 60 aa, Artificial Sequence
  Synthetic
SEVEKVEREVDEMVRDSTKENEDILREVRERLKKIKEDLDRTVTEVRRLLKELEEKAREV

SEQ ID NO: 15834 - protein, 56 aa, Artificial Sequence
  Synthetic
KDMLDRVREKVKRNKEESDKSLDEIRRIAEEVKRRIDELLKEIKKRAEELKRKLRK

SEQ ID NO: 15835 - protein, 60 aa, Artificial Sequence
  Synthetic
SEVEEVLKRARELVERSTRENRKILERARKMLEDARKTNEDVLRDVERLLDELRRELEKI

SEQ ID NO: 15836 - protein, 56 aa, Artificial Sequence
  Synthetic
KEVLDEIRELVKENKKRSDDSLREAEKRLRELKEESDKTLDEIRRKLEKLKEEIDR

SEQ ID NO: 15837 - protein, 60 aa, Artificial Sequence
  Synthetic
DEVETVRKDVERLVRTSNDENRRILETARKLIKEVREKNKEVTDRVRDLLRRIEEEVKKV

SEQ ID NO: 15838 - protein, 56 aa, Artificial Sequence
  Synthetic
ERILEEIRRRVEENKKRSDESLKEARELLRDVERESDETLKEIEEEARRLKEEIDR

SEQ ID NO: 15839 - protein, 59 aa, Artificial Sequence
  Synthetic
DEVKKVVDEARKLVEDDKRTNEEVLRRTRELLERDERKNEEAVKRIRDLLKEIKKLVEA

SEQ ID NO: 15840 - protein, 56 aa, Artificial Sequence
  Synthetic
EELLKRIDELIKESKRRTKEAHRESEELARKTKKSTRDLLREVEKRLREIKEEIKR

SEQ ID NO: 15841 - protein, 59 aa, Artificial Sequence
  Synthetic
SDVEKVVDEVREKVKRDKEDNRRVAKEARELVKESSEKLERLVTEVKKLIKTIEKLVRD

SEQ ID NO: 15842 - protein, 56 aa, Artificial Sequence
  Synthetic
DELLKEIDKLIKESKKETDDLLKEIKDLIDENKRRIDKLLREIEKLARKVKRDIEK

SEQ ID NO: 15843 - protein, 59 aa, Artificial Sequence
  Synthetic
SDVEKVVEELRRLVRKDEEDNRRAVEETRRLVEDSSRKLEEMVRRVRDLIRKVEELVKS

SEQ ID NO: 15844 - protein, 56 aa, Artificial Sequence
  Synthetic
ERLLREIEKLIRESKKKTDDLHRESKKLIEDNKKRIDDLLKEIKDRVERVKEEIRR

SEQ ID NO: 15845 - protein, 59 aa, Artificial Sequence
  Synthetic
DEVKKVVDEVRKKVEEDKDDNRRAVKETRELVEESSRDLKRLVETSRRLIEEVERLVEK

SEQ ID NO: 15846 - protein, 56 aa, Artificial Sequence
  Synthetic
ERLLREIRKLITESKKTTRDLHRDSKRLIDENRKRIRDLHEETRKLVKEVLDKIRK

SEQ ID NO: 15847 - protein, 59 aa, Artificial Sequence
  Synthetic
SDVEKAVDEVRKLVKDSNEKVERVLREVRKLIEEDERKNREVFERVRKLIEDILRLVKG

SEQ ID NO: 15848 - protein, 56 aa, Artificial Sequence
  Synthetic
EKLLRDIREEIERNRRELEKALREIKKEIEKTKRKTDRLLETIKELIDRVVEEIKR

SEQ ID NO: 15849 - protein, 59 aa, Artificial Sequence
  Synthetic
DEVETVKRRVEELVKRSNEELKRIVEETRRRVEDDERDNERIIREIKKKLKDIEELVKS

SEQ ID NO: 15850 - protein, 56 aa, Artificial Sequence
  Synthetic
EEILKTIRRLIEKNREDIDRLHEESKREIDRTKERTDRLLDDVRRIAERIKEEIDK

SEQ ID NO: 15851 - protein, 59 aa, Artificial Sequence
  Synthetic
REVEEVLKEVDELVRKSNEDLKDIVRRTRDLLRKDKERNDEVVRRSEELIRRVEELVRR

SEQ ID NO: 15852 - protein, 56 aa, Artificial Sequence
  Synthetic
EEALERIKRKIDENEKEIRELHKESEKRIRDTLRATDKLHKDTRRRVEEVKEEIKK

SEQ ID NO: 15853 - protein, 59 aa, Artificial Sequence
  Synthetic
SDVERVVERARDLVRKSDDDLRKMVAETKRLVEESSKKLDKIVRESRELIRDVKRLVEE

SEQ ID NO: 15854 - protein, 56 aa, Artificial Sequence
  Synthetic
EELLKEIKKRIDESREKTKRLHEESRKLIEDNKRRIDELHKETKEEVERAKKEIED

SEQ ID NO: 15855 - protein, 60 aa, Artificial Sequence
  Synthetic
EEVKRALEELDELVKRIEEDSRRMVKEAEDLVEKIRKEIEDLLRRSRKLNEDIRRLIDRD

SEQ ID NO: 15856 - protein, 56 aa, Artificial Sequence
  Synthetic
EDILRRADELLKRLRRKDEELTKKIERLLEKVAKEVEDINRESKRSADEVRKRVRK

SEQ ID NO: 15857 - protein, 60 aa, Artificial Sequence
  Synthetic
SSVKEVRDELKRLVDEIRKESEDMVERLRRLVEEIRKRNEELVRRSEELNERARRLIERD

SEQ ID NO: 15858 - protein, 56 aa, Artificial Sequence
  Synthetic
DKILKEAEDLLRDLERRDRELTREVEKLLEELRRTSEETNKRSKESADRVEDEVRR

SEQ ID NO: 15859 - protein, 60 aa, Artificial Sequence
  Synthetic
KEVEEALKRVRELVKRAEDMNEELLRRSRKLNDEIRRRIEEMLRRLEEVVRRIKELVDRD

SEQ ID NO: 15860 - protein, 56 aa, Artificial Sequence
  Synthetic
EKILTEIEKRLKDLEKKSRDSNRESEESLERIRRKVEEIARRVRELLDRLRREVER

SEQ ID NO: 15861 - protein, 57 aa, Artificial Sequence
  Synthetic
SRLEEVTRRARKLVEDITRELRKAVEDSRRVVDKIRRLNEELTRRSRELVKEVKDKV

SEQ ID NO: 15862 - protein, 59 aa, Artificial Sequence
  Synthetic
EKVREILEEIRRLLEELEREVKELNEESKRRLDELEKRSEETNKESEDLLEKVRRDVEK

SEQ ID NO: 15863 - protein, 57 aa, Artificial Sequence
  Synthetic
SELEDVVRRLDELVKRIKEENRETLERSRRLVEEAKRTNEETEDRMRRLVEEIEKKV

SEQ ID NO: 15864 - protein, 59 aa, Artificial Sequence
  Synthetic
EEVRRLLEEIRRKLEDAKRHVEELSEESKKLLKELEEHVREVNKKSEKLLRELKDKVKT

SEQ ID NO: 15865 - protein, 57 aa, Artificial Sequence
  Synthetic
SELEKLVEDVRRLVEKIKRDNRKTLKELEELVREIVERNRDTLRRSRELVDRIKKRV

SEQ ID NO: 15866 - protein, 59 aa, Artificial Sequence
  Synthetic
EDVRRVLKEIKELLERVREHVERLNRDSERLLKDLEEHARRLSKESKELLRELEERVRT

SEQ ID NO: 15867 - protein, 60 aa, Artificial Sequence
  Synthetic
SEVEKIREDVKKLIEESKKLNRDILEEVRKMIERWRDTTRRIRERIRKLIEEAEEEIKRS

SEQ ID NO: 15868 - protein, 56 aa, Artificial Sequence
  Synthetic
SEVLEEVKRLVEESKRESDEILKRVKKLVDDLARTDDKVLEDIKREVDRLKKELED

SEQ ID NO: 15869 - protein, 60 aa, Artificial Sequence
  Synthetic
SEVEKIKKDVDRMITEWEKRSRDIAKTVDELIEDSRRLNETIRRDVDRVARELKERIKRT

SEQ ID NO: 15870 - protein, 56 aa, Artificial Sequence
  Synthetic
DDVLKKIEEALKRLADRDDDILRRIETLVRKTRRESEELLKEVEDKMRKLKEELRR

SEQ ID NO: 15871 - protein, 60 aa, Artificial Sequence
  Synthetic
SEVEKLTEDVKRLIEKSKRNNRDILRKVKEDIDEWRKRTKKIADEVRKTERDLEEKIKRT

SEQ ID NO: 15872 - protein, 56 aa, Artificial Sequence
  Synthetic
DEVLRRIEEDLKRSKKETDDILKEVKDLLTDLLRRDDEVLEEIKRRAERIKEEIDR

SEQ ID NO: 15873 - protein, 60 aa, Artificial Sequence
  Synthetic
REVEKILTDVRRLIEEWRKKTEDIKREVDKLIEEWRKRSDEIADRSRKLAEEIERLLREG

SEQ ID NO: 15874 - protein, 56 aa, Artificial Sequence
  Synthetic
ERVLRKIRRDLERLKKTDDDVLKTIEKKLRELEERDRRLHKESREIAEKLKEDIDR

SEQ ID NO: 15875 - protein, 60 aa, Artificial Sequence
  Synthetic
DEVETIMEKVERDVKRWEELTREIKRRSDKLIEDWKKRSEEVLRESTELIKTIEKLLREG

SEQ ID NO: 15876 - protein, 56 aa, Artificial Sequence
  Synthetic
ESVLRTIDELVRRLEEEDRKVHEESKELARRLEKEDKRLHEESKKLIDELEKKIRD

SEQ ID NO: 15877 - protein, 59 aa, Artificial Sequence
  Synthetic
SEVEKILDEVRKLVKKWDDETRKILEEIDKLIEDSERLLEKIERRSKKLADEIRDLLRK

SEQ ID NO: 15878 - protein, 56 aa, Artificial Sequence
  Synthetic
KSVLDEIRERVTRAKEKDKRVLERVKREVERTKEESKRVHEKSREIIERLKKEIDK

SEQ ID NO: 15879 - protein, 57 aa, Artificial Sequence
  Synthetic
DEVRKVRKELDDAVRKLRRDHERVIRESEKVSKEIEDRARDVERRLDKVVDELRKKD

SEQ ID NO: 15880 - protein, 55 aa, Artificial Sequence
  Synthetic
EEVMKRLRDMIRRLKEDAEKLKRELKRRHERVKELLDKVRRELEKLEKEVDDKVK

SEQ ID NO: 15881 - protein, 57 aa, Artificial Sequence
  Synthetic
DEVREVERESEELSEELRRRHEEVVKESEEVSKEIEERIREVIRDLRRVLRKLEEDG

SEQ ID NO: 15882 - protein, 55 aa, Artificial Sequence
  Synthetic
EEVVKELRELHDRSRKKVEDIAREARDMHRKAADKLRRLMEDLKRVLEEIRKKVE

SEQ ID NO: 15883 - protein, 56 aa, Artificial Sequence
  Synthetic
SRVDKIRRELRELLERDREDLERAMRELRKIDKDIDERLKEVVERLRRIDERIDRE

SEQ ID NO: 15884 - protein, 55 aa, Artificial Sequence
  Synthetic
KEVEKEVEDAIRETEKRAREVEEENRKSVEDVRRKMKKVEEENRKSVEDVRRKAT

SEQ ID NO: 15885 - protein, 56 aa, Artificial Sequence
  Synthetic
SRVDKIRKELEDLLREDEKRIRDMVKRLREIDEKIDRELEKVARELRELLKRVEDS

SEQ ID NO: 15886 - protein, 55 aa, Artificial Sequence
  Synthetic
EEVEKKVRELVERTEETVRDVERENKESVKRVREKAETVKREVEKRAKEVRDKAK

SEQ ID NO: 15887 - protein, 60 aa, Artificial Sequence
  Synthetic
SEMEEVEERLKELDDKDKRDVDEARKRLEKLDRDIDRRIKEVTKRLRDLNRRIEEELRRN

SEQ ID NO: 15888 - protein, 55 aa, Artificial Sequence
  Synthetic
EEVEKKNRKSADDSRETAKRVEEENERTIKRLEEELREVEEEDRKTVEDLRRTLK

SEQ ID NO: 15889 - protein, 60 aa, Artificial Sequence
  Synthetic
DEVREVTKELRDLDREDKKRVEEATKRLRDLNEEDKRLVKKVADDLREDLKRIRERLERN

SEQ ID NO: 15890 - protein, 55 aa, Artificial Sequence
  Synthetic
EEVEKENERSVKKSEEDLKRVKDEDEESVKESRKAVREVEEELRKRLKELREELK

SEQ ID NO: 15891 - protein, 57 aa, Artificial Sequence
  Synthetic
SEDETVRREVRELIRRLRKHSEDVKRESDKLLDEIRRRVKEVEDRVKEAVERLDRKK

SEQ ID NO: 15892 - protein, 55 aa, Artificial Sequence
  Synthetic
EDVVRKIRTVVKKIEEDNKKTADELRKLHKDIKKEVDDMEKRIRKVLDEIDKEIK

SEQ ID NO: 15893 - protein, 57 aa, Artificial Sequence
  Synthetic
DEEERARRELEDLLRRLREHSERVAKEVEEVVERNRRKSEEVEKRVREMLKRLDEKK

SEQ ID NO: 15894 - protein, 55 aa, Artificial Sequence
  Synthetic
KDVVKEIRDRVREAERRNREVVEEIRKLLKEIDKTTRDVEEEIRKLLKRIDEEIN

SEQ ID NO: 15895 - protein, 57 aa, Artificial Sequence
  Synthetic
DEERKARTEVKKEVDDLKKHVKDVADEVREAVKKNRRKSEEVSREVRDLIRRLKETK

SEQ ID NO: 15896 - protein, 55 aa, Artificial Sequence
  Synthetic
EDVVREIRELLKRIREENRRTVEEIRKLLKRIDEATEELVREIRRVVKEIEDKIR

SEQ ID NO: 15897 - protein, 57 aa, Artificial Sequence
  Synthetic
DREEKLRKELKKLIDDDRKKSEDVEREVRKLIKENEDKSRKVEEEVRKLAEELDTKK

SEQ ID NO: 15898 - protein, 55 aa, Artificial Sequence
  Synthetic
EEVIKEIRTVVKRVNEESEEMTKRIRDVVREADKTTEDVRRKIEDMVRRIDERTN

SEQ ID NO: 15899 - protein, 60 aa, Artificial Sequence
  Synthetic
DELRRIEEEVRRRFEEMARRHRKVKRDIEELVKEVTKRNKDTEREIEELVKRMKDEIDRI

SEQ ID NO: 15900 - protein, 59 aa, Artificial Sequence
  Synthetic
EEKVRRVVKKAREAVERSSREVEKVEREVKKLLDDLKKHSEEVEKKVRELLKRLEDRAR

SEQ ID NO: 15901 - protein, 60 aa, Artificial Sequence
  Synthetic
SELEEIVKTAREIMDRVRREHDRVATEIRELVKRLEEANRRVREEIKRLVKEVEERIRKI

SEQ ID NO: 15902 - protein, 59 aa, Artificial Sequence
  Synthetic
REEVEKVVKEIEDVVRESSERVRRVVEEVKKLLRELAKHSEDVEREVRELLKKLAREVD

SEQ ID NO: 15903 - protein, 58 aa, Artificial Sequence
  Synthetic
DELKEIRDRIKKRVEELRRENEEVREEIERIVRKAREDHRRVERELEDLVRRARDKVE

SEQ ID NO: 15904 - protein, 59 aa, Artificial Sequence
  Synthetic
EEEVRRVVKEVEELLEDLKRHSEKVKEEVKRLLEESSREVERVEEKAREMLERLRERAR

SEQ ID NO: 15905 - protein, 60 aa, Artificial Sequence
  Synthetic
SEAEKLRDEIRRIVEKAERDHEDVKKKIEDLVKRVEERNREVTKRIRDLVRDARRRLDEI

SEQ ID NO: 15906 - protein, 59 aa, Artificial Sequence
  Synthetic
KDKLKKVEEEVEELLKKSNRKVREVKRELKELLDRLAKHSDEVRREVEELLRDLARRAT

SEQ ID NO: 15907 - protein, 60 aa, Artificial Sequence
  Synthetic
SELEKIREDMRELVERLKEANDRMREKIRKILEDVDREHEEVRKRIEELVKRARETIERI

SEQ ID NO: 15908 - protein, 59 aa, Artificial Sequence
  Synthetic
KDKVKKVKEDVKRLLDELRKHSEKVIREVEKLLRESNEKVKRVKEKLEELLRRLRERSR

SEQ ID NO: 15909 - protein, 56 aa, Artificial Sequence
  Synthetic
DEIETIKKEIDDMLREIKREVERSKEEIDRALKRIREEVKKSEEEIDKALEELRRN

SEQ ID NO: 15910 - protein, 59 aa, Artificial Sequence
  Synthetic
EEIIKRLLEKIRREARKVKELIRTSNEEVRKRLKDLEELIRKSHEDVRRTLETLERETR

SEQ ID NO: 15911 - protein, 60 aa, Artificial Sequence
  Synthetic
DKERELDKEVRDMIDTLRDSNRRINERSERVLRELDESVKKNEEDIRRAIEELKAEVRRD

SEQ ID NO: 15912 - protein, 55 aa, Artificial Sequence
  Synthetic
EKVLKEIRDLARKIKEDNDRSLEDNDRLAKEIKERNKRVHDETRKMLEDIKRELT

SEQ ID NO: 15913 - protein, 57 aa, Artificial Sequence
  Synthetic
DEDKEIDERVKTVKEEIRRRSKKDKEEVDRVLKESDETLKRILEEVKKVLKEIEERV

SEQ ID NO: 15914 - protein, 59 aa, Artificial Sequence
  Synthetic
EEELRRIVERVRERVTELREKLKEIHKRTREVADELRKNNRRWEEDVRRLVKELREREE

SEQ ID NO: 15915 - protein, 57 aa, Artificial Sequence
  Synthetic
DEEERIRTKVEKVKRELEEKSERDKRALEKVEDESRRTSEEDERELERVIEEIIREV

SEQ ID NO: 15916 - protein, 59 aa, Artificial Sequence
  Synthetic
EEELRRIEREVDRAVKELDRLLRELHRRTREVVKELRDLDRRIHEDTRRVVREAREEVR

SEQ ID NO: 15917 - protein, 57 aa, Artificial Sequence
  Synthetic
SEREEIEERVERVERESEDTSRRDEEALERVLRESEDTSRKDREALRKALEDIEREL

SEQ ID NO: 15918 - protein, 59 aa, Artificial Sequence
  Synthetic
EDVLRRIMEDVKRVADKLRELDKKIHEETRRAVDDLRRLDKEIHDRTRKLVKELREEAK

SEQ ID NO: 15919 - protein, 59 aa, Artificial Sequence
  Synthetic
SEIEEITKDLRRLVEEIERLNKRVEDENERTAKELRDRVREAEKKNRKTVDDIRKLIED

SEQ ID NO: 15920 - protein, 55 aa, Artificial Sequence
  Synthetic
DEVRREVDELIKKSRETLKRIERRSEEVAEELERRLRDIKRRSEDMVRELEERAK

SEQ ID NO: 15921 - protein, 59 aa, Artificial Sequence
  Synthetic
DEKEKVTKKIEELLKAIEDKIREVEKRSRDSAKEIEDRNREVEKRNKDTVRRIRELIER

SEQ ID NO: 15922 - protein, 55 aa, Artificial Sequence
  Synthetic
EEVRKRLEDAVERIKKELKRIKDENDEVVKKSRDSLRRIKEDSERVVRELEERAK

SEQ ID NO: 15923 - protein, 59 aa, Artificial Sequence
  Synthetic
KRKEDIERRIEKLVRDDRRLVREAEKRSKESVDRLRDLVDKARKESDESARTIDKLIKD

SEQ ID NO: 15924 - protein, 55 aa, Artificial Sequence
  Synthetic
ERVRKRLEDVVRESKKRLDEIKKRNEDVVRELEERLRRIEERNRRVAEELKRKAK

SEQ ID NO: 15925 - protein, 56 aa, Artificial Sequence
  Synthetic
SEIEDIERELRESNKRHEDTLRKIKRDLEDSNRRHRETIRDIEARLEEVIKKLRED

SEQ ID NO: 15926 - protein, 56 aa, Artificial Sequence
  Synthetic
EEELRELVKRVHERAERVNRDLKRKVKEVHDRVREVNKELRRKVEELKRRAEERRR

SEQ ID NO: 15927 - protein, 56 aa, Artificial Sequence
  Synthetic
SEIEDIKRKLDDVIREHARTLKEIKDELKKSNERARERIEDIDRKLRDVERRLRES

SEQ ID NO: 15928 - protein, 56 aa, Artificial Sequence
  Synthetic
VEELEDLVRRLKKRVEEVNKRLREKVKRLHDEVDRVLRELEEEVKKLKEDVERAAK

SEQ ID NO: 15929 - protein, 56 aa, Artificial Sequence
  Synthetic
SEREKIEEDIKKALKEAREVVERIKKKLDDSNREHKRTLDEIKKKLDEVIDEVRKS

SEQ ID NO: 15930 - protein, 56 aa, Artificial Sequence
  Synthetic
EEEIREDLERIVTEVKKVLDELDKLVKDLHDEVRKVNEELDRKVKKLRKEAEEKTR

SEQ ID NO: 15931 - protein, 56 aa, Artificial Sequence
  Synthetic
SEIEEIKRRLEDSNRRAREVIKRIEDELRRSNEEHRRTLKEIKEELDRVLEELKRK

SEQ ID NO: 15932 - protein, 56 aa, Artificial Sequence
  Synthetic
EDELREVVKRVHDEVRRELKKLEELVKKVHEDAKRVNEELRRKVKEVKERAERDVR

SEQ ID NO: 15933 - protein, 59 aa, Artificial Sequence
  Synthetic
RREEEVEKRLDDARRRLEKSNRDDERLTRTVEEELKRSNDEIRKRLETAMRELKKLVKD

SEQ ID NO: 15934 - protein, 55 aa, Artificial Sequence
  Synthetic
EEVERRLEKVEEDSRRELKRSEKRSDEVARDSERLLDEWRRRLEEVIRRVKEETR

SEQ ID NO: 15935 - protein, 59 aa, Artificial Sequence
  Synthetic
SREETVRERLREVAERLKKSNREIEELLKKAAEELKESNTRDKKLSEDVSRRLEKLSRD

SEQ ID NO: 15936 - protein, 55 aa, Artificial Sequence
  Synthetic
EEVEERLKRVIEESERRLDKWRRDLDRVIKESEDLLKKSREDSERVVREVEKKEK

SEQ ID NO: 15937 - protein, 60 aa, Artificial Sequence
  Synthetic
SEIEEVERMLEDLERRVREADKRVREESKKLEDEIRREDKRVEEMIDEVRKKVDELDRDV

SEQ ID NO: 15938 - protein, 59 aa, Artificial Sequence
  Synthetic
KDEVRRIEEEVDRVIEENRETVKEIEERNRRVLEANRESLRELEERLKRILEEVRRRSK

SEQ ID NO: 15939 - protein, 60 aa, Artificial Sequence
  Synthetic
SEIDEVRREVEELERRAEEVDREVERRSKELKERVDDVDRRSRELSKRLKDTADEVRKRV

SEQ ID NO: 15940 - protein, 59 aa, Artificial Sequence
  Synthetic
KDKLETIRRRLEEVLKRNKETVDEIRRRNEDVIRRNEESLEKNERDLRRVLDEVRRSAT

SEQ ID NO: 15941 - protein, 60 aa, Artificial Sequence
  Synthetic
SELEKVDELVKRLMKEVRDVDRRSEKLTEELERKVREMDRKSKKLSEDLERDARRVEKEV

SEQ ID NO: 15942 - protein, 59 aa, Artificial Sequence
  Synthetic
KDALRAIEKKLEDILRRNEETLRRNEDKIRRIIETNKRSLEENRRRLEEVLRRVKESAR

SEQ ID NO: 15943 - protein, 60 aa, Artificial Sequence
  Synthetic
SITEKVERLIRELERKVKEIDDDLRRTSEEIMKRARKADEDSERLSERLRELVDRLDREV

SEQ ID NO: 15944 - protein, 59 aa, Artificial Sequence
  Synthetic
RESAERLKEELRRVLEENRETLERLREENERVLEENKRRVDENREKIKEVLRRVEERTR

SEQ ID NO: 15945 - protein, 60 aa, Artificial Sequence
  Synthetic
SITERVEEDIKRLMEEAKRVDDKVRKLVEELMRDVKRVDKELAELVEELERRVKDLTRRV

SEQ ID NO: 15946 - protein, 59 aa, Artificial Sequence
  Synthetic
REEAERLKEELRRVLEENRRTVEEIERRIKRVLEENEETVRRLEKRIEEVLRDVREKTK

SEQ ID NO: 15947 - protein, 57 aa, Artificial Sequence
  Synthetic
SKVEELKRRLKKVRDDDRRSVEKLRETLRRVLARDRDEIREAERELREALKRLEDAG

SEQ ID NO: 15948 - protein, 55 aa, Artificial Sequence
  Synthetic
EDVLRDVERVVREVLEKNKKILKEVKEVVEESLRNVRDLIRRAREIVKEIVDRVK

SEQ ID NO: 15949 - protein, 57 aa, Artificial Sequence
  Synthetic
KEVEDLRRELEEAKKRDKDLIDKLKRRAEEVKEEDERSIRENKKALRKAEEDLRRKG

SEQ ID NO: 15950 - protein, 55 aa, Artificial Sequence
  Synthetic
ERVLEEVRKTLKRSMENVEELEKELEELVTRVRDHNRRDHEETRRLLEEIKRRVD

SEQ ID NO: 15951 - protein, 57 aa, Artificial Sequence
  Synthetic
DEVERLKEKLEEVRRRDEEIIRKLEEDLERVKRDDDRLVRENEEELKRVEEKLERDG

SEQ ID NO: 15952 - protein, 55 aa, Artificial Sequence
  Synthetic
EEVLRRVEEAAKRSLDNVDKLEKDVADLVRRSMENVRDLHRRTRRLLEELKEKVK

SEQ ID NO: 15953 - protein, 60 aa, Artificial Sequence
  Synthetic
SEKEKVLEDAERVLREIKKKNEKALREAEEVARRIAEEVKRIHDRSKEVVDDIKRLADAG

SEQ ID NO: 15954 - protein, 55 aa, Artificial Sequence
  Synthetic
KDVERRVREAKKENDKSVDEIREEVKRVKDELDRLSERNEEELEKVERDLRRRAK

SEQ ID NO: 15955 - protein, 56 aa, Artificial Sequence
  Synthetic
DEEKKVLDKLRELATRLSRRVEEAHRESEKIAEEIRRRAEKVLRESRKTVEEIKRS

SEQ ID NO: 15956 - protein, 55 aa, Artificial Sequence
  Synthetic
ERIKDDVRRMKKELEDLIEENRRRVEKVKEDIRRLIRELEARNEDVDRELRRKED

SEQ ID NO: 15957 - protein, 56 aa, Artificial Sequence
  Synthetic
SRLEKVEKELEELAREDKERIKRVIDDIRRLVREDEERIKEMHKKTEDIVRAIEEE

SEQ ID NO: 15958 - protein, 55 aa, Artificial Sequence
  Synthetic
ERIKKRVEKLKRDSKRLIDELRKELEEVVKRSEDLIKENRDTVKEVSDRIREKAR

SEQ ID NO: 15959 - protein, 56 aa, Artificial Sequence
  Synthetic
DDEERVLKELKKLVEDDRKKIEDVIETIERLAREDVERIKRVIEELRRLVKELEDG

SEQ ID NO: 15960 - protein, 55 aa, Artificial Sequence
  Synthetic
EEIKEDVKRAADESEKLIRELRKAVKRVEEESRRLIEELEREVKEAEERLKRRTK

SEQ ID NO: 15961 - protein, 60 aa, Artificial Sequence
  Synthetic
EEVERLLEELKELVRRIEERLKRAHDEMEDLVRRIKEEIKKLHEDTKRVVEEIRKLIERD

SEQ ID NO: 15962 - protein, 58 aa, Artificial Sequence
  Synthetic
ERVKEAEDRVRDAVRRLKRLLEEHKKASEKVVRELERLLEENRKTVKEVVDRLREESR

SEQ ID NO: 15963 - protein, 60 aa, Artificial Sequence
  Synthetic
REVEELIKELRRLAEEIRDRIRKLHKEMEDLARDIERRIEELDRELERVATEIAKLIERD

SEQ ID NO: 15964 - protein, 58 aa, Artificial Sequence
  Synthetic
EDIKRLEEEVRKVEEELKKLLKEHRDANKEVVDRLKRRIEEHKRKTKDLKEELERRMR

SEQ ID NO: 15965 - protein, 60 aa, Artificial Sequence
  Synthetic
DEVEEVIERLRRLAERIEERLREMDRRLEELVERAKRTIERLHEELEKLVREAEELIRRD

SEQ ID NO: 15966 - protein, 58 aa, Artificial Sequence
  Synthetic
KDVTRLEEELRRVVKKLEDLLREHKEKSDRAVEDLERLLTEHKKRNEDVIRRLKEASD

SEQ ID NO: 15967 - protein, 57 aa, Artificial Sequence
  Synthetic
SEVEEIRKKAEDVMRRLEELDKRLDEVLKKVSRELEKSDKDLEDRIREVIRELEERG

SEQ ID NO: 15968 - protein, 55 aa, Artificial Sequence
  Synthetic
DEMERRLEEVVKEAERRSEEVLRRLEKVVKDIKKKSKEILDRLEELVREIRERVR

SEQ ID NO: 15969 - protein, 56 aa, Artificial Sequence
  Synthetic
SESEEIDREAKKVEREVREMSRRNDEELRRVAKESEDSVRRVEDRVREVSEEVEAR

SEQ ID NO: 15970 - protein, 59 aa, Artificial Sequence
  Synthetic
EKELTEILKRLKDLADELRKLLEDVHRRSKKAADEDRKLNEDILKELEDLARELRKKTK

SEQ ID NO: 15971 - protein, 56 aa, Artificial Sequence
  Synthetic
DEEKKVRDEIRRAEEESRRSSKRNEDELRKVKEEIERRLEEVRRKAKEVEEKVRRE

SEQ ID NO: 15972 - protein, 59 aa, Artificial Sequence
  Synthetic
EEELRRILERLKEMVERDKETNEEIHRRSKDVVDKLRRRIEDIKRRLDELAEKLKEDTR

SEQ ID NO: 15973 - protein, 56 aa, Artificial Sequence
  Synthetic
DDERRIRETLKRADEEVEKALREVREHTKDVERENEKLSKENKERLEEVKKRVDDS

SEQ ID NO: 15974 - protein, 59 aa, Artificial Sequence
  Synthetic
KDVLRKIEKEIEEMVKDLRRLLKEVEDKDRTLAEELRRINEDIHRRSEEMKKELDDRTR

SEQ ID NO: 15975 - protein, 60 aa, Artificial Sequence
  Synthetic
KEVEDVEEKIREIVERIRDEARKAEERNRDTVRRIEDVARKLHKRTKEIVDEIRDVLTKR

SEQ ID NO: 15976 - protein, 59 aa, Artificial Sequence
  Synthetic
KEMLETIKRKVEKVKEDLRKKIEDIEKHTRDVEDKVRKELERNEKKSRDVKEEVERRLT

SEQ ID NO: 15977 - protein, 60 aa, Artificial Sequence
  Synthetic
SELEKAEKENKDSADEIREVLKRLEEENRETAKRIEKHTRDAHRKTEDIVRRIEEVLRRR

SEQ ID NO: 15978 - protein, 59 aa, Artificial Sequence
  Synthetic
KEALKRIRDHVEEVRREVEELLRKIREHTKEVAEKVRRENEKNKKRSEDVRKKVEDDER

SEQ ID NO: 15979 - protein, 60 aa, Artificial Sequence
  Synthetic
SEVERVLEENRKSAKEIEDELRKVLRENEKSAEDIEREIDKAEKENRETVKDLRRVLTER

SEQ ID NO: 15980 - protein, 59 aa, Artificial Sequence
  Synthetic
KEKLETIERHVRKVEEDVERMLKEIERRTRDVMRKVDKLIKEIEKHTREVAKEVKEAED

SEQ ID NO: 15981 - protein, 56 aa, Artificial Sequence
  Synthetic
SLVEDLERKLEESTRRDEESMKRVREILKELEDRDRKSVKEIEDELRKARKEVKDS

SEQ ID NO: 15982 - protein, 59 aa, Artificial Sequence
  Synthetic
EEMAREVIKTLEKVSRELEETNRRVIDRIRKLAEEILRKNKEVLERLRKIVKEIKEKAK

SEQ ID NO: 15983 - protein, 56 aa, Artificial Sequence
  Synthetic
SLVETLKKILDDSTRRNEELIRRLEEELKRIKETNERTVRELERELKRAEEEIERQ

SEQ ID NO: 15984 - protein, 59 aa, Artificial Sequence
  Synthetic
EEAAKRVIERLRRLSERNVRTLEEIIKTLRDLARRSKERDDEVLEELKEMIRRIEEKSK

SEQ ID NO: 15985 - protein, 57 aa, Artificial Sequence
  Synthetic
DELEKVVRELEELAKEILKKLDEIIRDTERLVREAVKRLRELIERTRRLMDEVRKKV

SEQ ID NO: 15986 - protein, 59 aa, Artificial Sequence
  Synthetic
EKVMRELEDTVRRVREELRKLLEEHNRRVKKVLEDLDRLLDEHRKIVEDIKRDLDRREK

SEQ ID NO: 15987 - protein, 57 aa, Artificial Sequence
  Synthetic
SEIEKVLEELRELVKKAVTDLRRIIEESKRLADEAAKALKDIIRRSEELADRLRKEI

SEQ ID NO: 15988 - protein, 59 aa, Artificial Sequence
  Synthetic
EKLARELEDVVRKVKETLDRLLEEHKEIIERIKRTLDKLLKEHNEIVERIKRDLDRRRK

SEQ ID NO: 15989 - protein, 57 aa, Artificial Sequence
  Synthetic
DEMEKVIRDDEKLLEDVLRRLAEIIRRTEKRAEEMVRELEKLIEDSKRKADDVRKRV

SEQ ID NO: 15990 - protein, 59 aa, Artificial Sequence
  Synthetic
EEVVKRLDDIARDVNRTLDKLLKDHNEIVERIERTLDELLKEHNEIVKRIKEDLDRKRK

SEQ ID NO: 15991 - protein, 57 aa, Artificial Sequence
  Synthetic
DDAETVIERDRKLADEVAKELKRLIEETRDLARRIREELRRLIEELKTLAKRAKDEV

SEQ ID NO: 15992 - protein, 59 aa, Artificial Sequence
  Synthetic
RDVVRELREIARKINEDLDDLLRKHNEIVEKIKRDLDRLLEEARKILEEIKRELDETKK

SEQ ID NO: 15993 - protein, 60 aa, Artificial Sequence
  Synthetic
DEEERLRDSVRRSRELIKEIRKRLEESIRRSERINERVREELRRSVRESERSAEEARRRG

SEQ ID NO: 15994 - protein, 56 aa, Artificial Sequence
  Synthetic
TETVLEEHKERVKRILDRARDLLRKHRELVEDSRRHLEKLLRDHRKVVKEIEDKIR

SEQ ID NO: 15995 - protein, 59 aa, Artificial Sequence
  Synthetic
SEEERLRESLERSRKRLEEVKRELERKLEEWEEIVEESRRRAEKSLRESKERIDDLKRR

SEQ ID NO: 15996 - protein, 56 aa, Artificial Sequence
  Synthetic
TEEVLRRHEKVVRRIDEELEELLEELERVIREDTERNKKLLDEHREVVKEIEERVR

SEQ ID NO: 15997 - protein, 60 aa, Artificial Sequence
  Synthetic
SSEKRLRDSVRESRDRARKIEEDHRRLVEEWERLVKRSEEEVRKSVEESREEVEKAKKEG

SEQ ID NO: 15998 - protein, 56 aa, Artificial Sequence
  Synthetic
TDKVLEDHKRLVEKILKEAEDNLRRSRKMIREDEERNRDLLRRHREVVKEVKRKVD

SEQ ID NO: 15999 - protein, 59 aa, Artificial Sequence
  Synthetic
DKEERLRESLEKSDRDIRRIKEELERLLREWEKRVRDSEKELRDVLRKVTEEAKELKKQ

SEQ ID NO: 16000 - protein, 56 aa, Artificial Sequence
  Synthetic
TDDLLRRHKEVVEKILREIEELLRELREAIRRDKKRNDELLKRLAEVAEKIREDVR

SEQ ID NO: 16001 - protein, 60 aa, Artificial Sequence
  Synthetic
SEKETLERSIRESERILEEVLRELKKVLDEWRRRVEESEKRHRDLIEEVRRRAKKLREDG

SEQ ID NO: 16002 - protein, 56 aa, Artificial Sequence
  Synthetic
TDDLLRRHKELVEEIKELLERLLRELEEVIKRDKDKNDENLTRSKRLIEEIEERVR

SEQ ID NO: 16003 - protein, 60 aa, Artificial Sequence
  Synthetic
DSEERLKESVKRSEDDLKRLRDEHRKLVEEWRRRIDESERRHRKLIEDVRRRLTEFRKRG

SEQ ID NO: 16004 - protein, 56 aa, Artificial Sequence
  Synthetic
TDRLVEEHKKMVKEIRDRVKANLERSRRMIKRDKEKNDDNLRRSKELIDKLEEDVR

SEQ ID NO: 16005 - protein, 59 aa, Artificial Sequence
  Synthetic
SKEERLRESSRRSEKAVREVEKRHKESVERSKEEIRRLAEELRKSIEDSERRIKEIRER

SEQ ID NO: 16006 - protein, 56 aa, Artificial Sequence
  Synthetic
TDRLLEEHRKLVERILEELEKNLERHRRVVKEILDRVKELLDEHRRRVEEIERKIE

SEQ ID NO: 16007 - protein, 59 aa, Artificial Sequence
  Synthetic
SKEETLKRSSEESKKELKRVDEELEKIIREWEEDVKRSEKELEEVIERAKREAEKLRTR

SEQ ID NO: 16008 - protein, 56 aa, Artificial Sequence
  Synthetic
TDTLLERHKRLVEEVREKLERLLRRLRKVIKEDRERNKRLIKRLKEVIDEIRERVR

SEQ ID NO: 16009 - protein, 59 aa, Artificial Sequence
  Synthetic
SERERLEDSSRKSKERLERIARTLEKLLRDWRREVEKSEKRHRELVEKVRRDLDDLRRR

SEQ ID NO: 16010 - protein, 56 aa, Artificial Sequence
  Synthetic
TEKLLRDHKRLVDDLDRRAKELLEELKRVIDEDKKRNEKNLTDSRRLVEELKEEVR

SEQ ID NO: 16011 - protein, 59 aa, Artificial Sequence
  Synthetic
SSKERLEESSERSERSIERIDREHERSSEESERRLKKMVDDLRRSSEKSKDDLEKLKRE

SEQ ID NO: 16012 - protein, 56 aa, Artificial Sequence
  Synthetic
TDELVERHKRVVEEIEERAERNLRRHKKVVEDILREARKVLEDHKELVERLKERVE

SEQ ID NO: 16013 - protein, 59 aa, Artificial Sequence
  Synthetic
DAERRLKKSSEDSKRAIDELRKEHEDSSRESKERLDKIKRDHEELVRRARERAEELRRR

SEQ ID NO: 16014 - protein, 56 aa, Artificial Sequence
  Synthetic
AEKLVTDHKRVVETILDKARKNLDRHRRAVEDLLRKARENLKKTEELVRKLDEDVR

SEQ ID NO: 16015 - protein, 59 aa, Artificial Sequence
  Synthetic
DAERRLREILRRVTERLKEVKERHKRSSEKSKKSADDVRREHEKLAEELRRKVEELKRR

SEQ ID NO: 16016 - protein, 56 aa, Artificial Sequence
  Synthetic
TDTVIEELKRRIRELEKRLEENLRRHEELVRRIEEELKRNLKRSRDLLKEIEDKVR

SEQ ID NO: 16017 - protein, 59 aa, Artificial Sequence
  Synthetic
SEAEEVLRRLEELAKRDREENKKVLDDLEKLVREDEERNKEVLKDLEKFIDELDKELRS

SEQ ID NO: 16018 - protein, 59 aa, Artificial Sequence
  Synthetic
KDVVRELERLLREWERDNERSREEIDRVIEEARKRNEDSERELDRLIKEVKDRLDEKAR

SEQ ID NO: 16019 - protein, 59 aa, Artificial Sequence
  Synthetic
SDAEDVLRKLKELIDRDTKENDEVLRKHKRLTDEDRRKNEEVVRELRKIITRLDEKLRA

SEQ ID NO: 16020 - protein, 59 aa, Artificial Sequence
  Synthetic
KEVLDRIRDLLRRWRERNEESRRRAEKSIRDSDETNKRSREEIKRIIRKLREILKERKR

SEQ ID NO: 16021 - protein, 59 aa, Artificial Sequence
  Synthetic
SDVEKVLRELEELIDRDRRDVEKVIEELRKLIKEDEEENREVLKRAEKMLREIREKLRN

SEQ ID NO: 16022 - protein, 59 aa, Artificial Sequence
  Synthetic
EKFLRDIRETLKRWKERNEELTRRLREIIREVEERNEESKRRLDELIREAEEDMRRRRT

SEQ ID NO: 16023 - protein, 59 aa, Artificial Sequence
  Synthetic
SEAERVLEDLKRLIDEDRKKLREILEDHKRLTDEDRERNRRVLEELDKIIKELDERLRS

SEQ ID NO: 16024 - protein, 59 aa, Artificial Sequence
  Synthetic
KDVLDKIEKSLRDWERDNERMVKEADRSVKRSDETNEKSREDLERLIEEARRRLKERER

SEQ ID NO: 16025 - protein, 59 aa, Artificial Sequence
  Synthetic
SEVERVLEELEELARRDEEKNKRVEDRLRKLIEDDRRDLRRILERLREIAERLKEEAES

SEQ ID NO: 16026 - protein, 59 aa, Artificial Sequence
  Synthetic
EEFVRRIRDLLRRWKEEVDRSEDRIRRELEKWERENEEAEKRIRKIIEDLRREIKKKAD

SEQ ID NO: 16027 - protein, 59 aa, Artificial Sequence
  Synthetic
SKLERVLEELERLIREDEDENKKILDRLKKLIDEDKKENDEIMETLKEIARKLTEELRS

SEQ ID NO: 16028 - protein, 59 aa, Artificial Sequence
  Synthetic
EEVLRRIRELIKEVRRRNDESRERIERLLKEWRERVDASERTIREIIKEIKERVRRARK

SEQ ID NO: 16029 - protein, 59 aa, Artificial Sequence
  Synthetic
SKAEDVLRKLKELIDRDRDENRKVLDELRRLIERDREKNRRIMEKLKKIVRELEEALKV

SEQ ID NO: 16030 - protein, 59 aa, Artificial Sequence
  Synthetic
EDVLKRIEDELERWKEEVERSKREIEKLIKEARDENDKSRKTIEKIIREAEKILRDRDR

SEQ ID NO: 16031 - protein, 59 aa, Artificial Sequence
  Synthetic
SEAERVLEELKELIERDEEENRRILEEHKRLTEEDLRENREVMKRLEDIIRELEEKLRT

SEQ ID NO: 16032 - protein, 59 aa, Artificial Sequence
  Synthetic
EKVLTDIERLIREAEKRNRDSKREAEKSVKKSDELNERSRRRIEKIIEELRRLVDTRRT

SEQ ID NO: 16033 - protein, 60 aa, Artificial Sequence
  Synthetic
SDVEKFLDELRELIRRSKERVDRMLRKLEELIRRSSEDVERLLKELKELIDDIRRLLDEN

SEQ ID NO: 16034 - protein, 59 aa, Artificial Sequence
  Synthetic
DELRERIKRLLEEHHKRLREAVEELRKLVEDATEEHERLSERAKRLVEEVKKRVDERER

SEQ ID NO: 16035 - protein, 60 aa, Artificial Sequence
  Synthetic
DEVEKVLRDLEELIRRSETDIRRLLEELKKLIDDTRREVKKVLDDLRRRIKEVLDRIRRN

SEQ ID NO: 16036 - protein, 59 aa, Artificial Sequence
  Synthetic
DEARERLKDTVTKASRRHEKVERDLEKLLEEHHRAIEKLRKELRDLVRKAKEDIDRARK

SEQ ID NO: 16037 - protein, 60 aa, Artificial Sequence
  Synthetic
DEAEKVRREHRELVEDSLRKAEEALKRLDELIKRTEKRVKDVEEELKRLIKRVLDEVRKN

SEQ ID NO: 16038 - protein, 59 aa, Artificial Sequence
  Synthetic
DEVKRRLRTSDKKVSEKHKELLDRLRELLRRHHESLKRLEERIRKLVTDATRRIEEEEK

SEQ ID NO: 16039 - protein, 60 aa, Artificial Sequence
  Synthetic
DEVEELLKEHRELVKESKKTVEKMLRELEELIKRTRDEVEKVERTHEELVRRVDEVLKRR

SEQ ID NO: 16040 - protein, 59 aa, Artificial Sequence
  Synthetic
DELKERLKESDKEASDLHEKAREDLERLLKKHHDDLRKIMERLERSDKEAKKRLEEEKT

SEQ ID NO: 16041 - protein, 60 aa, Artificial Sequence
  Synthetic
DEVEKLLKELEDLRRKTREDLERVKKELEELVKRSKDRLREAEDELRRLVEDIERVIRED

SEQ ID NO: 16042 - protein, 59 aa, Artificial Sequence
  Synthetic
DELKKRIRELVKEHTDELRKVKRELEALVEKATEDHERVLRRLEELVERIKREVDKAEK

SEQ ID NO: 16043 - protein, 60 aa, Artificial Sequence
  Synthetic
SDAEDLLREHRELVERSKREVERVLDELRRLIEKSLREVEKVLKELEKLIREILDRVRKN

SEQ ID NO: 16044 - protein, 59 aa, Artificial Sequence
  Synthetic
DRVREELRRSDEKVSRDHEELVKEAERLVDEATKEHRKLKRRIRELVRRAKEEIEKLRK

SEQ ID NO: 16045 - protein, 60 aa, Artificial Sequence
  Synthetic
SKVEDILRRHRELVKKSLDEIRDLLRKLKRLIEESLRRVEEVLRDHERLVREIEDRVRKN

SEQ ID NO: 16046 - protein, 59 aa, Artificial Sequence
  Synthetic
DELKRRLRESDKRVSERHKRATEEIKKLLDRATEEHKKLVKRLRDSDKRVADELDKAEK

SEQ ID NO: 16047 - protein, 60 aa, Artificial Sequence
  Synthetic
DDVDRVRKEHEKLVRDSLDTARKLLEELEDLIRRDKEDVERVLEELKRLIEEIDDRVRRN

SEQ ID NO: 16048 - protein, 59 aa, Artificial Sequence
  Synthetic
DELIERLRRSDKRASEEHKRLMDEAKRLVEKAEKDVTELNKDIKRLVKEVEDRLREAER

SEQ ID NO: 16049 - protein, 60 aa, Artificial Sequence
  Synthetic
DEVKKVLDESRELVDRIRRKAKEVDDRDRKLIRDVLEELKKLLEENRKLVEDIRRLLEAG

SEQ ID NO: 16050 - protein, 56 aa, Artificial Sequence
  Synthetic
KETLRRLHEETERILRDLKRHNDELNDEARKRLKEVKERLDESHDRVRRELEAKER

SEQ ID NO: 16051 - protein, 57 aa, Artificial Sequence
  Synthetic
KDVEEILRKLKELIDEARRRLEKTLRDHEDIVRRAKRRLEELLKRHRDIMDEVRRKV

SEQ ID NO: 16052 - protein, 59 aa, Artificial Sequence
  Synthetic
EEARRRLEEEVRKVRKEIEDVNRRLEKSHKEAEETLRRVEEELKKSHDELERILREIER

SEQ ID NO: 16053 - protein, 57 aa, Artificial Sequence
  Synthetic
DDVEEILRTLRELIKKIKKDLKKVLDDHERIARRAKEELERILRRHREIVERVDRKV

SEQ ID NO: 16054 - protein, 59 aa, Artificial Sequence
  Synthetic
DEARKKIEDIVREVEDDLRRVAKAAEDSNRKLEKDLREVAERLRKSHEEAEKALRDREK

SEQ ID NO: 16055 - protein, 57 aa, Artificial Sequence
  Synthetic
DDVRRLEEELRRLMEEAERRLRKTLEDHKRIVEEAKRRLEEILREHKRILEEIDKRV

SEQ ID NO: 16056 - protein, 59 aa, Artificial Sequence
  Synthetic
EELKKRVEDLVREIRRRLDKVNEDLERSNRELEKVLRDVLRELKKSHDDLERSLRETRR

SEQ ID NO: 16057 - protein, 57 aa, Artificial Sequence
  Synthetic
DEAEKILDELRRLIDEIRRRLRKTLEEHKRILERIRRELEKMLEEHRRIVDEMRRKL

SEQ ID NO: 16058 - protein, 59 aa, Artificial Sequence
  Synthetic
EEVTRRLEKLVRDVDRDIKRVNKELEKSNRELEKDLRAVEKRLEDSNRDARKKLEDTRR

SEQ ID NO: 16059 - protein, 57 aa, Artificial Sequence
  Synthetic
DDAERILEELKRLMEEVEKRLKDTLDTHREIARRILERARESLKRHEDIAREIERDV

SEQ ID NO: 16060 - protein, 59 aa, Artificial Sequence
  Synthetic
EDVKRKIRELVERAKKRLKEINDELKKSDEDLDRKLEDLNRRLEESNEELKRRLDETRR

SEQ ID NO: 16061 - protein, 57 aa, Artificial Sequence
  Synthetic
SDAEKLLEDIRKLTEDVERDLRRSLEELKDLIRRLKKEIEDLLERHKRIVDKVVREV

SEQ ID NO: 16062 - protein, 59 aa, Artificial Sequence
  Synthetic
EEVKERVERLVREVEKRLDEVDKELEEEVDKARKELEKLLEDIDRSDKEARKRLEDKRR

SEQ ID NO: 16063 - protein, 60 aa, Artificial Sequence
  Synthetic
SKEDEIRRLIEDLERRNKEVEETLRELVRETRERIERIKRRLEELIKKSKDEVDDARRKG

SEQ ID NO: 16064 - protein, 55 aa, Artificial Sequence
  Synthetic
EELLERLERLIDKSRKNVEDIVKRHEDLSRELTERAKAILERHKELTDELREDVR

SEQ ID NO: 16065 - protein, 59 aa, Artificial Sequence
  Synthetic
SEEERIERLIDELRRDNDEVRKRLDKLVKDTERENEEAERRLRRLIEESRREVEKLKAE

SEQ ID NO: 16066 - protein, 55 aa, Artificial Sequence
  Synthetic
EELARELEKLIEDSRRNVKRIKEEHEELSRRNRKLLEDILERHRRLTEELRKKVK

SEQ ID NO: 16067 - protein, 60 aa, Artificial Sequence
  Synthetic
SKEREIEELIKELEEEVERLKEELRRIIKKLRDDNKRAEEELERLIRESKEDLDRARKEG

SEQ ID NO: 16068 - protein, 55 aa, Artificial Sequence
  Synthetic
EELRKELEDVRRKLKEEIDRILEEAKRVVDDSRRNAEEITRRHKEATKRLREEVE

SEQ ID NO: 16069 - protein, 60 aa, Artificial Sequence
  Synthetic
SIAERLKELIDRMREDNERAAKELRELIRKAKEESKEVEERLRRRLKELRDRVEELVRRN

SEQ ID NO: 16070 - protein, 59 aa, Artificial Sequence
  Synthetic
KEMLDRILEELKKLIKESRENLRRILEDLKRLLDESRRHAERITRRLEELIKELKEKAD

SEQ ID NO: 16071 - protein, 60 aa, Artificial Sequence
  Synthetic
KARERLKRLIEEAKRRNEEMEKELDRRLDELRRESKTLEEDLRRSLEELEERIRRLVKRN

SEQ ID NO: 16072 - protein, 59 aa, Artificial Sequence
  Synthetic
REMVEEILRELRKLVEDSLEVLERILDDLRRLIEESRKHLEEVKRRLEELKKRLEDEAR

SEQ ID NO: 16073 - protein, 60 aa, Artificial Sequence
  Synthetic
KEVEKILEEIERLIREIDREVKRVKTENEKTVRDIRKRVEEIKEEHKDLTRKLEKLARDG

SEQ ID NO: 16074 - protein, 59 aa, Artificial Sequence
  Synthetic
DEARKRAEDLLRDAKRRVDEVVEELKKTVEELKEEVRKVEEELKELVKRSEDKVRETER

SEQ ID NO: 16075 - protein, 61 aa, Artificial Sequence
  Synthetic
SEVDKVLKEHEDLVREDKKRLEEILRELKDRLRRDEEELRRIMEELEELLRRLKDVVDKRR

SEQ ID NO: 16076 - protein, 59 aa, Artificial Sequence
  Synthetic
KEMIDRLRRSDEELKKEADRANEEAKRIVEKIRDTLKKANDKLDEIVERIEDELRRAET

SEQ ID NO: 16077 - protein, 60 aa, Artificial Sequence
  Synthetic
KEAEDVEEEHKRLVEDDRRKLEEIKKTLERLVEEDRRRLEEVVRELKRLLDEITDVLTKR

SEQ ID NO: 16078 - protein, 59 aa, Artificial Sequence
  Synthetic
DEVRKRLRKSDKELRDEAREVNKELEAIVKRARDEVKKVNDDLRKIVDEVRETVKEARR

SEQ ID NO: 16079 - protein, 60 aa, Artificial Sequence
  Synthetic
DEVREVKKRLRDLIRDDERELRRVLEELKELVKDDVDKLRRLIEKLRKLLEELRRVATKR

SEQ ID NO: 16080 - protein, 59 aa, Artificial Sequence
  Synthetic
EKAREELKRIVEEVEEKSRRANKKLKDIVDEMRERVKRANEELDDIVKKITEDLERMRK

SEQ ID NO: 16081 - protein, 60 aa, Artificial Sequence
  Synthetic
REVDEVRKEHERLVKEDEDKLRKIIEDLKKLLREDEKRLREALKRHRELVEEARDVVRKR

SEQ ID NO: 16082 - protein, 59 aa, Artificial Sequence
  Synthetic
DKVKKELEESDRRVEEKSRRANETLKRIVEEIRKKAEEINRRLKESDDRAAEDIKRVEK

SEQ ID NO: 16083 - protein, 60 aa, Artificial Sequence
  Synthetic
DEARRVKEELDKLRREDEELLRRLMEKLKDLIRRDTEELKRIIDELRELVERLEDELRRR

SEQ ID NO: 16084 - protein, 59 aa, Artificial Sequence
  Synthetic
EKVREELRRIVDRVKKEVDRANRELEDIRREVEEISKRANEELERIVTEAADRLRKVAE

SEQ ID NO: 16085 - protein, 60 aa, Artificial Sequence
  Synthetic
SEAEKVIREHERLLEEDRRRLEEALRTLERLAERDEERLKEAEERHRDLLRKLEETVKKR

SEQ ID NO: 16086 - protein, 59 aa, Artificial Sequence
  Synthetic
DEVKRRLRKSDEDVKRRAEEINKEAKEIVDDVKKKSDEANKRLKDSDKRVAERLKEAED

SEQ ID NO: 16087 - protein, 61 aa, Artificial Sequence
  Synthetic
SEVEKVIEDHDRLLKRDEELLRKIAEDLKDLVRRDEERLRRATEKLKRLLETLEDVLRKRR

SEQ ID NO: 16088 - protein, 59 aa, Artificial Sequence
  Synthetic
KEVKDKLRRSDERVEKRSRDANRELEEIVRRARKKSEEANRRLEEIVERAEKRLKEAED

SEQ ID NO: 16089 - protein, 59 aa, Artificial Sequence
  Synthetic
SEVDKVVEESKTSMRRLERRHREATKESKKSIEEIEETVERVKRESEKSVKKLDDLVKN

SEQ ID NO: 16090 - protein, 59 aa, Artificial Sequence
  Synthetic
EEVRRRLRKIHKELEERLRRMNKRLRELHRELEEKVKEVKKELEDIHRKARERVEKAKE

SEQ ID NO: 16091 - protein, 59 aa, Artificial Sequence
  Synthetic
EELKEVRERSKESIKRIKEEHERVEEELKDIKRDIDRRHKEVVDESRESVKRVEDLSRA

SEQ ID NO: 16092 - protein, 59 aa, Artificial Sequence
  Synthetic
EEVRRELREIHDELRKRVEEANKRLEDILREIDKRLKELNEELKRIHDRARERLEEERR

SEQ ID NO: 16093 - protein, 59 aa, Artificial Sequence
  Synthetic
DEIREVIKESKKSVEDVKRRHEEAKRESERSLKEIRELAEEVKERLRDLLRRIRKLVKD

SEQ ID NO: 16094 - protein, 59 aa, Artificial Sequence
  Synthetic
EEVRRRLRKIHKEAEERLRRANDELRKLHEEIKKTVEKIKRELDKIVEEIERDVRRDRK

SEQ ID NO: 16095 - protein, 59 aa, Artificial Sequence
  Synthetic
SRVEEILRDSKRSMDEARKEHERVLRELRDRLRRLDERHRRLLEELKRLLREVRELTRA

SEQ ID NO: 16096 - protein, 59 aa, Artificial Sequence
  Synthetic
EEVLRRLDDIHRRIKRELKEVNDRLEEIVREIRKRLKEVNERLKEIVDAVEEVVRRAEK

SEQ ID NO: 16097 - protein, 59 aa, Artificial Sequence
  Synthetic
KRLEDVARESKKSIDEIRKRHKEATDESNKSIEEARRIHEEVLRTLKELLDRVRKLIES

SEQ ID NO: 16098 - protein, 59 aa, Artificial Sequence
  Synthetic
EEVRRDLRRIHERLREEAEEVNERLERNHEELEREARKVNEELRKIVEDARREVERAKD

SEQ ID NO: 16099 - protein, 59 aa, Artificial Sequence
  Synthetic
DDVEEIKRRLEELLERLKEDHKRMLEESRKSVEDAEKIVEEVKKESEDSIREIKKLLKD

SEQ ID NO: 16100 - protein, 59 aa, Artificial Sequence
  Synthetic
EKVKRELDEIVKRIEDEARKVNEELKRIHDDAERKVRKVKEDLERIHRELKKRVEDDRT

SEQ ID NO: 16101 - protein, 59 aa, Artificial Sequence
  Synthetic
KEDERVEEELRKLLKELEDRHKKASEDSRDSIRRIRERARTVLEELKRVLEDIDRLIKA

SEQ ID NO: 16102 - protein, 59 aa, Artificial Sequence
  Synthetic
EEVKRRLDKIVDDVRERLKEMNDRLRRLHEELKRELERIKEELDKILEEVKRRLEEARR

SEQ ID NO: 16103 - protein, 57 aa, Artificial Sequence
  Synthetic
ELEERLTRSNDELRKELKRMNEELRRKLEEIRKELERLNEKLREIIERIKEDLDRRA

SEQ ID NO: 16104 - protein, 59 aa, Artificial Sequence
  Synthetic
RELAEEFLRRHKELVERIREIHERLRERLEELLRRIEELHKRLEDELREVLKRIEDEIR

SEQ ID NO: 16105 - protein, 57 aa, Artificial Sequence
  Synthetic
KKEEDLDESNKRARDELKEMNDRLRKIVKEIEDELRRLNEEARRSNEELRRRVEERL

SEQ ID NO: 16106 - protein, 59 aa, Artificial Sequence
  Synthetic
DELAKKVIKEHEDLVREVLKRHEDLLRRARELLKKIKEIHDRLLDEHRKLVEDIEREAT

SEQ ID NO: 16107 - protein, 57 aa, Artificial Sequence
  Synthetic
DRERELEKSNRELERELREALKRVKEIIDRIRKTLEDMNRRLKRSNEEAERRLREKA

SEQ ID NO: 16108 - protein, 59 aa, Artificial Sequence
  Synthetic
DELAERVIREHRRLAEEIRRLIEKLKREIEELLERARRTHEDLLRKHKELVKKVDEEIR

SEQ ID NO: 16109 - protein, 57 aa, Artificial Sequence
  Synthetic
DDEEEVKRSNDELRKEIKEAEERLEKSNRELEEDLRRMNRELEESNKRLRELLEREA

SEQ ID NO: 16110 - protein, 59 aa, Artificial Sequence
  Synthetic
KELAEDMLRRHRDLVREIRELIDKLTRDHDRLVKEAREIHKRLTERHRKLVEDIKRETD

SEQ ID NO: 16111 - protein, 57 aa, Artificial Sequence
  Synthetic
SKEEELEKSNRKLKEDLERMNEDLKRILREVEDVLRRIEEELEKLVRELEEILKRRV

SEQ ID NO: 16112 - protein, 59 aa, Artificial Sequence
  Synthetic
DELAEEVIDRHRDLVRRIKDEHRKLTDELRKLLEDIERLAEEAKRKLEKLIEDVEREAN

SEQ ID NO: 16113 - protein, 57 aa, Artificial Sequence
  Synthetic
SSEERVKKVVEELEDLIRKIREEHKDSIRENRKVVEDIRERVKELITELKKELEDKL

SEQ ID NO: 16114 - protein, 56 aa, Artificial Sequence
  Synthetic
TEDLLRRLRKLIEDVFREARENLKRHKKMSKEAKEKLEELLKRLRDLIKEAREKIK

SEQ ID NO: 16115 - protein, 59 aa, Artificial Sequence
  Synthetic
SEADEVLRTHEELVRELEERAKEILRRHRKLSEESERKAREVLKTLRDLIRELKKLADE

SEQ ID NO: 16116 - protein, 59 aa, Artificial Sequence
  Synthetic
EEIARRIEESEDKSRRIIDEVRERVRKSIEENKRVVEEVRERVERLIKELDKIVEDIRR

SEQ ID NO: 16117 - protein, 60 aa, Artificial Sequence
  Synthetic
DELEKVIEELKRRIEEVKKELTELNKELKDVSKEIEDVIRDLNRELKKLSDRIKELADRD

SEQ ID NO: 16118 - protein, 59 aa, Artificial Sequence
  Synthetic
EEIRRRLDEVLRKAEEDLRRAEESNDEHLRKSKEDVERARKSNDKHLDDNRKTLEEATR

SEQ ID NO: 16119 - protein, 60 aa, Artificial Sequence
  Synthetic
SDVEDLLRRLRKLTKDIEERVKELNKKLEDVSRDIKRRVEEVLKKLEDVLRKARDEVRKL

SEQ ID NO: 16120 - protein, 59 aa, Artificial Sequence
  Synthetic
DRAEKELRKILEDHKEISDRVRRSNEKLLRDHRRTSETVKRRLEKVLEDIRKELEDAKR

SEQ ID NO: 16121 - protein, 61 aa, Artificial Sequence
  Synthetic
DVEERVKTIVDDIERTLDEVRRRLEESHKRLEDALKEVDDRLKKLLKETEEVLKRIEDERG

SEQ ID NO: 16122 - protein, 59 aa, Artificial Sequence
  Synthetic
KEKVEELLRRLREILERVTRRLEEVLKRHRDLVEEVKKELERVLEDHKRLSEDAERRAR

SEQ ID NO: 16123 - protein, 60 aa, Artificial Sequence
  Synthetic
SVEEALEKSVKESEEVLKKAEKELRESHEDAKRVLKEVRDELERLMEETKKELRDVERKR

SEQ ID NO: 16124 - protein, 59 aa, Artificial Sequence
  Synthetic
KEKVDRILKKDKDLIDRVRRELKKMLDRHRKLVEDVKRELEEALKEHKDDSKRVRDKLK

SEQ ID NO: 16125 - protein, 60 aa, Artificial Sequence
  Synthetic
DIEDRLERVVRDAKRVLADVEDKLRKLLEETERMLRRVKRELERSHEEAEEELRRVEEER

SEQ ID NO: 16126 - protein, 59 aa, Artificial Sequence
  Synthetic
KKLLEDILRKLRKIIEEVKRTLEEALKRHRDLTRKVVEELEDLLRKHRRIVEEVKKRLK

SEQ ID NO: 16127 - protein, 60 aa, Artificial Sequence
  Synthetic
DIEDELRKSVKRSEEVLREVEERLKRLLEETKEVLTRARETNEKSHRELEDKLRKIEEER

SEQ ID NO: 16128 - protein, 59 aa, Artificial Sequence
  Synthetic
ESKLRELLKRDKKEIDDVKRELERLLEDHKRLTEEIRRRLKRLNEKHREIVKRVEKELK

SEQ ID NO: 16129 - protein, 60 aa, Artificial Sequence
  Synthetic
DVEDRLRESEKRSEKTLKDVEERLRRSHEDLEKKLREVEKRLRDSHREAEKTLKRVKEEK

SEQ ID NO: 16130 - protein, 59 aa, Artificial Sequence
  Synthetic
KEVVRKILEDDKRLIEEVKKELERVLEEHRRLVEKVKRELEEVLKRHKEIVDDVRRRLE

SEQ ID NO: 16131 - protein, 60 aa, Artificial Sequence
  Synthetic
SIEDELRKIADEARKVLDKVRKDVERSHREAEKKLREIDKRLKDSARDSKRVLDEVREER

SEQ ID NO: 16132 - protein, 59 aa, Artificial Sequence
  Synthetic
EEKLERILRKLKKIIKDVEDELRKLLEEHRELVKKVEKDLRDLLERDRELIEEVERRLR

SEQ ID NO: 16133 - protein, 60 aa, Artificial Sequence
  Synthetic
DIEDRLRTSVKKSRDVLEEVERKLRDSHRRAKEVLDKAREDLRKSKEDSKRVLDDVRRKR

SEQ ID NO: 16134 - protein, 59 aa, Artificial Sequence
  Synthetic
KEKLEDVLRRDEELIDRVRRRLERILEEHEELVKRVEEELRRVLEEDRKLIKRVKEELE

SEQ ID NO: 16135 - protein, 60 aa, Artificial Sequence
  Synthetic
DIEDALRDSERESEEVLKRAREELEKSHKEVKKRLDEVEKTNKDSVDESKKVLDDVRRKR

SEQ ID NO: 16136 - protein, 59 aa, Artificial Sequence
  Synthetic
KELLKKILKEDKELIKRVEEILRRILEEHRELVRRMKKELDELNKRDKELIDRVREELT

SEQ ID NO: 16137 - protein, 60 aa, Artificial Sequence
  Synthetic
DLEEEAKKSVRESERALDEVRKRLDRVRKEVERELRKVEEDLRRSHRKLEDILRRVAEKR

SEQ ID NO: 16138 - protein, 59 aa, Artificial Sequence
  Synthetic
EEAARRILERDKALIEKAREDLKRILDEAREILKEAAKRLEDILRKHKKIVEDVARELE

SEQ ID NO: 16139 - protein, 60 aa, Artificial Sequence
  Synthetic
KIEEEVEKLIRDARRIIEEMRESTERLIERNEEVLETVRREVEKLLRDLERILEKIKREL

SEQ ID NO: 16140 - protein, 59 aa, Artificial Sequence
  Synthetic
EEVLRRILEEIRKIVEDVRRELDTLNRELEELTKESRRRAEELLRRLKEIVKKVERDAE

SEQ ID NO: 16141 - protein, 59 aa, Artificial Sequence
  Synthetic
REVEEILKEVETLIRENKKKLEEWLRTHEKLNEDLERKAREILTRHRRENEDLKRVADD

SEQ ID NO: 16142 - protein, 59 aa, Artificial Sequence
  Synthetic
DEVKRRIEELIKKSKRVNDEANRRVDKLVKDTRDKIREIEERIRKLIEESKKLLEDKRR

SEQ ID NO: 16143 - protein, 59 aa, Artificial Sequence
  Synthetic
REVEEILRRVRELIERNRKEVEDWMRRHRRVNEELKRKAREILERIKEMLKTLKEVLER

SEQ ID NO: 16144 - protein, 59 aa, Artificial Sequence
  Synthetic
DEAAKRIEKLIKESRERNEEVNRKIKKLIEDTRRVVEDVRRKVEELVKRLRTELDRARK

SEQ ID NO: 16145 - protein, 59 aa, Artificial Sequence
  Synthetic
SEAEEIAKRAKEAIERNRKLAEEWAKRARDAAERLKELYKRIAERHRKANEELRRAAER

SEQ ID NO: 16146 - protein, 59 aa, Artificial Sequence
  Synthetic
DEARKRIRELIERSKKANKEANDRARKLAEDAKRLNEEANERAKRLAEESREAIKEAER

SEQ ID NO: 16147 - protein, 61 aa, Artificial Sequence
  Synthetic
REVEEVAKELRELIKRTEDLIRRALERNRKLVKETRDLIEKVLRDLRDLLRRLEEEARRRG

SEQ ID NO: 16148 - protein, 56 aa, Artificial Sequence
  Synthetic
DKTLRDLLREHKELVEEAKRRLEESNDEHRREVEDAERRIEEIVRDAKRVVDEIER

SEQ ID NO: 16149 - protein, 61 aa, Artificial Sequence
  Synthetic
SEVEKVVTELRRLIERLEEVIRRALDTNRKLLEDTEKEAERMMRKLEELIKDLERDLREKG

SEQ ID NO: 16150 - protein, 56 aa, Artificial Sequence
  Synthetic
KETLRKLLKELREVLDKAREDLERSNRDHRRAVEEIKERLERLLKKLEDVVRKAKE

SEQ ID NO: 16151 - protein, 61 aa, Artificial Sequence
  Synthetic
KEAEEAAKKLKDLIKEDRERARRALEENKRLIDELRKAAKEALDRNRELLERLRDEARKRG

SEQ ID NO: 16152 - protein, 56 aa, Artificial Sequence
  Synthetic
KDTAEDLLRRATRDSEEAKKKLKKSNEEAAKAVEEAKERLKRSVDEATKAVEEAKR

SEQ ID NO: 16153 - protein, 59 aa, Artificial Sequence
  Synthetic
SEVEKALEESKESLKTIKKIAKDVLTESEESLRRTKKLIEEVLEASKRSIEELKRLSEA

SEQ ID NO: 16154 - protein, 56 aa, Artificial Sequence
  Synthetic
EDELRRLHEDVKRLVEEIAKRLDELHDRHRETVKRAKEELDKLHDRARKEVEDDKR

SEQ ID NO: 16155 - protein, 59 aa, Artificial Sequence
  Synthetic
SEVEKVLKDSEKSIEDAERIARDVLRKSEESIDRIRRIAEEVLKESEKSIRDAKKLAED

SEQ ID NO: 16156 - protein, 56 aa, Artificial Sequence
  Synthetic
ERELDRLHEKLRRVVEEIEKELRESNRKLEEVLRDIKRKLDDLHRKAREILERIRK

SEQ ID NO: 16157 - protein, 60 aa, Artificial Sequence
  Synthetic
SEVEEVLKRIRDVIKTMEDRAREVLKESEKSIKEIRDTIREVLKRSEDSIRRIDEELKKG

SEQ ID NO: 16158 - protein, 56 aa, Artificial Sequence
  Synthetic
KDRLDELLKRAEEVLRKIKEDLRRSNEKLREEVKEAKKRLDDLHRELEDVLREAKR

SEQ ID NO: 16159 - protein, 60 aa, Artificial Sequence
  Synthetic
KETEEAEKLAREAARRSEKLAEEAEKRAKEAIDESKELADRARDTARRADEDLERLAREG

SEQ ID NO: 16160 - protein, 56 aa, Artificial Sequence
  Synthetic
REKLDDLLRRHNEKVKRAKERLDRLLEEHEKRIRDAERDLERLERELKKKAEDKRR

SEQ ID NO: 16161 - protein, 60 aa, Artificial Sequence
  Synthetic
SETEEALERLRKMIEDSRRLAKKIREDLREMIERSRRLAEKVRRDDEKSSEDLRRVTEEG

SEQ ID NO: 16162 - protein, 56 aa, Artificial Sequence
  Synthetic
KDRLDRLLEEHNRIVKEIKEDLDRLLREHNEIVKRIKDDLDRLHEENRRLLEESER

SEQ ID NO: 16163 - protein, 59 aa, Artificial Sequence
  Synthetic
SKEDLVRELKKKLEEVVKRSREESERSLRKLEKVIRDFRRESERLKKESRDVVKKARED

SEQ ID NO: 16164 - protein, 55 aa, Artificial Sequence
  Synthetic
EEVLKEIDDLIRRDEERLRRVLRESEELIKEIKKRAEEMLTRSKKLTRDIEEKTR

SEQ ID NO: 16165 - protein, 59 aa, Artificial Sequence
  Synthetic
RDREELRRLEEELRRVFEESRRRSERSKKELDKIVKEAEKASKRSLDKLKRVFDELRRR

SEQ ID NO: 16166 - protein, 55 aa, Artificial Sequence
  Synthetic
EDVLRDARELIERDREELERVLRDSDRLVREIKKRIEEMLKRSEDLIEEIERRAR

SEQ ID NO: 16167 - protein, 61 aa, Artificial Sequence
  Synthetic
SEVERVLKEIEDLIEEIERRAKTVLEEIDKLTKEIEEVVKRMLDRDRELIKTAEDLLRKNK

SEQ ID NO: 16168 - protein, 58 aa, Artificial Sequence
  Synthetic
RVRKALEDLLRKVEEVVRRVREELKKLERKDREVVRKVEEDSERSLRELEKVADEARK

SEQ ID NO: 16169 - protein, 60 aa, Artificial Sequence
  Synthetic
SEVEKVLRELKELTRRIREEAERLLREDERLLREAERIARELLETNKRLIEEIERRLRER

SEQ ID NO: 16170 - protein, 58 aa, Artificial Sequence
  Synthetic
RVKKDLEEVRKRDREVVEEVRRRSEKSKEDVRRLVEKIRKDSEDSLKELKEVVEEARR

SEQ ID NO: 16171 - protein, 60 aa, Artificial Sequence
  Synthetic
DEVEKMLEELKRLTDKIREDAERLLKRSEELTEEIKRLIDELLKEIEELIKEARDIVRRN

SEQ ID NO: 16172 - protein, 59 aa, Artificial Sequence
  Synthetic
ERVRRELEKVEREDRKVVRDAEEELKKSRKKSEDVVKEAKERLEELLRRVKRVVDEVRR

SEQ ID NO: 16173 - protein, 60 aa, Artificial Sequence
  Synthetic
SEVERVLKEIEELTRRLREEAEELLERSERLTEKIRRRAEELLKRNEDLIEKIERDLRRN

SEQ ID NO: 16174 - protein, 59 aa, Artificial Sequence
  Synthetic
DRVKKALDELRRRDREVVKRLEEELEKSKKKSEDVVREVEEKSERSKRKLERVADEARR

SEQ ID NO: 16175 - protein, 57 aa, Artificial Sequence
  Synthetic
SEAEKLLKEDEDLIRKARDEIRKVLEDDERLIEEVERKSREMLKRIKEIIDDMRKRI

SEQ ID NO: 16176 - protein, 59 aa, Artificial Sequence
  Synthetic
KEVVEEVRKSRKKSEDVLREVERELKKSFEKSKRVNDDSKKKLDELKREADEVIKRLKD

SEQ ID NO: 16177 - protein, 57 aa, Artificial Sequence
  Synthetic
SRAEELLKRDEELIDTVRRRIEKMLREIKEIIDRVKRKSEKMLEDDERLIREVEKRV

SEQ ID NO: 16178 - protein, 59 aa, Artificial Sequence
  Synthetic
EEVLRELEKSRKKSEEVLERVKRELEKLERRAEEVNKESEDRLRESEKESKKVIDELRR

SEQ ID NO: 16179 - protein, 57 aa, Artificial Sequence
  Synthetic
RRAEELLRTIKEIIKRIDDELKRVLDDDDRLIDELRKESERLLEEIERIIRRIEREV

SEQ ID NO: 16180 - protein, 59 aa, Artificial Sequence
  Synthetic
EEVLRELRKLEEEAKAVIDKARRELERSERKSEELNRESKRRLEELSRRAKRVIDELRK

SEQ ID NO: 16181 - protein, 57 aa, Artificial Sequence
  Synthetic
DEVRRLLKEIEDIIRRIEEDIRRMLEKDRKLIEEVERKSKEMLDRDKRLIEELEKRL

SEQ ID NO: 16182 - protein, 59 aa, Artificial Sequence
  Synthetic
EEAVRELDRLRREAEEVLDRVRKKLDKSRKDSERVNEESERRLERSAEESKRVLDELRR

SEQ ID NO: 16183 - protein, 60 aa, Artificial Sequence
  Synthetic
DVREELKKVVDKAEKVSRKSRDDLDKVRKRVEEVNRDNERRLREIAKKVKEVLRDIDRKR

SEQ ID NO: 16184 - protein, 59 aa, Artificial Sequence
  Synthetic
KEVVKRLLEDVDRLIREVEKESKRLLDEIEEMIEELKRRAEENLKTIEDIIKDVTEKAT

SEQ ID NO: 16185 - protein, 59 aa, Artificial Sequence
  Synthetic
REVEEVLKTVRKLIEELERSSRKSLKEVKELLEKLEEDARRSLKRVKELLKELEDRSRT

SEQ ID NO: 16186 - protein, 59 aa, Artificial Sequence
  Synthetic
EEAKKRIEDLIRELEELLRESSDRHRKLDEELKKLLKDVTDAHRRLMEELRKLLEDIET

SEQ ID NO: 16187 - protein, 59 aa, Artificial Sequence
  Synthetic
DEVETILRDIKRLLREIEELARKSSKKFKELLERLEETARRSLTRIERLLEEVEDISRT

SEQ ID NO: 16188 - protein, 59 aa, Artificial Sequence
  Synthetic
EDAAREIEKLKRELERLLEEASRTHEELTRRLEKLLEDATREHERLKRELEKLLEDIKK

SEQ ID NO: 16189 - protein, 59 aa, Artificial Sequence
  Synthetic
REVEEILRKIRELLEELRKRVEESRRRIEELLKKLEEEVRESEKDVRRLLRELEEISRT

SEQ ID NO: 16190 - protein, 59 aa, Artificial Sequence
  Synthetic
EEAAKEIEKLVKELEELLKRASDKHRKLSKDLEDLLREVTERHRRLEKELEDLLREIER

SEQ ID NO: 16191 - protein, 59 aa, Artificial Sequence
  Synthetic
SEVEKLLEEARRLLKELEDSSRRSVEEAKRLLEELKRRVEESVRRIRELLKDLERLSSR

SEQ ID NO: 16192 - protein, 59 aa, Artificial Sequence
  Synthetic
ERAKEALRELEKRLRDLLRDSSRLHEDLARDLKRLLDEVTEEHDKLRRELRKLLEDIKT

SEQ ID NO: 16193 - protein, 59 aa, Artificial Sequence
  Synthetic
SEVEKVEEDVKRLLKEIEDSSRRSLEKAKRLLEELRRSSEESLKRIRDLLEELRELSRT

SEQ ID NO: 16194 - protein, 59 aa, Artificial Sequence
  Synthetic
EEAKKRIEELKRELEELLKKSSEEHKKLVKELKELLKKSTEDHEKLKRDLRKLLEEIRT

SEQ ID NO: 16195 - protein, 60 aa, Artificial Sequence
  Synthetic
DSEDLMRRVKEELDKLVKDSRKRSEDLKRENEELLRRSEEALEKSVRDADRLFEEIKRTK

SEQ ID NO: 16196 - protein, 55 aa, Artificial Sequence
  Synthetic
RDVLKTLKDLIRELKRHSEEVEREDKETTDRLRRHSEKALRTNEEIIRRIEERAR

SEQ ID NO: 16197 - protein, 60 aa, Artificial Sequence
  Synthetic
SVDEALRDIERKVEELMRESDERLRRVKKEVEDNVRRSEEELKRIADEMKELLDRARERG

SEQ ID NO: 16198 - protein, 59 aa, Artificial Sequence
  Synthetic
EDLVREVLKKLKELIDRWRDLSRRLKERLDTLIKEHHELSKRLLERLKRLIDEARKKLN

SEQ ID NO: 16199 - protein, 59 aa, Artificial Sequence
  Synthetic
SEVEELKREADDVNRRAEELARETLKKIEKVNREVKRRLEEALREIEELLRRAEEIVRR

SEQ ID NO: 16200 - protein, 59 aa, Artificial Sequence
  Synthetic
EEARKRLEEVVRHNKKLDDEHRKALDELRKHNEDLDRRSKEELDKLRKRLEDLLRKVKE

SEQ ID NO: 16201 - protein, 59 aa, Artificial Sequence
  Synthetic
REVEELLKEIEEVLKKSERLSRESLKKIREVLERIERLARENVKRMKEVIDRVRELAER

SEQ ID NO: 16202 - protein, 59 aa, Artificial Sequence
  Synthetic
EDARRALEELRKRVEEVNKKSRDDLERLTREAEELNRKNEEDLRRLEKEVKDLLDEIRR

SEQ ID NO: 16203 - protein, 60 aa, Artificial Sequence
  Synthetic
SSRETVKRLTEEARKLLEDWKDRNRDVERKVEEIIERIRRTNEKSERDARRKLEEVDKRR

SEQ ID NO: 16204 - protein, 56 aa, Artificial Sequence
  Synthetic
TEELKREIERILEELRRLMKEDKEELERILERLRRLAEEDKKENEEILDRVDKKAK

SEQ ID NO: 16205 - protein, 60 aa, Artificial Sequence
  Synthetic
STEETITDLKREAEEILRRWREENKRVSDEAAESVKESDKTNKKSKDDLKRVLDEVDTKE

SEQ ID NO: 16206 - protein, 56 aa, Artificial Sequence
  Synthetic
AKELEDEVREALKRIRKLIEEDRRKLKRILDEHRRLTEEDRERNERVLRELREDTR

SEQ ID NO: 16207 - protein, 60 aa, Artificial Sequence
  Synthetic
SVDESLEEIRKEVERLLRKWKEDNKEMRKRIRELLEDWRKKVEDSKKRAKDLIDEVKKRR

SEQ ID NO: 16208 - protein, 56 aa, Artificial Sequence
  Synthetic
TRELEKEAEDALRRLKKLIEEDRRELEKILKELEDLMREDTKENEKILREAEERSR

SEQ ID NO: 16209 - protein, 60 aa, Artificial Sequence
  Synthetic
SVEDEIRRLTEEIERTLRRWREEVKRSEDRAEESIKRSDEKNKESKERLDKVLDEARRRR

SEQ ID NO: 16210 - protein, 56 aa, Artificial Sequence
  Synthetic
LRELLKEVEDVLEELKELIKRDTEENKRILDEHKRLTEEDEKRNREVLERLKRKTD

SEQ ID NO: 16211 - protein, 60 aa, Artificial Sequence
  Synthetic
ESEETLKEVKKEIEKLIKRAEEINRESAERLKRILEEWKKEVDRSEKRLREVLDEVRRRR

SEQ ID NO: 16212 - protein, 56 aa, Artificial Sequence
  Synthetic
RRELLEELKRVLDRLKKLIDDDRRKNEKVLRDLEKLMREDADENREVLKRLEDKAR

SEQ ID NO: 16213 - protein, 60 aa, Artificial Sequence
  Synthetic
SDEERVIKEVEDLIRRIREDNKRLLDEAEKIIRRVAEDNKKLVEDHRRMLRKIDEEAKRG

SEQ ID NO: 16214 - protein, 55 aa, Artificial Sequence
  Synthetic
EDVKRLEEKVRKLLEESKRKLKRLAEEVRKLIKDSRDKIRELERENKEIIKKVKD

SEQ ID NO: 16215 - protein, 60 aa, Artificial Sequence
  Synthetic
DREKEVVDTLRRLIEDARRDNKDLVETHRRLLEDLERDNRELVRTHEERLEEIERRARRG

SEQ ID NO: 16216 - protein, 55 aa, Artificial Sequence
  Synthetic
EDVRRLEKEVEELLRESDRRVEDLERKNREILKRSEDLIRRLKEENRRIIEKVRK

SEQ ID NO: 16217 - protein, 59 aa, Artificial Sequence
  Synthetic
DDERRVVEELERMIRELEKKIREIVKRHEEALKRLKEDNDELSKRHKKMVEEIKRRADE

SEQ ID NO: 16218 - protein, 55 aa, Artificial Sequence
  Synthetic
EEVRRLKREVEELLKRAEELLKRLEDRNRKILRESEEDIKRLERENREIITRVRT

SEQ ID NO: 16219 - protein, 61 aa, Artificial Sequence
  Synthetic
KELDEIIRRVEELIKDDERRNREVLKRSDESTKESHDKARRILEESEKTTEDIKRKVEKDG

SEQ ID NO: 16220 - protein, 56 aa, Artificial Sequence
  Synthetic
EDKIRRLERESRELLRDSEDKVRKSKRKDEENLKRIEEEARRSEKRDEELLREAAK

SEQ ID NO: 16221 - protein, 61 aa, Artificial Sequence
  Synthetic
RELDEIIKTLEKLIEDSHREAREIVKEVKKRLDDDKRRNEEVLKESRETTERIRKEIEERG

SEQ ID NO: 16222 - protein, 56 aa, Artificial Sequence
  Synthetic
EEKIRRLEERARRNVEEMRKLAEELEKESRRILKESAEAVKRSKDEDRKLLEEAKK

SEQ ID NO: 16223 - protein, 59 aa, Artificial Sequence
  Synthetic
SETDKVIEESEKTNRDIKRHSEEVVKDSKRTNTEIERTVEKMIRELEEILERIKRLADN

SEQ ID NO: 16224 - protein, 56 aa, Artificial Sequence
  Synthetic
KDKAKKLKDETDRILETSERLLKALRDETDAIKRKVEELVRRVKEELDRILKKTED

SEQ ID NO: 16225 - protein, 59 aa, Artificial Sequence
  Synthetic
SETDRVVEESERTNKEIERHSEEMVRDSERTNKEIEEHSREVIERLREILERIERLVRK

SEQ ID NO: 16226 - protein, 56 aa, Artificial Sequence
  Synthetic
EEKMRRLKEETDRILDKSRRELKRLKDETDKLLEDSERLLREVEKTLRRILEEARK

SEQ ID NO: 16227 - protein, 59 aa, Artificial Sequence
  Synthetic
SETEEVVKTLKRLLEEIKKHSDDAVRKSEETNKRIREEVERVIKRLKELIEEISELVKS

SEQ ID NO: 16228 - protein, 56 aa, Artificial Sequence
  Synthetic
EEKLKRLKDALDRILEESKRLADELKKRTKDILDEAKDALRKIKEELDKLVEDAER

SEQ ID NO: 16229 - protein, 59 aa, Artificial Sequence
  Synthetic
SETDKVVREVEELIRRLEEHSRRVVEKSERTNEEIERHSRDVIRRSKEINDRIEELARN

SEQ ID NO: 16230 - protein, 56 aa, Artificial Sequence
  Synthetic
KDKMKRLKEELDKLLDDSRRLMKRLKDETDKILDKSRDLLAKTKRESDRILEEAER

SEQ ID NO: 16231 - protein, 59 aa, Artificial Sequence
  Synthetic
SETDKVVDDSRKTNEDIKRHSEEVIRRLEELIREVEEHSRRVEDEVRRILDEIRKLAED

SEQ ID NO: 16232 - protein, 56 aa, Artificial Sequence
  Synthetic
KDKATELKKDTDRILKESEDALRRIKKELDDLLRTSKRLAEELKKELREILERAKR

SEQ ID NO: 16233 - protein, 59 aa, Artificial Sequence
  Synthetic
SETDEVVERLEKILKDIREHSERAIKKLEDILREIERHSRKVIRDSERINTEIKKLAEA

SEQ ID NO: 16234 - protein, 56 aa, Artificial Sequence
  Synthetic
KDKLTTLKKKLDDLLDTSRRLVEKVEEDLRRILEASKRMLEETKKRSKEILDRIRK

SEQ ID NO: 16235 - protein, 59 aa, Artificial Sequence
  Synthetic
SESEEVVREVDKILKEIRKHSKDVIEKLKKLIDDIRRRVRKVIRDSEEINKRIEDLARE

SEQ ID NO: 16236 - protein, 56 aa, Artificial Sequence
  Synthetic
EEDMRRLKERLDKILDDSREMLKRLKDELDEVLEEVERLLRETKKRSDEILKRIKD

SEQ ID NO: 16237 - protein, 60 aa, Artificial Sequence
  Synthetic
SEIEDVIRRAEELIKEDKKRVEDVVREIEKLIRDDARKVRRAIEELKRLLREIEERVREE

SEQ ID NO: 16238 - protein, 56 aa, Artificial Sequence
  Synthetic
KEEAERLRRELEDLHRDVKRLIDELEKDLRRLLEESKRRADRVKEELRRLREEVRK

SEQ ID NO: 16239 - protein, 60 aa, Artificial Sequence
  Synthetic
SEADKAAEDAKRLIDKDREDVERAVKRAEDLIEKDREDVDRAIKESEELNKRAEDEARRR

SEQ ID NO: 16240 - protein, 56 aa, Artificial Sequence
  Synthetic
EEKARRLKEEADKVAKESKELADRLKERADRLHKRARELAERTKEDTDRLVEEAKR

SEQ ID NO: 16241 - protein, 60 aa, Artificial Sequence
  Synthetic
SEIDEVVKEIEKILEDDKRRVDEAIEELEKLIREIREEVRRVIKESEDLNKEIRDRVRKN

SEQ ID NO: 16242 - protein, 56 aa, Artificial Sequence
  Synthetic
KDKAERLRRELKKIMEDSRRLADEIKKRLDRLLEEVKEEIERTKRETDRLLEEVRR

SEQ ID NO: 16243 - protein, 60 aa, Artificial Sequence
  Synthetic
SELDRVVEEIDRLIREDEKEVRDMIRESEKLNRENEETNRKLLEDWDKLSKDIRDRVDKN

SEQ ID NO: 16244 - protein, 56 aa, Artificial Sequence
  Synthetic
DKKARELKEKLDELKKRSEKLLEDTKRETDKLHERSRRELEKLRRKDEELVKRVKD

SEQ ID NO: 16245 - protein, 60 aa, Artificial Sequence
  Synthetic
SEIEEVVERIERLIKRIKEEVERALKESEDLIRDIERRVRELLEEWDRLSERIREVVERN

SEQ ID NO: 16246 - protein, 56 aa, Artificial Sequence
  Synthetic
KDELRRLKEELRKLLEDVKKLLEESKKKTDDLLKRAEDELRKLKEKDDDLLRKVKD

SEQ ID NO: 16247 - protein, 61 aa, Artificial Sequence
  Synthetic
EELDRVVEELDRLIRDNKRRNDEALKESDRLIRENERRNRKAARDWEELSKEIEDRVRKNK

SEQ ID NO: 16248 - protein, 56 aa, Artificial Sequence
  Synthetic
KDKLTTLRKKLDDLHKESRRELERSKKKTDDLHRKSREEVRKLREDDERKLREIKK

SEQ ID NO: 16249 - protein, 60 aa, Artificial Sequence
  Synthetic
SEADEAAKKIEKLIEDNERKNRKALKEWDELTRENEKRNRDAIKESEDLIKEAADEVRRR

SEQ ID NO: 16250 - protein, 56 aa, Artificial Sequence
  Synthetic
EEKARRLREEAEELHRRSEEAARRAEKKDREAHKRSREAIKRTKDDTEELLKEAER

SEQ ID NO: 16251 - protein, 61 aa, Artificial Sequence
  Synthetic
DEIDKVVRKIEKLIDDNRRENEEMLRESEKLLKENEKKNEKAIRESEELIRRIEKRVRENK

SEQ ID NO: 16252 - protein, 56 aa, Artificial Sequence
  Synthetic
KDKARRLEEELKELHKRSKEELEKSKEKTDRLHDKSRRLIEETERRTEELLERVRR

SEQ ID NO: 16253 - protein, 60 aa, Artificial Sequence
  Synthetic
SVEDEVERLERDAEEISRRSETELRRLKKEVEDLNRESKKLLDELREEMEKILKKVREDS

SEQ ID NO: 16254 - protein, 59 aa, Artificial Sequence
  Synthetic
KDEVKRLVEEIERLLKRAEELSRELVRRIEKLIRELAEESRRLVDEIREVLKRLKDRAD

SEQ ID NO: 16255 - protein, 60 aa, Artificial Sequence
  Synthetic
SEIETVLEKLKRLLEEDRELVKRVEDKIRRIIEEDEKTVRDIKKRLDDILREIRDVLEKR

SEQ ID NO: 16256 - protein, 56 aa, Artificial Sequence
  Synthetic
EEELKKVEDELDRVRKETERIIKELREELEELHKRARDLLKEVRDELRKLLEEAKK

SEQ ID NO: 16257 - protein, 60 aa, Artificial Sequence
  Synthetic
SEIEDVVRRIDELLREDKRRVDEVLERNRKLIEDDERLSREIARELDEIIKRLREVVKSN

SEQ ID NO: 16258 - protein, 56 aa, Artificial Sequence
  Synthetic
REEVRKLKERLDKILEDTRRLLEESKRRLDRLHERHRETSEDMKRRIDKLLEEVRK

SEQ ID NO: 16259 - protein, 60 aa, Artificial Sequence
  Synthetic
KEAEDVVREVEELIDRDRKLVERVLRENERLLKEDRDTVKKVLEELEEILKDIERVVRER

SEQ ID NO: 16260 - protein, 56 aa, Artificial Sequence
  Synthetic
EELLRRLKEEIERLLERSRRLVKESEERLDRIREETKRELDRVEEKLRRLLEEVKR

SEQ ID NO: 16261 - protein, 60 aa, Artificial Sequence
  Synthetic
SEIEKVVEEIKKLLKELKETSERILRRNEKIIKEIEETSREVLKELERILEEIEDVVRKR

SEQ ID NO: 16262 - protein, 56 aa, Artificial Sequence
  Synthetic
KDRLKRLRDELERILRDHERLSRESKDKLDKLLERHKELSDEVRKKLKELRDRADT

SEQ ID NO: 16263 - protein, 61 aa, Artificial Sequence
  Synthetic
REIEEVEKEIERIIERIERTSRRVKEENDRLLEEIKRRSEEVKKRNDDIIREIRRVVEEDK

SEQ ID NO: 16264 - protein, 56 aa, Artificial Sequence
  Synthetic
ERRLKELKRKLDKLREDHERLSRRSDEELRRLEEEHKRLSEDSKRELDKLLDEVRK

SEQ ID NO: 16265 - protein, 60 aa, Artificial Sequence
  Synthetic
DEIERVLEEAKKLIRDLEEHSRRVEEENKRLLKEIRETSERVKRELDRILEEIRKTVERR

SEQ ID NO: 16266 - protein, 56 aa, Artificial Sequence
  Synthetic
DEKLRRLEEELKRLLDESKRLLEESEDELRKLEEEHRKLSEEVKRRLDELKKEVET

SEQ ID NO: 16267 - protein, 60 aa, Artificial Sequence
  Synthetic
REIEEIVERVKEIIDRIRRHSKEVEKENEKIIERIRRRSEEVLRTNEKALRDIERRVRER

SEQ ID NO: 16268 - protein, 56 aa, Artificial Sequence
  Synthetic
KDELKRLKEELERLLRESKKLVDESKRRLEELLREHRELSKRSRDKLDELLRRVEK

SEQ ID NO: 16269 - protein, 60 aa, Artificial Sequence
  Synthetic
SEIEEVVRRIREIIEEIRRLSEAALERNKRIIDEIRRTSKRVKEEIERIIRDIRRVVEER

SEQ ID NO: 16270 - protein, 56 aa, Artificial Sequence
  Synthetic
REDVRKLKEDLKELLKEHKRLSEESKKRLERLLEEHERISEELKRRLEKLLKEAED

SEQ ID NO: 16271 - protein, 60 aa, Artificial Sequence
  Synthetic
SEIEEVVKKVKKIIDEIRERSREALERNEKILEELKRHSEEVTRRAEKIIEEIKRVLEKR

SEQ ID NO: 16272 - protein, 56 aa, Artificial Sequence
  Synthetic
KDELTKLEKELEDLREEHRKLSKDSKDRLKKLLDESRELIERLKEKLKRLLEEAER

SEQ ID NO: 16273 - protein, 59 aa, Artificial Sequence
  Synthetic
SEVEEMLKRLDDILKKHRELVKEMKEELDRVIETHRRLVEEVRRRLEKSNDEIDKLVKA

SEQ ID NO: 16274 - protein, 59 aa, Artificial Sequence
  Synthetic
ERVEKALKEVRERLERSHKKAKEDLDRVREEARKSHEDVKRLSEEDRKKSEDLADEVRR

SEQ ID NO: 16275 - protein, 59 aa, Artificial Sequence
  Synthetic
REVEEALERLRKLIEDDRELVKRAKEKLDKLLKDDRKLVEDVLRELKRSNDEVKKLVDS

SEQ ID NO: 16276 - protein, 59 aa, Artificial Sequence
  Synthetic
KRAEEELRRVKEEVDRVLEESKRRLDEVRRRLERIEEESRTKSEEDRKRSEDLVREAER

SEQ ID NO: 16277 - protein, 59 aa, Artificial Sequence
  Synthetic
SEVERLVEDAERVIDEHRKLVTEMERRLERVNREDEKLVRKVLEELKKSNEEIKKLRED

SEQ ID NO: 16278 - protein, 59 aa, Artificial Sequence
  Synthetic
ERAKKLLDEIRKKLDDSNREVEKRSRDDERHTERVVRESKRLSEEDKKRSDELADETRK

SEQ ID NO: 16279 - protein, 59 aa, Artificial Sequence
  Synthetic
SRVEEVKKELDDLIRRHKELVEKVRKELKDLLDKHERLVEEAKKEIEKLIETLKRLAEN

SEQ ID NO: 16280 - protein, 59 aa, Artificial Sequence
  Synthetic
RRAEDELRKVRKEVERSNKEVEEILDDVRRKVEESDKRVKEILKKLREDVKKLLDEVRK

SEQ ID NO: 16281 - protein, 59 aa, Artificial Sequence
  Synthetic
SEVEKLVADADKLIKDHRKLVEEAKKRLDEVNERHRRLVEEVERRLDKSNKELEDLVRS

SEQ ID NO: 16282 - protein, 59 aa, Artificial Sequence
  Synthetic
RRADEELRRISERVKRSNEDVRKKSEDDKRHTDESDRDVKRLSKEDRERSETLMDRVRE

SEQ ID NO: 16283 - protein, 59 aa, Artificial Sequence
  Synthetic
SRVEDVERELEEEIDKHRKEVEDAKRRLDELIRRHKEEVKKLKKKLDDLIEELERLARN

SEQ ID NO: 16284 - protein, 59 aa, Artificial Sequence
  Synthetic
ERAKRSLDRVREKIEKSDRTAKDLLKKVEEEVRKSNERVKELLKRVKDAVDDLLRRRRK

SEQ ID NO: 16285 - protein, 59 aa, Artificial Sequence
  Synthetic
DEVEEVVKRAEDVIRTHKELVKKAKEDLDKIIEDIERELKKMLEDLERSNRRVEELVRG

SEQ ID NO: 16286 - protein, 59 aa, Artificial Sequence
  Synthetic
ERVKKILDDIRRELEESNKKVEEDLRKAEEDLEELLRRARELSKEDEKKSRKLVEDARR

SEQ ID NO: 16287 - protein, 59 aa, Artificial Sequence
  Synthetic
DEVDEVVKRLEDIIRKHETLVKKAKEDLDRVNEEDTKLIRDVLRRLKESNEEMERLVRS

SEQ ID NO: 16288 - protein, 59 aa, Artificial Sequence
  Synthetic
ERVKEELRRVEEDVKKSDEDARRLSKEDRDHTRENFKRSEELSRRDEETSRRLMEEVKR

SEQ ID NO: 16289 - protein, 61 aa, Artificial Sequence
  Synthetic
KDVEDLVRKAEELLKRHREDVTRLLERLKKVNKDHERLVKELKRRLEELLREVRELVERDG

SEQ ID NO: 16290 - protein, 59 aa, Artificial Sequence
  Synthetic
DEVERRLRRLEEELKKSHEEVERRLDEVRRHSKRSHDELRKVLRKLEEDLRRLAEEVKT

SEQ ID NO: 16291 - protein, 61 aa, Artificial Sequence
  Synthetic
SDLEELVKRAEKLLEEHKELVKRLEDRLRELDKRHKEIVERLRKELERLLREIRRIVEEKG

SEQ ID NO: 16292 - protein, 59 aa, Artificial Sequence
  Synthetic
DEAKRKLDELEERLRRSNKELEEKSEENERRTRESNEELERRLEDVRRKLERLREEVER

SEQ ID NO: 16293 - protein, 61 aa, Artificial Sequence
  Synthetic
KDVEDLLRRLEEIIKDHRREVEELLRELTKLDEEHKEEVRRLTEELERLLDEARRLVEEKG

SEQ ID NO: 16294 - protein, 59 aa, Artificial Sequence
  Synthetic
DEAERELERVEREVRKSSDKLRRDSKRNKERTRKSNEELERRLEEVERELRRLVAEVEK

SEQ ID NO: 16295 - protein, 60 aa, Artificial Sequence
  Synthetic
KKVEDLEERLERLLRDAERRVRELLDEARRLLETHRELSKRLLERLEKVNRDIREKAKEK

SEQ ID NO: 16296 - protein, 56 aa, Artificial Sequence
  Synthetic
ERLLRRVEKEVEDLLRTVKDLLRRIEEEVRKSLEESKKLLKEVEDHSRKLLEEIRK

SEQ ID NO: 16297 - protein, 60 aa, Artificial Sequence
  Synthetic
DEDEEVLRRLKELLKTHRKLSEDLLREAEAINEDHRRLSEELLRRLEKLNEEIRRKAKEK

SEQ ID NO: 16298 - protein, 56 aa, Artificial Sequence
  Synthetic
EELLRRVEEEVKKSNEESKKKIKELEEHSRRSNEESERRLREVEEHSRRLLEEIRK

SEQ ID NO: 16299 - protein, 59 aa, Artificial Sequence
  Synthetic
SEVEDIVRKVDEIIRRLERHNEELRKRVEEVLDRLRRHNEKLDRDVKEIIKEIERVIRG

SEQ ID NO: 16300 - protein, 56 aa, Artificial Sequence
  Synthetic
KDLLREIEEKVRRLVRKSEELLRRIAEDVKKVIEDSKDSHKKIEDELRELEERLRK

SEQ ID NO: 16301 - protein, 59 aa, Artificial Sequence
  Synthetic
SEVEDIVRKVDEFLERLKEHNRKLDKEAKELLDRLKRHNEKLDEEAKRLIEEIKRVADE

SEQ ID NO: 16302 - protein, 56 aa, Artificial Sequence
  Synthetic
KDLLREIAEKAERVKEESKRSHDEIADEIRKVEEESERSHREIAEELERLSRRLKK

SEQ ID NO: 16303 - protein, 60 aa, Artificial Sequence
  Synthetic
KDVEDIVREVERLIKELREHNKELVDRAREVLKELKDHNEKLVEDVKRLIEDITRKIRAN

SEQ ID NO: 16304 - protein, 56 aa, Artificial Sequence
  Synthetic
KDLLRDIERKVEKLERDSRRLLREIEEEIRKVIERSKELLERIEKELRDLMRELRK

SEQ ID NO: 16305 - protein, 59 aa, Artificial Sequence
  Synthetic
KEVEDIVEDVKRVLDELRRHNEKLVREVDRLIRELDKHNKELDDRATEIIKRIEEVVRR

SEQ ID NO: 16306 - protein, 56 aa, Artificial Sequence
  Synthetic
KELLERIDEEVKRVEETSRRLLREIAEKVKTLKEKSKRSHEEIRRRLEELADEIRK

SEQ ID NO: 16307 - protein, 60 aa, Artificial Sequence
  Synthetic
SEVEEIVRRVEKLIEDLKRHNEKLVDEVKKVIDTLRKHNEDLVRRVEEVIKRIEEVIREN

SEQ ID NO: 16308 - protein, 56 aa, Artificial Sequence
  Synthetic
KDLLRDIAEKVKTLKEDSRRLLEEIADRVRRLEEDSRRLLEEIRKEVERLKEELKK

SEQ ID NO: 16309 - protein, 59 aa, Artificial Sequence
  Synthetic
SEAEEAAREAKEAIDRLEEHNKKLDEDAKRAIEEARKHNKELDERAKRALEEIEKAARD

SEQ ID NO: 16310 - protein, 56 aa, Artificial Sequence
  Synthetic
TDAARRIAEEVKKLEKKSEDSHRKIAEDVKKAEEDSERSHRDIARRAEEVKKKADD

SEQ ID NO: 16311 - protein, 60 aa, Artificial Sequence
  Synthetic
SEVEKIVREVEKLLEELREDNRDLVRRADKDLERMERHNRKLVKDVEDVLRRIEEVRRAN

SEQ ID NO: 16312 - protein, 56 aa, Artificial Sequence
  Synthetic
KDLLREIERKIREVEEKSRELLREIKKKLEDVARESRRLLEEIARKIEKLSDELRK

SEQ ID NO: 16313 - protein, 59 aa, Artificial Sequence
  Synthetic
SRAERIVEEVEKVITDLERDNRELVRDVRRLLERLERHNKELDDRITEIIKEILRLAER

SEQ ID NO: 16314 - protein, 56 aa, Artificial Sequence
  Synthetic
EELLREIKRKVEELEKRSKELLEEIARRVKEVEEKSRDSHRKIRERLKELVRKVRE

SEQ ID NO: 16315 - protein, 60 aa, Artificial Sequence
  Synthetic
REMEEVLKEAKELLKESNKKAREIDRKIKELLDDSHRKVKETVDRVKRRIEELDRKVKEV

SEQ ID NO: 16316 - protein, 56 aa, Artificial Sequence
  Synthetic
EEVLREVEKELEDNKRELRESHKEIARELERNKEDIDRLVEEIKRRIEELKKRIDK

SEQ ID NO: 16317 - protein, 60 aa, Artificial Sequence
  Synthetic
DEMEKVLKEAEDELRRVEKEVREVDKEAEELLERSHRKVRDIVRRVTEELKRLKDKVEKI

SEQ ID NO: 16318 - protein, 56 aa, Artificial Sequence
  Synthetic
REMLEKLRREVERVKKEVDDSHREIAKKVERNKKEIDKLVREVEREVEELKKRIDK

SEQ ID NO: 16319 - protein, 60 aa, Artificial Sequence
  Synthetic
SEVEEVLEDAKRLLKEVEKRVREIDRRAEDLLRRSHEKVRRIDKDVKRLLREVEKKVEEV

SEQ ID NO: 16320 - protein, 56 aa, Artificial Sequence
  Synthetic
EEVLKKVEDDVRRLDEEVRRSHEDIRKKVEDNKKRIDESHEEIRRLAERVKKEIRK

SEQ ID NO: 16321 - protein, 60 aa, Artificial Sequence
  Synthetic
SEDEKVVKEAKRLLDENRRENKEIDERAEKALEDSHRKVRKIDKEAKELLEKLRRDVEEV

SEQ ID NO: 16322 - protein, 56 aa, Artificial Sequence
  Synthetic
RELLDKVRREVERLKEESKKSHDRIREELRRNKEEIEKSHDEIRRRVEKLDDEIRR

SEQ ID NO: 16323 - protein, 60 aa, Artificial Sequence
  Synthetic
SEVEEVEREVRKLLKESNDKVREIDKEAKKRLKDVEDKAREIDERITKLLKDIEDEVRKV

SEQ ID NO: 16324 - protein, 56 aa, Artificial Sequence
  Synthetic
EEVLRKVEKEVEDNKKELDESHKEVKREVEEVRERIDESHKRIRERADRVKKKIEK

SEQ ID NO: 16325 - protein, 60 aa, Artificial Sequence
  Synthetic
KELEDVLEDVKRLLKESNDEVKEIDDRARRLLEESHRKSEEVDRRAEKRLREIEDKVRKS

SEQ ID NO: 16326 - protein, 56 aa, Artificial Sequence
  Synthetic
EEMLREVEERARKNKEDIEKSHDEIRKEVEDNIRRDRESHKRIEEEARRVMAEIEK

SEQ ID NO: 16327 - protein, 60 aa, Artificial Sequence
  Synthetic
SEVERVLKEADKLLKDNDEKNERVDREVEKLIRDSHEKSKKVDERAKRALDKLDDEVRKV

SEQ ID NO: 16328 - protein, 56 aa, Artificial Sequence
  Synthetic
EEMLREVEKKVETLKKKSDDSHKEIEEKIRRNIEEDDKSHERIREEAEKLKKKIDD

SEQ ID NO: 16329 - protein, 60 aa, Artificial Sequence
  Synthetic
ELEELMKKIEDDSKKNDEDTERLVKEIRDRSKRNREESKKLHDEDRREAKRVLDEARRDV

SEQ ID NO: 16330 - protein, 59 aa, Artificial Sequence
  Synthetic
EEDVRRAIEEVRRLLEKSHRDSRRVIEEVRRLLEKSHRDNRKVNEDSRRLLKKVREDAE

SEQ ID NO: 16331 - protein, 60 aa, Artificial Sequence
  Synthetic
SLEDLVREIREESERNKKETRKLLRRIEEESKRNLDESERLHREDKKRLEDIAERLERRV

SEQ ID NO: 16332 - protein, 59 aa, Artificial Sequence
  Synthetic
EDLVRKVITEVKRLLEESHKESREVIREIKELLEESHEKSKKVNEESKKLAEDVLRKAD

SEQ ID NO: 16333 - protein, 60 aa, Artificial Sequence
  Synthetic
SLEELLKKIREESKRNLDETRKLHREDKEESRKNLEESRKLHEEDRREAERVKRRADREV

SEQ ID NO: 16334 - protein, 59 aa, Artificial Sequence
  Synthetic
EKLVREVVERLRELLRESHERSREVNKRSRDLLRRSHEKSRRLNEESRRLLEEVERRVK

SEQ ID NO: 16335 - protein, 60 aa, Artificial Sequence
  Synthetic
SADELLKKLRDESEKNKDDTRKLLEELRRRAEKNKKDIEDLLREIEKKLREVLEDIKRKV

SEQ ID NO: 16336 - protein, 59 aa, Artificial Sequence
  Synthetic
EEEVKRAVDEVRRLLEESHKKSREVIKRIKKLLEDSHKKVREIVTELDKLIKEVEKKVE

SEQ ID NO: 16337 - protein, 60 aa, Artificial Sequence
  Synthetic
DLKELVDELRKKSDDNLKETERLVREIEKRLTDNKRESERLVREIEKELRDLRERIERTV

SEQ ID NO: 16338 - protein, 59 aa, Artificial Sequence
  Synthetic
KDEVRKAIKEAEELLKRSHEESRRVIERVRKLIEESHRKNREAIKRIRRLIEEIRKEVD

SEQ ID NO: 16339 - protein, 61 aa, Artificial Sequence
  Synthetic
SEIEKVREELKELLERDEREVKRVIDDLRRLIKDLRERVKEVNKRDDETVKEIKKVIEERG

SEQ ID NO: 16340 - protein, 56 aa, Artificial Sequence
  Synthetic
EEVAREVEERSRRVKRKLEELIREIKTELDRVREEIERLSKRDREKNERLREEARR

SEQ ID NO: 16341 - protein, 61 aa, Artificial Sequence
  Synthetic
SEIEDVLRELKKLLTDDKREVERANRDDERTLRDIRRKVEEAIKKLEDLLRDVKRRVDEEG

SEQ ID NO: 16342 - protein, 56 aa, Artificial Sequence
  Synthetic
KDVAEEVERESRKVEKELEDLSERDKERNDRILRTIEELIKRVEEEIRKVKEDVER

SEQ ID NO: 16343 - protein, 61 aa, Artificial Sequence
  Synthetic
SEIEDVLRKLRKLLREDEKRVEDANRRDRDTVRKIEKRSEEAFKESKETNKRIEDKVRKTG

SEQ ID NO: 16344 - protein, 56 aa, Artificial Sequence
  Synthetic
KEVVEEVRDDSRRVEEKLRRLSKEDKEENDKIRRRDRKLVEDLRRDSDRILRKVET

SEQ ID NO: 16345 - protein, 61 aa, Artificial Sequence
  Synthetic
DEIERVVEEVRELLERDKRRSDEVIERLKRLLEKDEEDVDDVIRRSKETNERIRDKIEKEG

SEQ ID NO: 16346 - protein, 56 aa, Artificial Sequence
  Synthetic
KEVVDDLKRLSKKVYDDNKELIDRVRERSREVLRRLKELADELRKLSEKIKRDADK

SEQ ID NO: 16347 - protein, 61 aa, Artificial Sequence
  Synthetic
DDIEEVVKEVEDLLRRDAEDVERAIKELRKLLEDDRDRVRKVNEESRRIIEEIRKAIERRG

SEQ ID NO: 16348 - protein, 56 aa, Artificial Sequence
  Synthetic
KEVVDKLREDSERVKKKAEDLVEEIRRASEEVKKEVDDLSREDEERLEKLKEDARR

SEQ ID NO: 16349 - protein, 60 aa, Artificial Sequence
  Synthetic
SEAEELEDRIRKLLREVEETSRRILKRARELNKRIEEESRRIIKRIKELIDEIKELVRTR

SEQ ID NO: 16350 - protein, 56 aa, Artificial Sequence
  Synthetic
ERLLRKLEREVRRLSEEVTRLDEETRRHSDDLRRRVERLDETTRRELEKLADEVRK

SEQ ID NO: 16351 - protein, 60 aa, Artificial Sequence
  Synthetic
SEAEELIKRAEDLIREIKKRSDDLVREMERLNEEIKRVSDEIIKRIEEVLEEIKKLVKKV

SEQ ID NO: 16352 - protein, 56 aa, Artificial Sequence
  Synthetic
RRLLEKLKRELKDLERRVREENERSKRHSEELVRRARKLNEKTDKDLKRLEEETRR

SEQ ID NO: 16353 - protein, 60 aa, Artificial Sequence
  Synthetic
REIEEVRKEVERVRKRYKDEVRKIVEDARRVLEEHKRRVEKLLEELERILREAKRLTDEG

SEQ ID NO: 16354 - protein, 56 aa, Artificial Sequence
  Synthetic
EDMLREIEKAVRELNEESKELLERIEREVRKSEERSKEVIKEIAERARKVVEDTKT

SEQ ID NO: 16355 - protein, 56 aa, Artificial Sequence
  Synthetic
SEAEKVLTDNRDTLRRLKEELKKVLDENRKTLEELDKRLEEVHKRHNEELDRIRKD

SEQ ID NO: 16356 - protein, 55 aa, Artificial Sequence
  Synthetic
ERVKEELKRIDEDLKRVVDRIKEKAEDIDRKLKKRVKEIMDKARESLKTLEERVK

SEQ ID NO: 16357 - protein, 56 aa, Artificial Sequence
  Synthetic
DEMREVLKRLRELVEELRRELEEVLRRNRETLKRLEEELRRVHKEHNDVLKEIRDK

SEQ ID NO: 16358 - protein, 55 aa, Artificial Sequence
  Synthetic
ERMKDELKKILDEARRVVERIDREAKRIDDELREVVERISRDAKRSLDELDERTR

SEQ ID NO: 16359 - protein, 56 aa, Artificial Sequence
  Synthetic
DEMREVLRELEDELRKIKERLKRVLDRSRELLEEWREELERVHRRNEETLRRIEKN

SEQ ID NO: 16360 - protein, 55 aa, Artificial Sequence
  Synthetic
EEIKRRAEDILRELRRLVEELERRNEEINRRLAKRIKELMEKIRREDERLKKEVE

SEQ ID NO: 16361 - protein, 60 aa, Artificial Sequence
  Synthetic
DKAKRVRTELERRLEKLKRDARKVIEEHEKSLRDLEEEVRRVREEHERSLKELKEELDRK

SEQ ID NO: 16362 - protein, 55 aa, Artificial Sequence
  Synthetic
EDVTRELERVLDELRREVDRVRRELEKIDRELRELVKRIEDELRKINKELKEKSD

SEQ ID NO: 16363 - protein, 61 aa, Artificial Sequence
  Synthetic
DEVEELVKTVRKLVEDHNRKLEEVVRRLREIVKELEDRTRRALEEARRTVKRIEEEVRKRG

SEQ ID NO: 16364 - protein, 56 aa, Artificial Sequence
  Synthetic
ERLLRELKDLLEKSKRRVDELVKEIEKRNRDHKEKVRKIVDEIRRLLRELEERVKK

SEQ ID NO: 16365 - protein, 58 aa, Artificial Sequence
  Synthetic
KLEEILRRIRELLKRHHEKNKKILDDIREKSKKLKKKVDDILTRITEIIKDLEREVDG

SEQ ID NO: 16366 - protein, 59 aa, Artificial Sequence
  Synthetic
ERVLEDLRRKADDIIRRADEESRKIKEEADDIFRRSDELLKRLEDEAKRIADEVRKKTK

SEQ ID NO: 16367 - protein, 59 aa, Artificial Sequence
  Synthetic
DSDRIEETIKKLLKELSDKSKEVLDEIRKRLKDHHDRNRKVLEEIRRILKRLEEEVRRK

SEQ ID NO: 16368 - protein, 59 aa, Artificial Sequence
  Synthetic
KRALKEMLDRVRKIIKEYEDSLRRLKEEVDEIIERADRLSEELRRKAEKIIRDITDAVR

SEQ ID NO: 16369 - protein, 58 aa, Artificial Sequence
  Synthetic
DSEELLREIRKRLEDLSRKSEEIKRRIDEISRDLERKVEEIKKRIEELVRRVRTEADK

SEQ ID NO: 16370 - protein, 59 aa, Artificial Sequence
  Synthetic
RKVLERIREEADEIDKDYDRLLKEIRKKIEDIARDTERRLRELKDRVDKIIKKVEEDER

SEQ ID NO: 16371 - protein, 57 aa, Artificial Sequence
  Synthetic
REIETVTKKSRDLNREIDKKLKELTERVDKLIEEWKRKTDRVREEAKRAVKEIEDKN

SEQ ID NO: 16372 - protein, 59 aa, Artificial Sequence
  Synthetic
EELRRVIEESKRSNDELKKKADELSKRVKEALDRLEEEDKRVLEEIKDILRELRERRRK

SEQ ID NO: 16373 - protein, 56 aa, Artificial Sequence
  Synthetic
SEIEEVEKKSRELNRRVKERLDEVEEESRRLNEKWERDTRRVRERVEEEIKKIEER

SEQ ID NO: 16374 - protein, 59 aa, Artificial Sequence
  Synthetic
EKLDEVLKRSEDSNRELKRRAEELLRDSERTNEELRRRDEEVKREVEEKLKELEKEIRR

SEQ ID NO: 16375 - protein, 58 aa, Artificial Sequence
  Synthetic
SSKEILKEIDERVEELKRRNEKVDREIKEKVKRLEEENEKVDREIKEILKELEKEAEK

SEQ ID NO: 16376 - protein, 59 aa, Artificial Sequence
  Synthetic
EEVLERLRREVRKRIEDYKRKLDKIARDVDETIERYKRKLEEIKRRVEDEARKIKEEIR

SEQ ID NO: 16377 - protein, 61 aa, Artificial Sequence
  Synthetic
SRKEELKRRLDEALKKYEADLDELRRRHEEDVRRSKEENERLLKELEDAVRRAKEEVKKAG

SEQ ID NO: 16378 - protein, 56 aa, Artificial Sequence
  Synthetic
DRRVEKEIREAIERLKRNLERIKRNIEKVREDSKRVNKELRDKIREIIERIDRRLK

SEQ ID NO: 16379 - protein, 61 aa, Artificial Sequence
  Synthetic
SRKEKLLDDARKILKRAEEELKRLYDKHRRIIEEVKRDLERLKKEHEDVVRRVEDVLRKRV

SEQ ID NO: 16380 - protein, 56 aa, Artificial Sequence
  Synthetic
DKELEEDIRRIEDRLRRLLEELEKLIEDSMRELKRVLDELEKHIREVDEELEEDLK

SEQ ID NO: 16381 - protein, 64 aa, Artificial Sequence
  Synthetic
SEAERVKRELDEALKKAKKALEDNKRKLEEALRKHREDAKRWKEELEKALKEAEKAAKDLRRDA

SEQ ID NO: 16382 - protein, 55 aa, Artificial Sequence
  Synthetic
KEAERKLRELEKRAKEALERSKEHSDELEERARKANKEIEDKLKRLAEEAEKEAR

SEQ ID NO: 16383 - protein, 56 aa, Artificial Sequence
  Synthetic
SEAEKIKKDLDKIREDLKRLDREAEERVRRLSEELDRKDRELRKRIDEILKRMRDE

SEQ ID NO: 16384 - protein, 59 aa, Artificial Sequence
  Synthetic
DEDLKRLEDELRKVEEDNRRTLEELRRRVEEVSRRNKESLEDIRRKLEEAIRRLREKTR

SEQ ID NO: 16385 - protein, 56 aa, Artificial Sequence
  Synthetic
DGAEEVDDRLKKADEELRRKDKESDEKTKRIAEELRKLLEESKKKTEDLVRRLDEE

SEQ ID NO: 16386 - protein, 59 aa, Artificial Sequence
  Synthetic
EKRLRELEKKVEDVSRTNKKTLEDNRKKIAEVVKRLDEEIKRNKDTVRRVVERVKKDTD

SEQ ID NO: 16387 - protein, 60 aa, Artificial Sequence
  Synthetic
ERKERLKERLDEVKKEHERLVERWHRENREVLRENRETVERLERELERVLRELRDALREQ

SEQ ID NO: 16388 - protein, 56 aa, Artificial Sequence
  Synthetic
DEELEKRIEEVERKLRDTNRKIEELLKRLKKRHEEVDRELERLLEKLEREAEETRR

SEQ ID NO: 16389 - protein, 61 aa, Artificial Sequence
  Synthetic
SEEEELEKELEKVLRENEESVRRLHKRNRDVLKKNRETLEKLEEDLKRVLERLKRALDRKN

SEQ ID NO: 16390 - protein, 56 aa, Artificial Sequence
  Synthetic
EKEARDEVRRLKKKMDDVDKDVERLVRELEKEHEEVDKDLRRKLDEVRKELEDARR

SEQ ID NO: 16391 - protein, 57 aa, Artificial Sequence
  Synthetic
SEEERLEKELDEVLEDHKRRVEEWKKKMDEVNKKHKESIDRLREELDRVLDEVRKAG

SEQ ID NO: 16392 - protein, 60 aa, Artificial Sequence
  Synthetic
REEALKRLEELVRKLKEKLERINRRIARIVDKNTKEIKDTNDTLRKEVRDLMKELKDRTR

SEQ ID NO: 16393 - protein, 57 aa, Artificial Sequence
  Synthetic
REDEEVKKELRKILEDHKRRVEDWKRRLKKNLEEHRRRVEEWKRRLDELLEKVRRAG

SEQ ID NO: 16394 - protein, 56 aa, Artificial Sequence
  Synthetic
EEEIKRVIERLARDARRINERLRELLERLSEISERINREIEKIIDEARERLEREER

SEQ ID NO: 16395 - protein, 57 aa, Artificial Sequence
  Synthetic
SEKEEVKKRLKDNMRRAEELIRRDDREVEENRKRHDELVKEWDKRLREILKKAEDSG

SEQ ID NO: 16396 - protein, 56 aa, Artificial Sequence
  Synthetic
EKEIKEVLEELSRTSKRLIEDSKRSSERLSERSKRTNEEIERIVRAAKRTIEERER

SEQ ID NO: 16397 - protein, 60 aa, Artificial Sequence
  Synthetic
SVAEELEERLKEIKRESEKSIRDLRRLLEEIERRLRDINRKLDEIVKRVAEKIKDAETKG

SEQ ID NO: 16398 - protein, 59 aa, Artificial Sequence
  Synthetic
KKVVDDVERKLREIIRRHEEELKKIKEDLDKIREDHERLLREWKKELDELITRVAESAR

SEQ ID NO: 16399 - protein, 60 aa, Artificial Sequence
  Synthetic
SVSKKLDDELRKMEREIEKSNETIKKLIEDIRRRSKESRDRLKELLEEIKKRLKEAEERG

SEQ ID NO: 16400 - protein, 59 aa, Artificial Sequence
  Synthetic
EKVVEDIERRVEKVLTDHERELERVERELDDIIRRHEEELEKIERELEKIKEDVDRSAK

SEQ ID NO: 16401 - protein, 60 aa, Artificial Sequence
  Synthetic
DELDRLRELLEELKRRSETVIKEAEELLRKLERELRELIREWKEITERLARRMEDLSRKG

SEQ ID NO: 16402 - protein, 59 aa, Artificial Sequence
  Synthetic
REDLKRIEEELREILKRHRDANKRIKDEVEELLKRVEEMLRRLHEEDRKLLEDLKRETD

SEQ ID NO: 16403 - protein, 60 aa, Artificial Sequence
  Synthetic
RETEEVKKDVDRIRKASEDVARKMEKITRDVAKELRDLIEEWRRRSEELKKELEDLSRRG

SEQ ID NO: 16404 - protein, 59 aa, Artificial Sequence
  Synthetic
EDELKRIEEELRKILKEHEDKNREIKKENDRLNKEVEEEAEKATREDKRLLEKADRDRQ

SEQ ID NO: 16405 - protein, 57 aa, Artificial Sequence
  Synthetic
SEKEEIEKRLDKLLKEHEEENDKIRRTLKEINDRSKEEVERIEERLKDLLRRLRERI

SEQ ID NO: 16406 - protein, 56 aa, Artificial Sequence
  Synthetic
TKRARDRLEELRRESEELIKTARDLVRRSEKEHRDLIERLRRILEELREKLERKTT

SEQ ID NO: 16407 - protein, 60 aa, Artificial Sequence
  Synthetic
SVKEEVRTLLRRLERVSRELIRRLKEMLKTLHEENKKLIDDSRKLIRKIKRDLERVAERR

SEQ ID NO: 16408 - protein, 59 aa, Artificial Sequence
  Synthetic
KDTVKKVKEDLKDILRRHEEANERIRDELRRNLRKHEDDSKKSKEELDRILKKARDDAR

SEQ ID NO: 16409 - protein, 59 aa, Artificial Sequence
  Synthetic
DIEDELRKELEKHHTKSREVKRRLTELLKRHEDRVEEVERRLRKDLKELRDRIEELSKI

SEQ ID NO: 16410 - protein, 59 aa, Artificial Sequence
  Synthetic
EKVAREVEERLKRDHDDLRRVIEEIRKRLEDSHRELKKTIEDVKRRVEELIEEAERRMK

SEQ ID NO: 16411 - protein, 59 aa, Artificial Sequence
  Synthetic
SIREKLREVLERHHRTSRKVEEDLRRKLEDHHRKTREVAERLKEKVDRLREEIKRASRI

SEQ ID NO: 16412 - protein, 59 aa, Artificial Sequence
  Synthetic
ERVVRKIEKDLRDDHRRLKEIAKRIDDEARRDIKRLEEIIKKIEEEVDRLIEEVRRRDK

SEQ ID NO: 16413 - protein, 60 aa, Artificial Sequence
  Synthetic
DKDREIERLAKEAKDRHDKTLEDDRRRLEEVRRKIEETIRRIKKKLDEAKKRLKELVRDK

SEQ ID NO: 16414 - protein, 55 aa, Artificial Sequence
  Synthetic
EEILKELEEIVRRVEEKNKRLHDENEKDTRRVEAVLEDIKRRIDEIVRRLEERIK

SEQ ID NO: 16415 - protein, 60 aa, Artificial Sequence
  Synthetic
DEKDRIDKRMKEVLKKIEELIRRDERRLEKVRKDHEELVRRIEDELRRVLEELKKLVEEK

SEQ ID NO: 16416 - protein, 55 aa, Artificial Sequence
  Synthetic
EDIERKIRELEEKVERELKKIHDENEKLAEKARRDLERIEREIDKLVKDVEDAIR

SEQ ID NO: 16417 - protein, 60 aa, Artificial Sequence
  Synthetic
SEKDKITKTLEDAKRDHRKLVEEDEKALEEVERRHEEIVRRIEEKLKEAKEELDRLVRDK

SEQ ID NO: 16418 - protein, 55 aa, Artificial Sequence
  Synthetic
EKILREIEERIKEVKENLRRVHEENRELAKKVLKDLERILEEIKKIIKELRERVK

SEQ ID NO: 16419 - protein, 60 aa, Artificial Sequence
  Synthetic
SKKDEIEETIRRARERIKTIVDRIREELKRIRDKHKKLVDEDKKTLEEVLRTLRELVRDK

SEQ ID NO: 16420 - protein, 55 aa, Artificial Sequence
  Synthetic
DEILEKVKELVREVEEVLRRIEKEIEDLVRKVEEDLRRIHERNRELAKKADDDIK

SEQ ID NO: 16421 - protein, 60 aa, Artificial Sequence
  Synthetic
SKEEEIEKTLKKIEEDHRELVRRIERALDDARRRHKELVDRDDKELRDAERELDRLVREK

SEQ ID NO: 16422 - protein, 55 aa, Artificial Sequence
  Synthetic
EEILKEIRDLADEARRNLERILRDIERVVEKVERDLKRIHDKNKRDVERVRREVK

SEQ ID NO: 16423 - protein, 60 aa, Artificial Sequence
  Synthetic
KEKDDIDRDLKRAEEEHKRLVDEIRETLKEIEREHRERVKRIKEKLDEAKRRLEKLKRDR

SEQ ID NO: 16424 - protein, 55 aa, Artificial Sequence
  Synthetic
EKILEDIKREVDRVRKNLKEIKEKIDKEREDVKRDLDRIRKEIEELVEKVDRDVK

SEQ ID NO: 16425 - protein, 60 aa, Artificial Sequence
  Synthetic
DKARKIEEDIRRAEEEHKELVKRNEERIKEVAERHEETVRDIERKAEDIRRELKKLVDEK

SEQ ID NO: 16426 - protein, 55 aa, Artificial Sequence
  Synthetic
KEILDEVKKLVDEVRANLEKSHEDIERLVEKVREDLKRIEERLRKIAEDLRRRVK

SEQ ID NO: 16427 - protein, 60 aa, Artificial Sequence
  Synthetic
EEEREIEDTIRRAEEEHRKRVEDNKRRLEEAEKEHRKRVEDNKRRAEEIRRKLKELVDRK

SEQ ID NO: 16428 - protein, 55 aa, Artificial Sequence
  Synthetic
EEILKKVKELVDRVRRNLERSHEKIKRIEDKVRRDLERSHKELEDLMRRMEEEIR

SEQ ID NO: 16429 - protein, 57 aa, Artificial Sequence
  Synthetic
EKKERIEERAKEVEREHREIVKRDEEELERVREEHEESVRRDRKALEDVERDVRRDG

SEQ ID NO: 16430 - protein, 56 aa, Artificial Sequence
  Synthetic
MEDMLRKVKEVADENRERLKELHEENERTARRLRKLNRELHEENKRLVEEIKKEAK

SEQ ID NO: 16431 - protein, 57 aa, Artificial Sequence
  Synthetic
SKAEEIRKELDRVRREIEKRAEEDKRTLEEVRREHEKLVRENEETIKRVEEDVERAG

SEQ ID NO: 16432 - protein, 56 aa, Artificial Sequence
  Synthetic
MEDALREIKEVADEVRKKLRELHEKNKKLMDDNRRKLDKSHKDVREVEREIRERIK

SEQ ID NO: 16433 - protein, 57 aa, Artificial Sequence
  Synthetic
DKERRIEEELEKARRDHKEDVDRDRERLKEVREEHERLVRENKKRLEEIRKELEDRG

SEQ ID NO: 16434 - protein, 56 aa, Artificial Sequence
  Synthetic
MEDLLREVKRVVEKNKEDLKRLHDENEKLAEENRRRLKKSHDEVEKVAEDLKRKAK

SEQ ID NO: 16435 - protein, 57 aa, Artificial Sequence
  Synthetic
EKKERIEDDLRRVKEEIDDLLRKNEKRLREAEDEHRKRVEDDRRRLDEVRKEVDDEG

SEQ ID NO: 16436 - protein, 56 aa, Artificial Sequence
  Synthetic
MEDALRKLKRVADEIRKRLDESHKEIKKVVDDNRKKLEELHRKNRELERKIREDAR

SEQ ID NO: 16437 - protein, 56 aa, Artificial Sequence
  Synthetic
KDEERIKKKLKKLVDENRDLNRRIEETNRRVAEDLDRRLKEIEKRNRDMAEELRKS

SEQ ID NO: 16438 - protein, 55 aa, Artificial Sequence
  Synthetic
DEIRKRAEDAERETRETNRRIRDHTRRVAERVEKVLDEIRRHTEEVKKEVDEKER

SEQ ID NO: 16439 - protein, 56 aa, Artificial Sequence
  Synthetic
SDEERIKDKLEKLVKENEDKNRRILEENKRVADENRRLNEEIEKRLEEMVEELERR

SEQ ID NO: 16440 - protein, 55 aa, Artificial Sequence
  Synthetic
EEIRKRVKEAEDKTEETNRRIEKHHREVKKESEESNKRITDRLEEVKERVTRKRK

SEQ ID NO: 16441 - protein, 56 aa, Artificial Sequence
  Synthetic
KREEDIKRRLEKLAKENRERNEEIKRRLDELVDRNREENEKILRELEKMVRELERS

SEQ ID NO: 16442 - protein, 55 aa, Artificial Sequence
  Synthetic
EEARKRLEELKKETEDTNRRIDEAVERAKEETRRTNERIKEELKRVKKKVTDKRR

SEQ ID NO: 16443 - protein, 60 aa, Artificial Sequence
  Synthetic
SEVETAKEDLKKKVEENEKRIKDVEDKLRKTVEDNRKRLEDVLEELRRSVETLRDLLRKG

SEQ ID NO: 16444 - protein, 55 aa, Artificial Sequence
  Synthetic
EELEKRLREAEEKSDRLLRRLKEESRKAEEDSKRLLKELKEESRRAEEEVRRARD

SEQ ID NO: 16445 - protein, 60 aa, Artificial Sequence
  Synthetic
DEKEEAKERLKELRRRLEETDKRVDEELEKLMREMEDTDRRVKEKVDRSRREADEVLRRG

SEQ ID NO: 16446 - protein, 55 aa, Artificial Sequence
  Synthetic
EELKRRLRKVSEENKESNERLRRKVKRVVDENRRTNKELKETSKKVKEDIERKRK

SEQ ID NO: 16447 - protein, 60 aa, Artificial Sequence
  Synthetic
SELEEVTDRLRKLAEKARRLDKEYEEKSRKLKEEVERIDEDLDRLLKELTDEVREIAERG

SEQ ID NO: 16448 - protein, 59 aa, Artificial Sequence
  Synthetic
EEALRRIEKEIREVEKENRDTLERLRRHDEEVNRTNKETLDRLDEKLKRVEREIDERRK

SEQ ID NO: 16449 - protein, 61 aa, Artificial Sequence
  Synthetic
DEEEDLKEKVKKVETEHEETLKEIRRKLEDVKREHEKTVEEIRDHNRKVEERIRDVERRKD

SEQ ID NO: 16450 - protein, 55 aa, Artificial Sequence
  Synthetic
ERIRERLEELMRDARRLNRELDEKVRKLVEKARRDNTRVKKKSRELMKEIDDELR

SEQ ID NO: 16451 - protein, 61 aa, Artificial Sequence
  Synthetic
DEEEELKERIERVKDENRRSVERLRRELKRVEDDHRETVKDLERRLREVKKEIEELVRRKD

SEQ ID NO: 16452 - protein, 55 aa, Artificial Sequence
  Synthetic
EELKKKLEELMKEVRDLDRELKREVEELEREIRRLNKEIRERIEDLVRKAREAIR

SEQ ID NO: 16453 - protein, 61 aa, Artificial Sequence
  Synthetic
REEEELKKKLDDVRRENEESVKKIKEDIDRVRREHEKTVEEIRRHNKKVEEEIRAEVRRKD

SEQ ID NO: 16454 - protein, 55 aa, Artificial Sequence
  Synthetic
DRIREEIEKLAEEIRRLDERLEEELREIVRKMRELNRRVAEKSKELTEDARRRLK

SEQ ID NO: 16455 - protein, 60 aa, Artificial Sequence
  Synthetic
SEREEIRERLRRNLEELRKSIKKIEDDLRRLEKRHRDAVKEIEDRLRRLEEKLDEMAKRD

SEQ ID NO: 16456 - protein, 56 aa, Artificial Sequence
  Synthetic
REDVKRAVDEIHKHTKEKEDRLRKLLKDLEKNIEDAIRRLEKLLRDLEEEIKEAAK

SEQ ID NO: 16457 - protein, 59 aa, Artificial Sequence
  Synthetic
EESERILEKIRRAAEEDKERIRKAIEELRKLAEEDERKLRKANKEARDSARELRRLLKE

SEQ ID NO: 16458 - protein, 58 aa, Artificial Sequence
  Synthetic
EVVEEARRLIKKWREEVERLNEEIKKLVEDWDRRVKELNERHRDDDRKIEKEVEDEEK

SEQ ID NO: 16459 - protein, 60 aa, Artificial Sequence
  Synthetic
SELEKALEEIKRLAEDDMRRIKKVIKELEKLARDDEKRLREVIERLETEVRKLEELLKRG

SEQ ID NO: 16460 - protein, 58 aa, Artificial Sequence
  Synthetic
EVVDELRKRLKEVKERAEDLNRKLEELIRRWKERVERLNRELEKRMRDVEEKVRREEK

SEQ ID NO: 16461 - protein, 60 aa, Artificial Sequence
  Synthetic
SDLEKILEELKRLAEEDKRKLEEVIKKLEEAARKDAEDLKKVNEEAKKSARELEELLKRG

SEQ ID NO: 16462 - protein, 58 aa, Artificial Sequence
  Synthetic
EVVREIEELLKKIEEEVRRLNEELKRLADEWRREVRRLNEEHKDTDRRIKERVKRAEE

SEQ ID NO: 16463 - protein, 60 aa, Artificial Sequence
  Synthetic
KDMERMLKEIEDLARKLREELKRVLDELRKTAKRDEEELKKVNKEAKESARELEEKLRRG

SEQ ID NO: 16464 - protein, 58 aa, Artificial Sequence
  Synthetic
EVVKELRKLLKKIKDDVRRLDKELDELLRRWEESVERLNREHKKTDEKVEEDVKRTTT

SEQ ID NO: 16465 - protein, 61 aa, Artificial Sequence
  Synthetic
SEEEKVEKELRDLVREDDRRLREVEERVRKVVKEAEDDHRRVKEDIRRMVEEIRKKLDKDG

SEQ ID NO: 16466 - protein, 55 aa, Artificial Sequence
  Synthetic
ERLEDEVRKVEDRSRRMNERIDERLKRVEEESKKAIEELRRELERVKREVEERKR

SEQ ID NO: 16467 - protein, 61 aa, Artificial Sequence
  Synthetic
SEVEEVKKELEKLAREDEKRLEDVKEEVKESARRDKRRLEEVEEDLDRLVKELEDKLRDDG

SEQ ID NO: 16468 - protein, 55 aa, Artificial Sequence
  Synthetic
DELKRKLKRVEERSREVNRELRERDKKIEEDSRRINKRLKKKVDEVKEKVREDTR

SEQ ID NO: 16469 - protein, 61 aa, Artificial Sequence
  Synthetic
DEEEDVRRKLEELARRLKRRLEEIEKRLRDSVKEDRRKLEEVKEKLRELIKKLEDEIRKKG

SEQ ID NO: 16470 - protein, 55 aa, Artificial Sequence
  Synthetic
EKLKEDVERVKRDVRRVIRELEKTDERIERESRKVNEELKELVERVERSVKKADE

SEQ ID NO: 16471 - protein, 60 aa, Artificial Sequence
  Synthetic
DEDREARKKVEALLKEVEDRVRESKKRTKDLLREIEKRLRDTTREIDELRRRIEDLSRRG

SEQ ID NO: 16472 - protein, 59 aa, Artificial Sequence
  Synthetic
EEVLRELKELLDKIRETIERASKENEELLREIEKRIEDANRENTERLRRIEKRIDDDAR

SEQ ID NO: 16473 - protein, 56 aa, Artificial Sequence
  Synthetic
SEKDELRKRVEDIKETAKKVVEELREASRKIHEDNKRVNDRLRKESKRIKDKADKL

SEQ ID NO: 16474 - protein, 55 aa, Artificial Sequence
  Synthetic
ERAREEVRRIEKTIRDTARRVRERVRDSERRFRKLVREWEKLVEDSERKIDELSK

SEQ ID NO: 16475 - protein, 56 aa, Artificial Sequence
  Synthetic
SAKEEIKERVKRIEERLRRLLKELEEKVKRIHDENRKVNKELTDRSKEIKDRLKDL

SEQ ID NO: 16476 - protein, 55 aa, Artificial Sequence
  Synthetic
EEVREELKRIEERLDRTLREVRKTLEDIERRIRKAVEDWRRLVKESEERVKRLTD

SEQ ID NO: 16477 - protein, 60 aa, Artificial Sequence
  Synthetic
SEEERVRKDLKELHEHLKREVDKARKDLEDMHRHSEELAREVRERHERSKRELDELERRG

SEQ ID NO: 16478 - protein, 55 aa, Artificial Sequence
  Synthetic
EEIEERVRRNEDTLRRVLKELRERAKRNKDDIRRVLKELEDRSREIEKKLREAER

SEQ ID NO: 16479 - protein, 60 aa, Artificial Sequence
  Synthetic
TEEERARETLDRLNKHSKELVDRVREKLKRLVEHSRELLRRVDRKHKESEKRVREVSRRG

SEQ ID NO: 16480 - protein, 55 aa, Artificial Sequence
  Synthetic
DEIERRVERNKREIDKVLKELEERVRTNKDEIDKALEKLKRLSEEIKRKMREDET

SEQ ID NO: 16481 - protein, 60 aa, Artificial Sequence
  Synthetic
KEKEELDETIRRLEEHSKKKVDKVRKELKEMDEHSRDEARRVRREHEKSEEKVRRASEEG

SEQ ID NO: 16482 - protein, 55 aa, Artificial Sequence
  Synthetic
EEARERLRKNEEEIKKVLEELERRVRENKERIDDVERELEDLSRKIEEKLDRDDT

SEQ ID NO: 16483 - protein, 60 aa, Artificial Sequence
  Synthetic
KEEEEARRTLERIERRIRKALKEIDETLKRLNDHSAKRVKEVREKHEESRRKVDDVSRRG

SEQ ID NO: 16484 - protein, 55 aa, Artificial Sequence
  Synthetic
EEIRERVKRIKEEMDRALKRLKDKVKENKERIDEVLKDLRRTSKEIKERLDRSTK

SEQ ID NO: 16485 - protein, 56 aa, Artificial Sequence
  Synthetic
SKKEELERLLEEAKKKHEESERRLRESSKKLEEEIRRMKEHSKKSSEDAEDKLRRN

SEQ ID NO: 16486 - protein, 54 aa, Artificial Sequence
  Synthetic
ELLERIKDLVRRSEEENKKLLDEHRKIVKTLKERLEKLNEEHERIVREVERRTR

SEQ ID NO: 16487 - protein, 56 aa, Artificial Sequence
  Synthetic
SSEDELRRLLKEARDTHRESEKRLRDSSKRAEDMHEKSKEDVERSSRELEKELRRR

SEQ ID NO: 16488 - protein, 55 aa, Artificial Sequence
  Synthetic
ERLLDEVRKEMKRSEEENRRLLREHEEVVKKSIKENKELLDKHKEIEDRLREEIR

SEQ ID NO: 16489 - protein, 56 aa, Artificial Sequence
  Synthetic
SEKETLKRLLDEIKKRHKESEDRVRKLVEDAREELDRVADELRKSSEDLRRDLKRA

SEQ ID NO: 16490 - protein, 55 aa, Artificial Sequence
  Synthetic
SKLLREVEKLMEESRKRNEDLLKELRDIIEDLREKLRELLREHREAAKRLRDEIR

SEQ ID NO: 16491 - protein, 57 aa, Artificial Sequence
  Synthetic
DERETLEKLLKEVRDMHEESKKRLTDSSRKLREDLRRVKEELDKTLRDIEERAKEEN

SEQ ID NO: 16492 - protein, 55 aa, Artificial Sequence
  Synthetic
SRLLEEAKKLIEESKRENEELLKEHDKIVKELIKKLRDLLKEVEDRARDVTEEAK

SEQ ID NO: 16493 - protein, 56 aa, Artificial Sequence
  Synthetic
SSRETLDELLRRAEEIHRRSEEELRRSSEEVRRKHEKSERDLEKLLRDAEELLRRE

SEQ ID NO: 16494 - protein, 55 aa, Artificial Sequence
  Synthetic
DKLLDTVRKLVETSRDENRKLLEDHKKMVKESEDRNRELLRDLERVIEELSRRIR

SEQ ID NO: 16495 - protein, 56 aa, Artificial Sequence
  Synthetic
SEVEEILDRLRREVERSKKKVEDILRELKKLAEDTKEKVERVLDRNRKTIEELKKA

SEQ ID NO: 16496 - protein, 59 aa, Artificial Sequence
  Synthetic
EDLVTKLRDLLRRHHETLRRLAKELRDLLKKHHEELRRLIERLEKSLEDLERELDKTRR

SEQ ID NO: 16497 - protein, 57 aa, Artificial Sequence
  Synthetic
SEVEKILEDLKKLIKESKDEADRILTDHRRLVKETEEEARRALERNRKTVDDLRKAN

SEQ ID NO: 16498 - protein, 59 aa, Artificial Sequence
  Synthetic
EEALRELRRLLKEHHEILRKVEEELRRSDEEHHRRLEEVERRLRKSLRELEETVRETTR

SEQ ID NO: 16499 - protein, 57 aa, Artificial Sequence
  Synthetic
SEAERILEKLDRLVKETDRRVKEVLEDNRRTVRRLEEEVKRILKENRETARELEEAN

SEQ ID NO: 16500 - protein, 59 aa, Artificial Sequence
  Synthetic
EEVLRRLKKLLDEHNERLRRLERDLDRSLKEAKETLDELERRLEKSLRELKESVDRTRK

SEQ ID NO: 16501 - protein, 60 aa, Artificial Sequence
  Synthetic
SSEERLKEEFKRAAEKVRKVEEELRELHERVEKSSRDSKRRIRELLKRAEEEVKRVEDRG

SEQ ID NO: 16502 - protein, 55 aa, Artificial Sequence
  Synthetic
DEVLRDLKRLIEELEDKARRVLDKSRRIIERLRRKDEEVLRKLEKEIRELKKKAN

SEQ ID NO: 16503 - protein, 60 aa, Artificial Sequence
  Synthetic
DEERELRRLLEDVKRRVREVEEELRRLHEEIKRTSKRSKEELRKLHKELEDAVREMAKRG

SEQ ID NO: 16504 - protein, 55 aa, Artificial Sequence
  Synthetic
DKVLRDLEELVKELKRRLDEVLETSRREAEKLKRDDEKVLRESKKIMEDLRRRAE

SEQ ID NO: 16505 - protein, 60 aa, Artificial Sequence
  Synthetic
SEEDELRKLLEELRRRSKEVNDRLRKLHDELRRRVEDLKRKLRELHKEAAKIVEEMKARG

SEQ ID NO: 16506 - protein, 55 aa, Artificial Sequence
  Synthetic
DKVLEDLRRLVEENTRRLEEMLKRSEKIARDLLEDVKRFLDESKKKIDTLRRRAE

SEQ ID NO: 16507 - protein, 60 aa, Artificial Sequence
  Synthetic
SLEDELRRLLTEAEKRSKDVNERLRDLHREVRELSEDVNRKLEELHRELEERVKELKREG

SEQ ID NO: 16508 - protein, 55 aa, Artificial Sequence
  Synthetic
DEVLKKLKELVRRNEEELEKALKESKDIVEKNKRDLDEVEKKSREIVRELIERTK

SEQ ID NO: 16509 - protein, 60 aa, Artificial Sequence
  Synthetic
SLEETLEKLLREAEDISRKANKRLEEAHERIKRTLEDLERKLEKLNKEVRDRVERVKERG

SEQ ID NO: 16510 - protein, 55 aa, Artificial Sequence
  Synthetic
DKVLEKLKRLIEENKKRLERVLEKSDKILDDLRRKVEEVLKRLEKTVKDLEDEAR

SEQ ID NO: 16511 - protein, 61 aa, Artificial Sequence
  Synthetic
SEDEELLRRLEETIRRATERVKRLLDTLRKLAEDVRKELERLLDTHRELAKRIEDELREGR

SEQ ID NO: 16512 - protein, 55 aa, Artificial Sequence
  Synthetic
EEVERVLREVTKRLRDLKREHRKLLEKVKRELEKVEEDHRDSSRKLEEIIKEAEK

SEQ ID NO: 16513 - protein, 61 aa, Artificial Sequence
  Synthetic
SEAEKLAKDIREAAKRLREHAERDKEELKKAADKLRDEARRDAEKLKRAAEKLKDLARRTG

SEQ ID NO: 16514 - protein, 59 aa, Artificial Sequence
  Synthetic
EEAAKRIKELLDKARKDLEDAKREAEELNRRAREELEKAKKDAEDLNRRAKEELDKARK

SEQ ID NO: 16515 - protein, 60 aa, Artificial Sequence
  Synthetic
DDKDKLLEELRKVIEELEKKLEDNNRELEKVLEKLKREAERDLERLREMIRRLEELLRRD

SEQ ID NO: 16516 - protein, 59 aa, Artificial Sequence
  Synthetic
EEVLDRLRRIIEELRERLKRAEKSNRDILERIDRELEKLKRRAEELNEELRRRLKERRD

SEQ ID NO: 16517 - protein, 61 aa, Artificial Sequence
  Synthetic
SRTEEVLKELRTLMRELRRRLEEVIKELEKSAEELERIAREVAKRSRKVIEELKRKADKDG

SEQ ID NO: 16518 - protein, 55 aa, Artificial Sequence
  Synthetic
EELEDLLRRIRETLEDMKRRLDELDTELEKRLREVARTLDELHKELEETLRRLKK

SEQ ID NO: 16519 - protein, 57 aa, Artificial Sequence
  Synthetic
DAEDELRELSKRNKDEVREVKERLKKLSEENRRDLERVKRKLEKDSEENREALEREN

SEQ ID NO: 16520 - protein, 55 aa, Artificial Sequence
  Synthetic
EELKKRIEELIRRSRKLAEDLKKKLEDIHRETERLVRELAELVRDLHRRTKEKAR

SEQ ID NO: 16521 - protein, 57 aa, Artificial Sequence
  Synthetic
SAEDRLRELSKRNREEVEEVEKRLRELMERIRRRLREVKEDLRRLSEENRKTLERKN

SEQ ID NO: 16522 - protein, 55 aa, Artificial Sequence
  Synthetic
EEIEERIKRLIKESRDLARELEEKLRKLLEELEKLAKRLREKVKELHDDTERAAK

SEQ ID NO: 16523 - protein, 58 aa, Artificial Sequence
  Synthetic
SEEDELRELSRRNEEEVKKAKRDLEKLSRENEEDLKRVKRKLEKKSEDNRRILERDNR

SEQ ID NO: 16524 - protein, 55 aa, Artificial Sequence
  Synthetic
EEVKKKIEDLIRRSRELVERLKRKVEELHKTTKRLVEELEKTIDRIIEETRERAR

SEQ ID NO: 16525 - protein, 60 aa, Artificial Sequence
  Synthetic
SAEDELRRLLRENRERNKKADKDIKKLLDDNRRDLERLRRELERILREIEKRLKDVEKDV

SEQ ID NO: 16526 - protein, 59 aa, Artificial Sequence
  Synthetic
EDVVRELMKKVDDDHKESEKLVRESEEKLERDNERTRRIADKLRKELDDTREEIERDAK

SEQ ID NO: 16527 - protein, 56 aa, Artificial Sequence
  Synthetic
DSEERAEDVARENKEILERVDEKARKLLDDNRKVVEELKKTNEESSRELKRVLDEL

SEQ ID NO: 16528 - protein, 59 aa, Artificial Sequence
  Synthetic
EETVEELLKKMRAISRDSERKVKELLDKIRELSDRSRRRAEELNKEHKKIVDDIAERRR

SEQ ID NO: 16529 - protein, 57 aa, Artificial Sequence
  Synthetic
SVEERLRELVKENRDVVRRAEEEFRRLVEENKRILEEIDRRARESSRKLKDVLDKLN

SEQ ID NO: 16530 - protein, 59 aa, Artificial Sequence
  Synthetic
EETMERLLRKAKEISRRSKERLKRLLDKVKKLSEDSERELKKLLDEHEKIVEDIEREAR

SEQ ID NO: 16531 - protein, 56 aa, Artificial Sequence
  Synthetic
DDERRLREVSDRNRRILDRIKKEVERLLDEVRKILKEAEDRLRRSSERLEELLRKD

SEQ ID NO: 16532 - protein, 59 aa, Artificial Sequence
  Synthetic
EREVKKTLDEMRRRSRESEEELKKLLKEIKEIVEELKRKLDTLLKEHKEIVEEIKRRTT

SEQ ID NO: 16533 - protein, 56 aa, Artificial Sequence
  Synthetic
SDEERVRRLEEEVDKTLEKVERELRKVSEENKRTLDRLRAEMEKSSKELERVLEEL

SEQ ID NO: 16534 - protein, 59 aa, Artificial Sequence
  Synthetic
ERDVERTLRKIEETVKKLAEDLKRLLDEIKKISEESKRRAEELLRKHKKIVDDIDKRTR

SEQ ID NO: 16535 - protein, 60 aa, Artificial Sequence
  Synthetic
SMKEELDRLLKELRERNKEIEDRAEELLRRSTDSLRKVKEKLDKLLEESTRILRKVEKEN

SEQ ID NO: 16536 - protein, 55 aa, Artificial Sequence
  Synthetic
EKVLKDIKRVIDEDEERLKRVLDDYERRVRELEDKVKKILDRYKTEVDKLRERAR

SEQ ID NO: 16537 - protein, 60 aa, Artificial Sequence
  Synthetic
SVEEEIRDLLRKLREIVDRVRRRLKEILEESTRRLEEVTRRIDESNEDLKRAVDDVKRRN

SEQ ID NO: 16538 - protein, 55 aa, Artificial Sequence
  Synthetic
KEVLRKLEEEIEKLRKEAKKILDEYRKLVEDLADKIKKILDRNRKLIEELVREVK

SEQ ID NO: 16539 - protein, 60 aa, Artificial Sequence
  Synthetic
SESEKTLKDLDEISKRYEKKVREMLERHKRLSEETKKRDDEALERLTRLVKELKDVARRG

SEQ ID NO: 16540 - protein, 59 aa, Artificial Sequence
  Synthetic
EDVKRRLDELLERHKRISEEVEKRNEDLLREHEEISRRSKKRIDDLLREAERILDEMRR

SEQ ID NO: 16541 - protein, 60 aa, Artificial Sequence
  Synthetic
SESEKVLRDLEKISEDTARRLEDELRKHKEIVDRIKEEDDEMLDRLRKLVETLKRLAERG

SEQ ID NO: 16542 - protein, 59 aa, Artificial Sequence
  Synthetic
EEVKRRLEELLKRHKEESDRARERNERLLKEVRDLSEESRERIERLLRELEERVREDER

SEQ ID NO: 16543 - protein, 60 aa, Artificial Sequence
  Synthetic
SRSEKSLKELREISERTRKRLEDKLDRHEKESKKVEDKAREVLKELEDLVRTLEEVARRG

SEQ ID NO: 16544 - protein, 59 aa, Artificial Sequence
  Synthetic
EEVRRRLRELLERHKRISDEARKRNEDLLREHEKRSRDIEKRLDDLLKEAEDRLRERKR

SEQ ID NO: 16545 - protein, 59 aa, Artificial Sequence
  Synthetic
SDEEELRRLIEEHEKILKEIEDRVRESSKRNKEILKRLEDEVRKLLETVKDRLEKARER

SEQ ID NO: 16546 - protein, 59 aa, Artificial Sequence
  Synthetic
SETAKRVLDELKERSERSMEDLKRLLKEHKERVDEMRRRAEELLKRLREVIRKVEEEIR

SEQ ID NO: 16547 - protein, 56 aa, Artificial Sequence
  Synthetic
SRDEEVKRLKKEHEDILEEIRKRVDESSKRNEKILREIKERVKRSSDDLKRLLEEL

SEQ ID NO: 16548 - protein, 59 aa, Artificial Sequence
  Synthetic
EEDVERVLREFEEVSRRSEETLRRLLEKHKELVERAARELETLLKEHRERVRKIEEEAK

SEQ ID NO: 16549 - protein, 60 aa, Artificial Sequence
  Synthetic
SSKERLEKLLRELEEDLRRAHEEHKRLIKRLREILDEIRKRVEKLNRDLDRVLERAREEG

SEQ ID NO: 16550 - protein, 55 aa, Artificial Sequence
  Synthetic
EELLKEVKEMIKRLRKKIKKSLDDVRRVIRELEEHARRDLRKLEKDLKDIEDKLR

SEQ ID NO: 16551 - protein, 60 aa, Artificial Sequence
  Synthetic
DSEERLKELERRLRELLKRVSERSKKLNKEHEEINRKAEEEVERLNRELERDLEDAARKG

SEQ ID NO: 16552 - protein, 55 aa, Artificial Sequence
  Synthetic
DELLREAEKMLKELEELVREDEKRLKDISKEVEEHYRKDLEDVKRAIKEIRDRLK

SEQ ID NO: 16553 - protein, 60 aa, Artificial Sequence
  Synthetic
DSERRLEKLLRELKELLKRVEESLRRLNEEHKRINDEARERSKRLNEELEETLRKAREDG

SEQ ID NO: 16554 - protein, 55 aa, Artificial Sequence
  Synthetic
EELLKEIKDRLKELAEHVERDERRLKRISEEAEKRYREDVREVKEMIEEIERELR

SEQ ID NO: 16555 - protein, 60 aa, Artificial Sequence
  Synthetic
ESEERLRDLIRKIRELLEEIERRLRDLNRRLREILKRIEEESEKLNRELKKILDEARERG

SEQ ID NO: 16556 - protein, 55 aa, Artificial Sequence
  Synthetic
EELLKEVRERLRELEEHARRDLETLKRMIRKLEEEAKKDLRELEKMIKDIRDKLK

SEQ ID NO: 16557 - protein, 60 aa, Artificial Sequence
  Synthetic
SLEEALRKLEEELERLNEEAKRRIDRLIEELRRLNEEARKKIERLIEETRELLKRLAEEG

SEQ ID NO: 16558 - protein, 55 aa, Artificial Sequence
  Synthetic
REILERAKELLKKLEREYRELLKKIEKVVRDLEEKYRELLKRHRKETERLDREVR

SEQ ID NO: 16559 - protein, 60 aa, Artificial Sequence
  Synthetic
ELAERVKRLIEEHRKTDKEVEDRIRKLIEDHDRENRKVEDEIRKLIKELREIVDRARKEG

SEQ ID NO: 16560 - protein, 55 aa, Artificial Sequence
  Synthetic
EEILDKIREVHRRVRKKARDLAERIKDAHRKLRKKVEELLRRIKEMIRRLEEELR

SEQ ID NO: 16561 - protein, 60 aa, Artificial Sequence
  Synthetic
SDRERLTRLIEELRKLLEKWEREVKKINDEIRRTVEKVEEDSKKSIEDLRRLLKEMEDRG

SEQ ID NO: 16562 - protein, 56 aa, Artificial Sequence
  Synthetic
TKDLERRIEDVIRRLKKLADDDLRDLRRFLKELKERADKLRKEDEEALKELRDRAE

SEQ ID NO: 16563 - protein, 60 aa, Artificial Sequence
  Synthetic
SREDDIRRLIEEARKLVEDAERRSKKSIDDIRRLVKEWEEEVKRINDDLKRLIDEARKRG

SEQ ID NO: 16564 - protein, 56 aa, Artificial Sequence
  Synthetic
DKDLKERIKKLLDELRRLVEELEKRDKEMLDRIKKLADDDRRELERILKKLEDDLR

SEQ ID NO: 16565 - protein, 60 aa, Artificial Sequence
  Synthetic
SAEDTIRTLLERHDDLDREVEERSKESIRELRRLIKEWRERVRKLNEELKRLLDDLRRKG

SEQ ID NO: 16566 - protein, 56 aa, Artificial Sequence
  Synthetic
KEELIEEIKEMNKKAKKSVDELEKKDRDVLDEIRKMAKEDLDRLRKALEDLERDAR

SEQ ID NO: 16567 - protein, 60 aa, Artificial Sequence
  Synthetic
SSEDRVRDIERRHKEEDDRVEEESRRSTREIRELLRTAKERSDDSIRKLRKLIDDLRKEG

SEQ ID NO: 16568 - protein, 56 aa, Artificial Sequence
  Synthetic
TEELEKELEDVNRDVDRSAKRLKERDEEALKTLEDEIRKLEEKDKKVLEDLEREAR

SEQ ID NO: 16569 - protein, 57 aa, Artificial Sequence
  Synthetic
SDKEEVDKLKERNERVLEEVRRRLEKLEKDNKDTLKKIRDDSERLREKIKRVRDREQ

SEQ ID NO: 16570 - protein, 59 aa, Artificial Sequence
  Synthetic
REFVEKALREYEELLKRSRETLEELLRRYKKLLDESRKTAKEDLDRSEEIIKKLADESK

SEQ ID NO: 16571 - protein, 57 aa, Artificial Sequence
  Synthetic
SDEEEVKKLHDENKKVNDEMREESKKLHDENDRVNKEVKERAKKVSKELEDMLRREQ

SEQ ID NO: 16572 - protein, 59 aa, Artificial Sequence
  Synthetic
EETVRRLLEKVREEIRRSKKRADDDLKTTKELIEKSEREVDRLLEEIKKIIEELERRAR

SEQ ID NO: 16573 - protein, 56 aa, Artificial Sequence
  Synthetic
SELEKVLREVEENLREVKRENEEKLRRNEENIKRLEEEDRRRLEEIEKMIEEIERA

SEQ ID NO: 16574 - protein, 58 aa, Artificial Sequence
  Synthetic
EVEEELRRLREEYEEVSRRSKEELEKSLRRLEEVHKESRKRLRDLLKKLDDVAREERK

SEQ ID NO: 16575 - protein, 56 aa, Artificial Sequence
  Synthetic
DELRELLKDIKRTTEDVEREVEEILRKVEEMIRRLEEEDRKVLEDIRRKIEDIRRA

SEQ ID NO: 16576 - protein, 58 aa, Artificial Sequence
  Synthetic
EVRKEMERLRREHEDVDKKVRDELRKLEEELRRVHRESEKALRDLLRKLREVAEREKT

SEQ ID NO: 16577 - protein, 56 aa, Artificial Sequence
  Synthetic
DELEDFLRKVERVIKELRDDDKRALDRIREVTKDVERKAREILKRVEEVIRRIEES

SEQ ID NO: 16578 - protein, 58 aa, Artificial Sequence
  Synthetic
EAEEALERLKTRLEKVHRDSKRALEKLRRDHEEVDKRITEELRKLMERLKRVVDELRR

SEQ ID NO: 16579 - protein, 59 aa, Artificial Sequence
  Synthetic
SADEALRELEERNRKVNEDVKREDERLHREDREVNKRIREEDKKLHKTLRDVLEELRKK

SEQ ID NO: 16580 - protein, 59 aa, Artificial Sequence
  Synthetic
ERRVEKLLRRYKKVLDEVKRELKESLDKAERVTRKSEDDARRSLEEIKKEIEEVRERIR

SEQ ID NO: 16581 - protein, 59 aa, Artificial Sequence
  Synthetic
RVDEELRKLVEDNKRKNEEVKKELKKLKEENERVNKEVRERDRKLHEKLRRVLEEVRRT

SEQ ID NO: 16582 - protein, 59 aa, Artificial Sequence
  Synthetic
EEEMRRLLEEYEELVRRVLKRLKEILEEYERLVRRVEEEVKKSLEDIERKIKEAKDRVD

SEQ ID NO: 16583 - protein, 59 aa, Artificial Sequence
  Synthetic
DVEEEVKKLKDKNRRINEEVKKRMRELEERNKELNKRIREEDERLHRELRKVLEEARKT

SEQ ID NO: 16584 - protein, 59 aa, Artificial Sequence
  Synthetic
REEVEKLLREYEERLERVRKRVEEILAKYKELLDRVEERARKSLKEIKETIEDARRRIK

SEQ ID NO: 16585 - protein, 59 aa, Artificial Sequence
  Synthetic
SMDEELDKLTRENEAVNERVEREARRLKEENRKVDEEVRRAVEELKERVRRVLEEVRRK

SEQ ID NO: 16586 - protein, 59 aa, Artificial Sequence
  Synthetic
EEDVRRLLEEYARLVREAEREVREILRKYEELVRKARKDAKKLLDDIERKIEKIKRDVD

SEQ ID NO: 16587 - protein, 59 aa, Artificial Sequence
  Synthetic
SMDEELKKLVKENEDLNRRVREEAERLRKENEKVDEDAEREDKRLHDKAERVLRELRRR

SEQ ID NO: 16588 - protein, 59 aa, Artificial Sequence
  Synthetic
ERTVTELLKEYRELVRRVEERVKKILKEYKEEVEEVKRRLEESLKDIERKIDEIRRRAT

SEQ ID NO: 16589 - protein, 59 aa, Artificial Sequence
  Synthetic
SMDEALEELTRRNEEVNKRIEEEDRKLHKRNKEVDDEVRKRDKDLHDELRRVLEDARRT

SEQ ID NO: 16590 - protein, 59 aa, Artificial Sequence
  Synthetic
EDEVEKLLREYKRRVEEVKKRAEDSLKRYEEEVKELEDEVRESLERIRRDIEDVKRRID

SEQ ID NO: 16591 - protein, 59 aa, Artificial Sequence
  Synthetic
SMDEAVEKLKKENKDIDEEVRRRLDELRKRNEEVNKKIKEDDDRLHKEAKEVLEDVRKT

SEQ ID NO: 16592 - protein, 59 aa, Artificial Sequence
  Synthetic
EDIVRKLLREYEKLLREVRERARRILEEYKRLVKEVRERAERSLEELKREIKKVRDRAK

SEQ ID NO: 16593 - protein, 60 aa, Artificial Sequence
  Synthetic
SEKEELLRKAKEVIDRIRKELEELLRRAREVNKDSRRTVEEVLRKAREVSERVRKASERG

SEQ ID NO: 16594 - protein, 55 aa, Artificial Sequence
  Synthetic
EELDDLRRRAEELLKRAEDEIRKLHEENKRSNEEAERAIRELAKRNKELDDKTRE

SEQ ID NO: 16595 - protein, 60 aa, Artificial Sequence
  Synthetic
KEKEDLIEKMKKVLEDIRKRLEELLKRARKVNEDSRKLVKEVLDKIKKVNEDVRKVATES

SEQ ID NO: 16596 - protein, 55 aa, Artificial Sequence
  Synthetic
EELTRLAREIEKLLEEARRRVEKLHEENKRSNEEAKERMERLRDHNRKLDDDTRK

SEQ ID NO: 16597 - protein, 60 aa, Artificial Sequence
  Synthetic
REREELIKKVRTVHKRSEEELRRHSEEVKKVNRDSRERVKEHLKRVKEVIKELEDVARES

SEQ ID NO: 16598 - protein, 55 aa, Artificial Sequence
  Synthetic
RELKELADRNKKLLEDIEREHKKLHEDNRRSNEDARRRHEELKREVEKLLDELRK

SEQ ID NO: 16599 - protein, 60 aa, Artificial Sequence
  Synthetic
SLEEEIKRLVKHHEELLREVRKRLKELEDHHRELDERHRRMLEELVREARKLIKDVKDDI

SEQ ID NO: 16600 - protein, 59 aa, Artificial Sequence
  Synthetic
EETVERILRTLKTTDERTTDTVREILRKIKRTNEESKETADRTVKRAKDLIREIRERVR

SEQ ID NO: 16601 - protein, 60 aa, Artificial Sequence
  Synthetic
SAREAIKEIKKHHKKLLEDVKETIDRIEEHHRKLDKDHRDELKKLLEEVRELLRDIRSRI

SEQ ID NO: 16602 - protein, 59 aa, Artificial Sequence
  Synthetic
ERTVEKILEELKDMNRATKRRVEEILRRLKKTNDESEKRARDTLTRIKELIEEVERRAR

SEQ ID NO: 16603 - protein, 58 aa, Artificial Sequence
  Synthetic
DESEELKKEAKEILDRLEKVLRELTDRNREMLKRIEKLIRENEKRLEDILREIAKRAS

SEQ ID NO: 16604 - protein, 59 aa, Artificial Sequence
  Synthetic
EEVEKELKRIKDELKRLVEKAERSLRESEERLRRLLEEAEKRNRKVEREIEKLLDDTRK

SEQ ID NO: 16605 - protein, 56 aa, Artificial Sequence
  Synthetic
SKEEKITRDAEEVLRRSEEIIRRLLRRLEEVLKDLERSARENKKRLDKILEDLAKL

SEQ ID NO: 16606 - protein, 56 aa, Artificial Sequence
  Synthetic
EKRVKRMEEELRRLHEEVRRRVEKVKRDMDRLNKKIKEDSRRVNEEIRKLLEDKTR

SEQ ID NO: 16607 - protein, 56 aa, Artificial Sequence
  Synthetic
SEEEKVRKELEEVLRRSDEDIERNRRRLEKVLDDLRRSAEENKRRLKEILDRLKDT

SEQ ID NO: 16608 - protein, 56 aa, Artificial Sequence
  Synthetic
EKEVRKVKDRLDKLHEKVKRISEEVNERIRRLNKRIKEISKRLNEELEELLRRRRT

SEQ ID NO: 16609 - protein, 56 aa, Artificial Sequence
  Synthetic
DELEKFKEDVKEVIKKLAETIKRLLDDVRRVLEKLRKLAEENKERLDRILDELRRL

SEQ ID NO: 16610 - protein, 56 aa, Artificial Sequence
  Synthetic
EKEVARLREEIKKLNERLKREVERLKRELEKLLRDIEKTSEDANRRLKELLDRTRK

SEQ ID NO: 16611 - protein, 56 aa, Artificial Sequence
  Synthetic
RREEELLERAEEVLEKLERIIEETERELKEVLDRLRKSIEDNLRRLKKVLKELKDN

SEQ ID NO: 16612 - protein, 56 aa, Artificial Sequence
  Synthetic
EKDLTEVKKRLRDLLKKMEDVLREVKKRLDDLNREMDDRSRKANEELRDLVRRKEK

SEQ ID NO: 16613 - protein, 61 aa, Artificial Sequence
  Synthetic
DVERKLREVEERHKDVLKKAKELLDKVEEDHKKSSKEVEDVLEEMRRRAEKLVRDAVRKKG

SEQ ID NO: 16614 - protein, 59 aa, Artificial Sequence
  Synthetic
DELARRIEEELEKLLRTLEELVTEIIKELEKLLKTHEDLLREVEKTLRRIIEELEKRDK

SEQ ID NO: 16615 - protein, 61 aa, Artificial Sequence
  Synthetic
SVEETLRTVEEEHRKSSKEAEELLEEVERRHEESSKRLEDTLREAEKEVRRLAEDVVRRRG

SEQ ID NO: 16616 - protein, 59 aa, Artificial Sequence
  Synthetic
KELVDEARRELKELLETHKETVKRVLDKLRDLLRTHEEKMKDVEETLRRLLERLKEETR

SEQ ID NO: 16617 - protein, 61 aa, Artificial Sequence
  Synthetic
KVEDSLREVKKRHKDKVDEVRKRLREAEEENKRLLDEVRRELERVEERIRRIVEEIVRKKG

SEQ ID NO: 16618 - protein, 59 aa, Artificial Sequence
  Synthetic
DEEARDIERRLRDLERTLEELVKEADERLKRSNEEDEERIRRVRKKLEELLRELEKRDE

SEQ ID NO: 16619 - protein, 58 aa, Artificial Sequence
  Synthetic
DEDRDLKRELDRLLREHEELVDRSTKRLEKLLRKHEREARESKKELEKLNDELREIAR

SEQ ID NO: 16620 - protein, 59 aa, Artificial Sequence
  Synthetic
EDVKRKLEEVRRRIEESVKRHRETVEEMRRRVDESVRRHERTVDELRRTHEELIERVRR

SEQ ID NO: 16621 - protein, 59 aa, Artificial Sequence
  Synthetic
KDEEKIIEDLKRLLRKHEKLVEESRERLKRLLETIRKIAKDIVERLKRLNEELREIAKR

SEQ ID NO: 16622 - protein, 59 aa, Artificial Sequence
  Synthetic
EEAREKIKRVVEELKESVERHERDVDRVRREAERLLEEVTRRIETVRRTHERLIEEIKK

SEQ ID NO: 16623 - protein, 59 aa, Artificial Sequence
  Synthetic
SEKDEIKRELEELLREHEKLAEESRRRAEELLRDIERRARESLTELRELNKKLREEARR

SEQ ID NO: 16624 - protein, 59 aa, Artificial Sequence
  Synthetic
EDVEREIRKVREDLKRSVDEHRKDLERIRRELEELLEKHHEDLRDVERTHRELLKEIKR

SEQ ID NO: 16625 - protein, 56 aa, Artificial Sequence
  Synthetic
DVEDELRRLHEENKDLLREAEEELERLHRENKKLLEDARRLLERLEEELERIERRL

SEQ ID NO: 16626 - protein, 59 aa, Artificial Sequence
  Synthetic
REEVEREVRKIEKLIRDSRERVRELIEKIERTLRDSERRVRELVKEVEKRLREIERKVE

SEQ ID NO: 16627 - protein, 56 aa, Artificial Sequence
  Synthetic
DVEKELKELHDKNEEILERARRLLERLHKENEEINKRVEEALRRLAEELRRLKEEL

SEQ ID NO: 16628 - protein, 59 aa, Artificial Sequence
  Synthetic
RREVKELIRKIDELLRRSKEEVDRLVKEVERLLRESKRRVEEVIEKLRKIIEELEREVR

SEQ ID NO: 16629 - protein, 56 aa, Artificial Sequence
  Synthetic
REVEEVIKDARRLLEELRKHSEDEVRKVEEEIKRLRDDNKRAVDDIERLLRELEEA

SEQ ID NO: 16630 - protein, 59 aa, Artificial Sequence
  Synthetic
RRAETKLEELRRRLDEILRTTEELLRRLKRELEKLSEESKARLDELKRKLDEILKETRR

SEQ ID NO: 16631 - protein, 57 aa, Artificial Sequence
  Synthetic
DEAREIVRELEKRIKDIEDRARKLIRELEKSLEDLKRRVEEMLREWEEESKELERRN

SEQ ID NO: 16632 - protein, 56 aa, Artificial Sequence
  Synthetic
REKVKEIKKRLDELLKRIEDELRRIREEDKRIHDEVEKELRKLERRDEELLKRLED

SEQ ID NO: 16633 - protein, 57 aa, Artificial Sequence
  Synthetic
SEAEDIVRKIEELLKRHHDRVEEMLRRWEELTRRHSEKAEKIVREVEKLIDELREAK

SEQ ID NO: 16634 - protein, 56 aa, Artificial Sequence
  Synthetic
EEEVKRLEKEIRDNLREMEERLKELEKRDKDNLDRIRELHRRLREELEKLLEDARR

SEQ ID NO: 16635 - protein, 59 aa, Artificial Sequence
  Synthetic
SMDELLKRLEEEDRKLNEESKETLERLRKHDEDLNRKNREKLKELKDRVDRVLEDAKKR

SEQ ID NO: 16636 - protein, 59 aa, Artificial Sequence
  Synthetic
EDDVRREVEDVKRRIEDSREKLRKLTEKWKKLNRESDEKVKKHVEDVEREIEKVRKEAE

SEQ ID NO: 16637 - protein, 59 aa, Artificial Sequence
  Synthetic
SSEEELKKLSDKARRLNDENRKILERLKEHDERLNKRNKEELKRLREDVERLLEDARRR

SEQ ID NO: 16638 - protein, 59 aa, Artificial Sequence
  Synthetic
EEDVKRKLDTIDKVIRDVRRRIEEHVRRWEELNRRSKKEIEDHVKTVEDVIKEAKDRID

SEQ ID NO: 16639 - protein, 61 aa, Artificial Sequence
  Synthetic
DEDEEVDREVREMIKRLEEHVKRDEDTLEEMLKRLRDHVERDRRRLEELLKDLERLVRERG

SEQ ID NO: 16640 - protein, 55 aa, Artificial Sequence
  Synthetic
EELKRLDREAEELLRRVDRLNEEVEKKLRKLLEEVRRENKRLEEEAKRLLDKAEE

SEQ ID NO: 16641 - protein, 61 aa, Artificial Sequence
  Synthetic
DEDEEVRKKVEEEIKRLKKEVEEDRRDVERLDEESKDKVRRDEKKVKDLLKELEDLVRRDG

SEQ ID NO: 16642 - protein, 55 aa, Artificial Sequence
  Synthetic
EELKRLEEEAKDLLRDVERLNRELHKRNREILEEATRRNEELKRELKELLDRARK

SEQ ID NO: 16643 - protein, 61 aa, Artificial Sequence
  Synthetic
SEEERVKEELDKAIKTLEKLVKDDLKKVADALRRLREHVEKDLRDLEEVLRELKELVDKTG

SEQ ID NO: 16644 - protein, 55 aa, Artificial Sequence
  Synthetic
EELKRAERELDRLLTEADRRNDELRREAERLLEKVNEDNRTVKERARRLLDDARR

SEQ ID NO: 16645 - protein, 61 aa, Artificial Sequence
  Synthetic
REDEEIVKEMERLLERLEELSRRIMEEVKRIDKESEDHIKRDEDKLREELERLRDLVRREG

SEQ ID NO: 16646 - protein, 55 aa, Artificial Sequence
  Synthetic
EELKELEERAKRLLERHERTNEELHRRNEEILRKANELNEEVRRRLDKLLDEVRT

SEQ ID NO: 16647 - protein, 61 aa, Artificial Sequence
  Synthetic
DREREVRRRVKEALDEIKRHVDRDRKKAEDMDRRSRELSDELRRRVDDLIKRLKELVDRDG

SEQ ID NO: 16648 - protein, 55 aa, Artificial Sequence
  Synthetic
EELDELRKELDKLLTEVDETNKKLHEDNKRILDDHDRINEELRRRMEALLREATR

SEQ ID NO: 16649 - protein, 61 aa, Artificial Sequence
  Synthetic
SEEEDMVRRVREMIKRLRDHVRRDKDKLDKEDKRSADHVDRDRKRLEDLLKELRDLVRDTG

SEQ ID NO: 16650 - protein, 55 aa, Artificial Sequence
  Synthetic
EDLKRLEKELRDLLDEVNKENEKVHRRNREILKRADELNEEAERRLRELLREAEK

SEQ ID NO: 16651 - protein, 61 aa, Artificial Sequence
  Synthetic
KEDEEVKDKVEKLIRKLEKESRDISEEVKRLDEESKKLARDLTEEVDRVIKRLRELVERDG

SEQ ID NO: 16652 - protein, 55 aa, Artificial Sequence
  Synthetic
EELKKLEKKLEELLERHRRDNKRLHEENRRILEELRRRIKELKERLRRLKEEARK

SEQ ID NO: 16653 - protein, 60 aa, Artificial Sequence
  Synthetic
ETDERLDELRRRLEKSLKDHKKLLDEVRKKAEELLDRNARLLEELKRELDELLKKVEEDN

SEQ ID NO: 16654 - protein, 59 aa, Artificial Sequence
  Synthetic
REVVEELLRRAEEEIRRHRKKVKESLDRLEDEIRKVEEDSRRSEKKVRKLIEDVKRRVK

SEQ ID NO: 16655 - protein, 59 aa, Artificial Sequence
  Synthetic
STEETLEKLDRDLKDSSRRNEELLKRVDDRLRESSKENRKILKELSDRLRDLLEKVKKD

SEQ ID NO: 16656 - protein, 59 aa, Artificial Sequence
  Synthetic
DKVVRELVKRAEDEIRDHKRLSKESLDRLDEEIKRHRELSKESMEEADRLIKTVKERVR

SEQ ID NO: 16657 - protein, 59 aa, Artificial Sequence
  Synthetic
ELDDLLREVEKRVRDLNRRNEEELRRVEDRMRESLRKSEEDLRRVEERLKKTLTRVKTE

SEQ ID NO: 16658 - protein, 59 aa, Artificial Sequence
  Synthetic
RRSAKKILDDLERTLEDVERRSRESVRRLREEIETHRKLVEELKKRLDDLEEEVKERVR

SEQ ID NO: 16659 - protein, 56 aa, Artificial Sequence
  Synthetic
SSDEILKRVKEELDRLLEENKRLLEEARKRLEDLIRKNREDLKRVEEKMRRLLEET

SEQ ID NO: 16660 - protein, 59 aa, Artificial Sequence
  Synthetic
EEVVRRLAEELRRLIEEVKRKIEESERRLKETLDRYRKLVEDSLRKLEETIRRVREESR

SEQ ID NO: 16661 - protein, 56 aa, Artificial Sequence
  Synthetic
SSEELLRKVKEDAKKIIKENEELLRKVDKDMRDIIKENRDLLEELTERVKRLLDRT

SEQ ID NO: 16662 - protein, 59 aa, Artificial Sequence
  Synthetic
EEVVKRILEELKKLLDEAERLSRESLKELEKMLREYRESVERSLRKVDDTLRRVEEKSR

SEQ ID NO: 16663 - protein, 59 aa, Artificial Sequence
  Synthetic
DDKRLLEEIRRRADELIKENEELLRRLEKLNEDLERRNKELNERLAERVKRLEEDVRRR

SEQ ID NO: 16664 - protein, 59 aa, Artificial Sequence
  Synthetic
RRIVEEEVDRVRKTIEELKRKSEDLVREHEEIVRDLERKSRELVKKVEKLLRDVRERAR

SEQ ID NO: 16665 - protein, 60 aa, Artificial Sequence
  Synthetic
SVDEMLKEIRDRAKKVDEDNRRLVERLEERNRELDERNKRLLDDIRRKVEEVMRIADERV

SEQ ID NO: 16666 - protein, 55 aa, Artificial Sequence
  Synthetic
KELVDRVRKLLEEVRRKSEKLVREHEDLVRRNEEHSRRLVEEADRILERAKRELD

SEQ ID NO: 16667 - protein, 60 aa, Artificial Sequence
  Synthetic
SVEEMLRRLRERDEEINDRLRRLAEDLKRENKRLDDENKKLVDEIREDVERLKEKLDRKL

SEQ ID NO: 16668 - protein, 55 aa, Artificial Sequence
  Synthetic
SELLKRWEELLRRLEKRIRDLVEDHKRLVEENERHSRKLVEEVKKALTDAEKKVE

SEQ ID NO: 16669 - protein, 60 aa, Artificial Sequence
  Synthetic
SVEELLEDIRRRVEKVKEDNKRMLEDLERKNRELKKEADDLAREIKKRVRDLEKELDEKL

SEQ ID NO: 16670 - protein, 55 aa, Artificial Sequence
  Synthetic
SKLVEEVRKLLEEARRESEELLRRHKKLVDDNRRHIRKLFEDVKKILDDARKEVE

SEQ ID NO: 16671 - protein, 61 aa, Artificial Sequence
  Synthetic
SEEEEIVKDVERVIRELEERHKDLVRRAREDIKRLREHIRRSIRALDEDIKRIEEKIRRDG

SEQ ID NO: 16672 - protein, 56 aa, Artificial Sequence
  Synthetic
EDLVRDLERKNKRVIDESRRLLEELRRRYEELLREYRELLEDLRRKYKRIEDEAKR

SEQ ID NO: 16673 - protein, 61 aa, Artificial Sequence
  Synthetic
SEKEEIVKTVKTVIDRLEEEHRKILEDLRDDIRRADEYIKRSIDEVEEDLRRIEETVRRDG

SEQ ID NO: 16674 - protein, 56 aa, Artificial Sequence
  Synthetic
ERLVRELEKENEKLKRRSERMLEELEKEYRRLLKKYEDLLRELERKYEEIKDKLRK

SEQ ID NO: 16675 - protein, 61 aa, Artificial Sequence
  Synthetic
SEDEDIVRKAKEDIERLKREVEETIKRVEDDARKVEKEVRDIVERTRKEIKKLEDEVRERG

SEQ ID NO: 16676 - protein, 56 aa, Artificial Sequence
  Synthetic
EKLVEELRRELEKLKKEIDDLLRDLEKKYDDIRKKIRKLSEELKKLLEELKRKLDE

SEQ ID NO: 16677 - protein, 61 aa, Artificial Sequence
  Synthetic
SELEKIVEEVRRDIKRVRERVEEIIRKTDEMIRRLEEHIKRSIERVRKDAEDIERTVRRDG

SEQ ID NO: 16678 - protein, 56 aa, Artificial Sequence
  Synthetic
KDLLDELRRRYEELEERIRRLSRELEEKLKKLRKRYEDLLEELEREYRRIAEEARR

SEQ ID NO: 16679 - protein, 61 aa, Artificial Sequence
  Synthetic
SEEEKIVEEVKRDIKKVDDEVKDIIRRTDKAIKDLRREHKELIDRTRKAIEELEDEVRKRG

SEQ ID NO: 16680 - protein, 56 aa, Artificial Sequence
  Synthetic
EDLVDELRKLYDTIREKIKRLSDRLREKNEKLKKESDDLSRRLRKELEKLEREVRR

SEQ ID NO: 16681 - protein, 59 aa, Artificial Sequence
  Synthetic
SKEELLKEIRDELRKLKKKHDDLLEEIKREYDRLREKVRKDLEDIERKLRKLEEDVERK

SEQ ID NO: 16682 - protein, 59 aa, Artificial Sequence
  Synthetic
EEEVKRVVERVKELIKRLEDNIREAIRKLREDIKRLEEEVEKARKDVEDFLRELRKKVK

SEQ ID NO: 16683 - protein, 59 aa, Artificial Sequence
  Synthetic
SSDELAEELKREYDRNKEEHKKLLEELKKEYKRLLDEHRDLLRRIKERLDRLLRRIEEK

SEQ ID NO: 16684 - protein, 59 aa, Artificial Sequence
  Synthetic
EELVERVIRDVRKHIEDNTENIRRDIERVRKDIETLEENVKDAAKKVEDILKTLEDEVK

SEQ ID NO: 16685 - protein, 59 aa, Artificial Sequence
  Synthetic
DKERLAEELRRLYERNKREHEKLLKKIEDDLRKLEEDHERLLREIEEAAERLRREIERK

SEQ ID NO: 16686 - protein, 59 aa, Artificial Sequence
  Synthetic
EELVKRVVDRVRRHIEENTKNIEEAIKRVEDVIRELRKNIEEAIKRVREVLKRLKDEIK

SEQ ID NO: 16687 - protein, 59 aa, Artificial Sequence
  Synthetic
SEDELLDRLREKYERNKERHKRLLDELRKRYEDLKREHEKLLRDIEEELKKLEDKIRRK

SEQ ID NO: 16688 - protein, 59 aa, Artificial Sequence
  Synthetic
EDLVRKAIEDVDRHIKENTKNIEDTIRKVKKNIEDLKRNVEEAIKKVKEVLREIEERTR

SEQ ID NO: 16689 - protein, 59 aa, Artificial Sequence
  Synthetic
SKEELLKRLKERNERLNEDSERLAREIKRRLEELRKEHRRLLKEIEERLKELEEDIRRK

SEQ ID NO: 16690 - protein, 59 aa, Artificial Sequence
  Synthetic
EEDVKRVIRRWEELLKELEKDNRRVVKEAKELIDRLERNIRERIKEVRDALREIRKKVK

SEQ ID NO: 16691 - protein, 59 aa, Artificial Sequence
  Synthetic
STDEKLKELEKRNRDLNEESRKLAEEIRKRYEDLKKEHEDLLREIEKRLRDLMREVERK

SEQ ID NO: 16692 - protein, 59 aa, Artificial Sequence
  Synthetic
EKSVDDVIRRWEELLEELRRRNEEAVRRMERNIDELRRNVRETIDRVRKLLEEIKRKVD

SEQ ID NO: 16693 - protein, 60 aa, Artificial Sequence
  Synthetic
SEAERVVEELERLLKKNRDDNERVIRRLEELLDRLREKNERAIEELRKLLDELKKVVDRG

SEQ ID NO: 16694 - protein, 56 aa, Artificial Sequence
  Synthetic
RELLREIEERLKTLSEESKRLIDRIREELKRLTKESEDLLKDIERLLREVKERART

SEQ ID NO: 16695 - protein, 60 aa, Artificial Sequence
  Synthetic
DEMEDLRRDVERIHEESRKLSEDSVRTAEKIHRESEKLIDDLRRKVEKILKEVEDVVRRG

SEQ ID NO: 16696 - protein, 56 aa, Artificial Sequence
  Synthetic
EEELKKLEDRSRKLLEENKRLNEDLDRRSEELKARLKDILRRIDERLRDLEREADR

SEQ ID NO: 16697 - protein, 60 aa, Artificial Sequence
  Synthetic
DEVEELKRRAEEILRKYDEDSKRIVEEAERIVRTSAEKIERLRKKAEDILREASKVVDDG

SEQ ID NO: 16698 - protein, 56 aa, Artificial Sequence
  Synthetic
ERDLEKIETDVERLERKSKKLLEDLREKSERLKKRLEDILKRIKEEVERLKRKVEK

SEQ ID NO: 16699 - protein, 59 aa, Artificial Sequence
  Synthetic
DEMEELKKEVEEILKEYEKRSRDLFKELKEILRRSKELSEDSKREADKILRDAEKVVAD

SEQ ID NO: 16700 - protein, 56 aa, Artificial Sequence
  Synthetic
EDDLRRIEEKVKKLEKESRELLKRIKDESEELKRDNKRLNDEVREELEKLKERVRK

SEQ ID NO: 16701 - protein, 60 aa, Artificial Sequence
  Synthetic
DEMDELRREVKEILKTTEELIKRLEDKVRDILRRYKEVSDDIVRKAEDILRKAEDILRRG

SEQ ID NO: 16702 - protein, 56 aa, Artificial Sequence
  Synthetic
ERELEEIKKESEDLERRLKKVLERIEREVRRLEEETKELLKRIAEEVERLIREAEK

SEQ ID NO: 16703 - protein, 60 aa, Artificial Sequence
  Synthetic
KEAEDLVREVERILEDYDRVVKELKDDADRILEESRRLIEELKKKAEDILRRVRKVVEDG

SEQ ID NO: 16704 - protein, 56 aa, Artificial Sequence
  Synthetic
EELLERIKDRLRKLHEKSKKLLTDIKRESRRLEKRLEDILKRIKEEADKLKEEADR

SEQ ID NO: 16705 - protein, 59 aa, Artificial Sequence
  Synthetic
REEELERRVREESEELNRRLAEVHKRLRKKSKELNDRHKELDDRIRREADRLRKDIRRQ

SEQ ID NO: 16706 - protein, 55 aa, Artificial Sequence
  Synthetic
DEVLKELKEMHDRLREHVKRDSERAERMHEELKRLSDELERRVREALKRLKEKVR

SEQ ID NO: 16707 - protein, 59 aa, Artificial Sequence
  Synthetic
KKEEVRKRIEEELRRLKKDHRRLDEEIKRKLKKLDEEIKEVHERLKKAARDLEDEARRN

SEQ ID NO: 16708 - protein, 55 aa, Artificial Sequence
  Synthetic
KEVEKDVEDLLKELEDDSRRLEEEVERLIERVKRHVERDERRVREMLREIKEKIK

SEQ ID NO: 16709 - protein, 59 aa, Artificial Sequence
  Synthetic
SKEDLDRELRRLSEELNREHKELDERIRRELEKLRTRIDKVHEDIRREMKRLEDEVRKR

SEQ ID NO: 16710 - protein, 55 aa, Artificial Sequence
  Synthetic
EEVFEDAERLHRELKKKSRDLEERVKKLLEEIEDHVRRDETRVRKVLRDIEEDIR

SEQ ID NO: 16711 - protein, 59 aa, Artificial Sequence
  Synthetic
SKEDMLREAEERSRRLNEDHKRLDDELRKESEKLNRRHRDLDEKIDRELRRLKKDIRRR

SEQ ID NO: 16712 - protein, 55 aa, Artificial Sequence
  Synthetic
RELLERLRKVHEDLKKKSEDLKRTAEKLHRELEKESRDLVRDVERALDELRRKVE

SEQ ID NO: 16713 - protein, 60 aa, Artificial Sequence
  Synthetic
SSEELLRDIERRLEEMNRDTERVVEEIRRRLEELRKRHKETIDKIREELKKVEDLVRRRG

SEQ ID NO: 16714 - protein, 55 aa, Artificial Sequence
  Synthetic
EDVLRRAKRLIEKYKEDTKRIKEKLEKVIEDLRKNIEDFEEDVRRVLEELKKRIK

SEQ ID NO: 16715 - protein, 60 aa, Artificial Sequence
  Synthetic
SSRELLERIKEELKELEDRHRDLLRRIEEKLERLNRRTREVLERIKRKLDELKKRVEEAG

SEQ ID NO: 16716 - protein, 55 aa, Artificial Sequence
  Synthetic
EDLLREVKELIERLRENIKRAKDKVEELIKKYKRDTDEAKKEVDEEIKRLKEEVD

SEQ ID NO: 16717 - protein, 60 aa, Artificial Sequence
  Synthetic
DSERLVREIRERLKKLEKEHRELLEEIKDRLRRLNEESKKLLDDIKRRLEELRDRIRRAG

SEQ ID NO: 16718 - protein, 55 aa, Artificial Sequence
  Synthetic
EDVLRDLEKLIEDLKRNIERARAKVEKLIKEYEDKLEKIVRDAEELIKDLDRKVK

SEQ ID NO: 16719 - protein, 59 aa, Artificial Sequence
  Synthetic
SSEEILRKIEEELERLEREVRKIHRDNERKSEELNRRSKKILDDIRRELDRLKKEAEEK

SEQ ID NO: 16720 - protein, 55 aa, Artificial Sequence
  Synthetic
KEVVKEMRRALEEIKKEIEKVRKELEKRNREYRKRSEEVREEAERKLEEIKRRTD

SEQ ID NO: 16721 - protein, 59 aa, Artificial Sequence
  Synthetic
RSEEILREIRDRLRKLNEESEKVHEENERRSRELNERSREILKRIDEELKRLKKEVDDK

SEQ ID NO: 16722 - protein, 53 aa, Artificial Sequence
  Synthetic
VVRDLKKKLERYKRETDRVRKELRDLNKKYEDRSREIKRELERLLRDIKRRID

SEQ ID NO: 16723 - protein, 59 aa, Artificial Sequence
  Synthetic
SLEEVIKTVRKLLEEVERRLREVVERAERMLEEVRRRTREVSEEAREMLKDVEKALRDK

SEQ ID NO: 16724 - protein, 59 aa, Artificial Sequence
  Synthetic
DRIVEKLLRDAERIVKRLRELIEKLREEVEKIVDENRKTVEELRRRNEEIVRRLRREIE

SEQ ID NO: 16725 - protein, 60 aa, Artificial Sequence
  Synthetic
DVKEVLDDAERKLREVLKLIEDSLKKLKELSDEVIERIARSLEKLEKLIRDVDEELKRKV

SEQ ID NO: 16726 - protein, 59 aa, Artificial Sequence
  Synthetic
KEVVKEIKERVDKVVDEARKLVEESERSIRELVERSKKVVEESERSIEELRRELKETVK

SEQ ID NO: 16727 - protein, 60 aa, Artificial Sequence
  Synthetic
DLEEVRERARRLLRKLEEDLERVHKEMEELLRELEERIKASLERLDELLKRLADKLRRDV

SEQ ID NO: 16728 - protein, 59 aa, Artificial Sequence
  Synthetic
KEVVKEIEDRVRKVAEKVREVIERNRKLVRDVLDKIRRMLKESERSVEEVLKRLDDELK

SEQ ID NO: 16729 - protein, 60 aa, Artificial Sequence
  Synthetic
SLDEVVKRLEDLLREVEEKSKESSKRMEDLNREVNERLRRSSERLKRLNDEVKKRLEDAG

SEQ ID NO: 16730 - protein, 56 aa, Artificial Sequence
  Synthetic
VEEIKKLADKVVTELEKLVEDDRRLAEESFERARKIVEEDERLARESVDRARRLVD

SEQ ID NO: 16731 - protein, 59 aa, Artificial Sequence
  Synthetic
KLDEVIEEIRKLLRRMEEELRRSVEEIDKLLREVRELLRESSEKVKELLRRVTEELKKR

SEQ ID NO: 16732 - protein, 58 aa, Artificial Sequence
  Synthetic
KLVEDLKRRAEEVIRELREIVKRNTEIAREVVERAKRIVEKNEKLLKDVVEEAKKIVK

SEQ ID NO: 16733 - protein, 56 aa, Artificial Sequence
  Synthetic
SELEKAKEDVDRLLEDVNRVSEEVEDRVRKLLADSDRVLEEVERRVREVLKRLKDA

SEQ ID NO: 16734 - protein, 56 aa, Artificial Sequence
  Synthetic
VKTVADELRKVVKELLEINRRSLEELTKLVDESRRVNEKVMEELKKLVDDLRRRIE

SEQ ID NO: 16735 - protein, 58 aa, Artificial Sequence
  Synthetic
SEIEKVKEVVREVIERSRKLLKEVRDTVEKVIDESRKLSDTVRRRVEDAIRDVLERRG

SEQ ID NO: 16736 - protein, 59 aa, Artificial Sequence
  Synthetic
REEVKKVIEDLTREAKRSLERNREVVKELKKLADDLKDLNKKSVDRLDDLVRRLKERTE

SEQ ID NO: 16737 - protein, 60 aa, Artificial Sequence
  Synthetic
KRAEDVLEKLREDAKRVLKRNRDSVKEAEDLVRKSLRTSEEVVKTLRTELKKLLDELDRV

SEQ ID NO: 16738 - protein, 59 aa, Artificial Sequence
  Synthetic
EKVLRDIEREVRKIIKELEDMDDELRRILEEVIERSRRVNERLKELLKEADDRLREKLR

SEQ ID NO: 16739 - protein, 59 aa, Artificial Sequence
  Synthetic
DAAEELLRLVEDVARELKRLVDELLKENRETVERLKKVVKRSEEINREVVRTLRELVAN

SEQ ID NO: 16740 - protein, 58 aa, Artificial Sequence
  Synthetic
EKIKEVRRSIEEARRRVEEALREVNEASKEAERTVREALKRSREAVEKAVRDVTEAAR

SEQ ID NO: 16741 - protein, 56 aa, Artificial Sequence
  Synthetic
KELEDVLRESEKTAEELLRRVKKSIDRTRDVVRRLLEEIRKSIEETKRVADEAKRE

SEQ ID NO: 16742 - protein, 58 aa, Artificial Sequence
  Synthetic
DLVRRLERISEEVRRRVEKLVREDRKILEDVARALRELVKEDEEILRRVVKDLRDKTR

SEQ ID NO: 16743 - protein, 59 aa, Artificial Sequence
  Synthetic
DEDKKVVRKVERIIKRVKELHDKSVRDSEEVVREVLKRHKESVEKIKEIVRRIVEIAAR

SEQ ID NO: 16744 - protein, 55 aa, Artificial Sequence
  Synthetic
EELKEVIRRVEKLSEDVKRENEKSNDEVRKLSEDAIRENEEVLRRARKLVDDLRR

SEQ ID NO: 16745 - protein, 59 aa, Artificial Sequence
  Synthetic
DEEKEVVKKLRDIIREVERLHTESVRKVEEIVRRVLRLHKETVRELKEIVKRIVDIARN

SEQ ID NO: 16746 - protein, 55 aa, Artificial Sequence
  Synthetic
RELEKVAKEVEDRSKELLDRNEEVLDRVRKLSEDVLRENREVIERVREEVKKESK

SEQ ID NO: 16747 - protein, 59 aa, Artificial Sequence
  Synthetic
SEADKVVAELEKIVKDVVDAHKDSVRKLREIVRRAVERLRKDVDDTRRVVKEIVDIARS

SEQ ID NO: 16748 - protein, 59 aa, Artificial Sequence
  Synthetic
ERVRRKLEEVVKKVRDLSRRATEEVEEVIKEVRELVRRLKEENKRVVDEVRKRVEDTRK

SEQ ID NO: 16749 - protein, 60 aa, Artificial Sequence
  Synthetic
KSMEDVVRKLDELVKTDKEIADRVVKELKDIVKRVEELVEDIVTKSRASVERVRDVVTRG

SEQ ID NO: 16750 - protein, 59 aa, Artificial Sequence
  Synthetic
REAKELLDRLKRRLEKSTEEVKKKLETVLRELEEVIKRVKEELERVNRELRKVIEDAKK

SEQ ID NO: 16751 - protein, 59 aa, Artificial Sequence
  Synthetic
ELEKLIRDVVRENEESAKEAHRRIKEVVRTSEDLVREVRERVRRIVESSKRVVEEVRKK

SEQ ID NO: 16752 - protein, 56 aa, Artificial Sequence
  Synthetic
MEKLLRDLKKLIEDNERVVRELKKNLDDDSERVKRVADELLKNLKKDTKKVKDTAK

SEQ ID NO: 16753 - protein, 59 aa, Artificial Sequence
  Synthetic
DEAEDVVKRADDIVKRNRELLERVVRDLERIVRKNKDIVRKVVDEAKKLVKTVEDLSRQ

SEQ ID NO: 16754 - protein, 59 aa, Artificial Sequence
  Synthetic
KEVEDLLRRVEEKLRKSVKEVEELLDTVRRRLEDSSRDVKRLLKEVLDRLEDVLDKEEK

SEQ ID NO: 16755 - protein, 59 aa, Artificial Sequence
  Synthetic
SAVEEADKEVRRILKKNTDLVRRVVEEAKKILDRNEKRVREVFKELTRLLDELRKLIEE

SEQ ID NO: 16756 - protein, 59 aa, Artificial Sequence
  Synthetic
EEVERLLRELERRLEDSVRKARELLKDIERRLRESIKRSEELLRDVERRLKELEERLEE

SEQ ID NO: 16757 - protein, 60 aa, Artificial Sequence
  Synthetic
DVEEELKRVVEKLRDVERKVRELNKRVTDKNEDVVRTVRELNERVTRENRRVVEDIDRKK

SEQ ID NO: 16758 - protein, 56 aa, Artificial Sequence
  Synthetic
LDDVLRRLEELVKDLERLIEESVRYLERNVERSRELVERSLRYLKENVDRSRKLAE

SEQ ID NO: 16759 - protein, 59 aa, Artificial Sequence
  Synthetic
DEVREVVERARKLVKDNLDAARKAVKRLRELVKENLDTVRDVVRKLRKLVEDLKRLIRS

SEQ ID NO: 16760 - protein, 56 aa, Artificial Sequence
  Synthetic
KELADEVRELAKRSHEELKRLLDEVRKLLKDSERALRKLLEDVRREADKVAEEVRT

SEQ ID NO: 16761 - protein, 59 aa, Artificial Sequence
  Synthetic
SEVDEVVRRARELVKKNRDDVKKVVEDLRRIVKEDLDTARRVVKRLRELVEELKELIRS

SEQ ID NO: 16762 - protein, 56 aa, Artificial Sequence
  Synthetic
KELADEVDELMKDSDRELKRLLEEVRKLAKRSTDELERLIEEVRKELEDVLDEARQ

SEQ ID NO: 16763 - protein, 59 aa, Artificial Sequence
  Synthetic
SREEELLERLRRVVERNKKLVDDLADRADKVVKENEKLVRDLLEESRKTSEILDRLVKN

SEQ ID NO: 16764 - protein, 54 aa, Artificial Sequence
  Synthetic
LVEEVRRLSEKSNRDLKELVKDIERKLDKVHKDLEKVIEEVERSNERVKEEVKT

SEQ ID NO: 16765 - protein, 60 aa, Artificial Sequence
  Synthetic
SDAERIVEEAKRLVEENTELVERVLEKLERLVRENRTLVERVIEELDDLVRRIEDVVRRG

SEQ ID NO: 16766 - protein, 59 aa, Artificial Sequence
  Synthetic
KKLEKLLREVERLMEESHKRLKEVADTARRLMDDSERELDRLLREAEKKIRDVREEIRR

SEQ ID NO: 16767 - protein, 59 aa, Artificial Sequence
  Synthetic
SLVDEILKDLDRLVEENEKLVKKIVEDAEELVKRNTDLVEEVLRELKEIVETIRDLVRR

SEQ ID NO: 16768 - protein, 59 aa, Artificial Sequence
  Synthetic
EELKDVLRRVEEKIRKSNEKLEKLLEEVSRLAKRSDERLKKVLEDIKEEIRKVKEDLER

SEQ ID NO: 16769 - protein, 59 aa, Artificial Sequence
  Synthetic
SLEEVVKKAEDLLKRVNDELKKVSKKVRDDLRRVNEKLKTVVEDVLRKLEAVVDKIRKS

SEQ ID NO: 16770 - protein, 56 aa, Artificial Sequence
  Synthetic
VKDVDKRIRDVVRRHEEVVETNARRVDEVVKRHDKLVKDLERRVEKVVRELEEKVR

SEQ ID NO: 16771 - protein, 59 aa, Artificial Sequence
  Synthetic
SLDEIVKRAEEELKRLNEELKRVSDRVKERLDRVLDELRRISERIKELLERVKRKLERE

SEQ ID NO: 16772 - protein, 56 aa, Artificial Sequence
  Synthetic
AEDLRREVEEIIRRHKEVIRKNEEDVKRVLDTLREMLKKNKKLVDDMVRKLDETIK

SEQ ID NO: 16773 - protein, 55 aa, Artificial Sequence
  Synthetic
SEAEKVLEKVERVAREVLERIKRIVEHTKRVVEDVIRRADESVRRSEEIMEDVRR

SEQ ID NO: 16774 - protein, 56 aa, Artificial Sequence
  Synthetic
KEDVERLVRTVKEELDRLVDESRKLSRDVRETLEELVKRSEDVTRRVEETLREIVK

SEQ ID NO: 16775 - protein, 56 aa, Artificial Sequence
  Synthetic
DELERILEEVKKVVEEVVRRAEESVKKTEDVMRKVVERVARSLEESRRVAEEVERR

SEQ ID NO: 16776 - protein, 56 aa, Artificial Sequence
  Synthetic
EKDVKRLVDEVRKELEELVRRSEELTKEVKKTLEELVKESKEVVKDVEKKLREIEK

SEQ ID NO: 16777 - protein, 57 aa, Artificial Sequence
  Synthetic
REVDEAVKNNEEDAKESRRVVEEAVKRDEDIARDIERRAREVVERDKEIVDEVRRRV

SEQ ID NO: 16778 - protein, 60 aa, Artificial Sequence
  Synthetic
SKEVKDLLDENSKRSNEISREVKKDLERTVRENKKIVDEVRKKLEDTVDKNRRIVEEVTT

SEQ ID NO: 16779 - protein, 57 aa, Artificial Sequence
  Synthetic
SEVDKMLKRSNDIVREIARVVEEAVKTDERIMREILEHARKVVEEDKEIVDRVRKEV

SEQ ID NO: 16780 - protein, 60 aa, Artificial Sequence
  Synthetic
SEEVVRRLRTLVEENRKIVEDVKRELERTVRDNRRIVEEVAKRNHDTVRENKEIVDRVKT

SEQ ID NO: 16781 - protein, 57 aa, Artificial Sequence
  Synthetic
KEAEDVIELVRRILEEVDRRVRDVLRKDEESLRRVKKTVEEVLKRHKDIEDEVRRRV

SEQ ID NO: 16782 - protein, 60 aa, Artificial Sequence
  Synthetic
SEEVKRVLEEIVKKVEEIVKDVERKLRKTVEENEEVVRRVKRYLEKSVEDLEKVVRDVTT

SEQ ID NO: 16783 - protein, 56 aa, Artificial Sequence
  Synthetic
SAEDILREVEELVRRTRKHLEDSLREVTKLVEETKREADRILKEVRDRVKEVIERG

SEQ ID NO: 16784 - protein, 59 aa, Artificial Sequence
  Synthetic
EEVLKTVREELRDIIRRSVEHNRDSLRRLREIIERSLRHVEEVLERVRKEIERIKRETK

SEQ ID NO: 16785 - protein, 56 aa, Artificial Sequence
  Synthetic
SAEDILREIKRLVEETERLLKRILEEVRKLVEETRRRLETILRRVEEKVRRLVEKG

SEQ ID NO: 16786 - protein, 59 aa, Artificial Sequence
  Synthetic
EETLKRALDEARKIIEESKKHVKDVLRKVTDEIRESKKDVERVEDEVDKRIREVDERTK

SEQ ID NO: 16787 - protein, 60 aa, Artificial Sequence
  Synthetic
SIDEVAEEVERLLEEVKETSREVLERVKRELEKIIDTSRRILEEVRRLLERVLEEVERRK

SEQ ID NO: 16788 - protein, 59 aa, Artificial Sequence
  Synthetic
DRDVKRVLDKVRKKIEENKDTVRRVEEEIKKLIEDNKRTSEKVRKEVTDIIEEIKEEIK

SEQ ID NO: 16789 - protein, 56 aa, Artificial Sequence
  Synthetic
DVEDVVREAEDLLRKLEEKSRKVVEDAKRLLDEVKRKMEESVKEAKRLLDEVLRKS

SEQ ID NO: 16790 - protein, 59 aa, Artificial Sequence
  Synthetic
KKIVEEVRRRVEEVVRRDEKSVEDLKREVDRVITELDRLVKRNTEEVERVIRRLDEETR

SEQ ID NO: 16791 - protein, 60 aa, Artificial Sequence
  Synthetic
SEEEDAERLLRDLKRRADEVVKESEKILEDIVRDAERVLRESKRISEEIVRRADEIRRKV

SEQ ID NO: 16792 - protein, 55 aa, Artificial Sequence
  Synthetic
RLVEELRRLVEEVRERLDRSVKKTKELLKEVIKELEKLLKKDEDDVERVIRRLED

SEQ ID NO: 16793 - protein, 60 aa, Artificial Sequence
  Synthetic
SEVEDILRRVEKRARDSLKHLEDVLRKVDKRVRESLDNLRRVLEEVERIVRELERLLDEG

SEQ ID NO: 16794 - protein, 59 aa, Artificial Sequence
  Synthetic
ERLLEEIVRRLEDSLRKVEEIARRIEKRLRDSLRETKRIADEIRKRLEDALRRVEERAR

SEQ ID NO: 16795 - protein, 60 aa, Artificial Sequence
  Synthetic
SDVEKILDDVRKDAERSLENLKEVLEKVEEEVRRSLEDLRKVLEDVERIARKLEELLKEG

SEQ ID NO: 16796 - protein, 59 aa, Artificial Sequence
  Synthetic
EELLRRIERTLRESLEAVKRIAEEIERTLEESLREVERIVKEMEDLVRAALKRVEDKAR

SEQ ID NO: 16797 - protein, 60 aa, Artificial Sequence
  Synthetic
SEVEEILRRIKEEVRESLEDLRRVLEEIEKKAKESLRELKEVLERVKEIADKLKRLLDEG

SEQ ID NO: 16798 - protein, 59 aa, Artificial Sequence
  Synthetic
EKLLRDIKRDLERSLEAVDKIVKEIMERIKESLKATERIVKEMKDLITRVREEVKRRAE

SEQ ID NO: 16799 - protein, 56 aa, Artificial Sequence
  Synthetic
DEVEELKERAKRSNEELKRKVEELKKRAKKAIDDVRRVVDENKKLVKEAIDRLRKT

SEQ ID NO: 16800 - protein, 59 aa, Artificial Sequence
  Synthetic
KETLKKLLEELKKLVDESRRRLDELRKEVEKKVEEMLERARRLLKKTEDLVREVKRRVD

SEQ ID NO: 16801 - protein, 55 aa, Artificial Sequence
  Synthetic
DELKELEDRLRRAEEEARRLLEEIKKRLKESNEELKRLVEENEKLVKEALRRLEN

SEQ ID NO: 16802 - protein, 59 aa, Artificial Sequence
  Synthetic
KDVLRKLLEEVERLVKRVLDELRALLKEVEDLVRKSVEDLRKLLEETRKLVREMEERVR

SEQ ID NO: 16803 - protein, 55 aa, Artificial Sequence
  Synthetic
SLVEKLEKRLRDVIKTIEDIIRENEERLRRSNRELEKLVDENRKLVEEVLKRLAD

SEQ ID NO: 16804 - protein, 59 aa, Artificial Sequence
  Synthetic
ERVLEKLLREVEELAKRVLTELRRLLRETERLVRESEKRLRDLLRDTERLAREVEKRVE

SEQ ID NO: 16805 - protein, 55 aa, Artificial Sequence
  Synthetic
SLVEDLKRELEKAKEEIEKIVRDLERELDRVIKENERLIRENEDTVRKALERLRR

SEQ ID NO: 16806 - protein, 59 aa, Artificial Sequence
  Synthetic
EDVLRELKDRVRRIVEEVARRLEELLKKVKDLVKKSLKTNEDLLRKTEELVRRAEERVK

SEQ ID NO: 16807 - protein, 60 aa, Artificial Sequence
  Synthetic
SEVEEVLKRLKELVDTVLEELKDVIRRIEELLERVRRDNERTIREDEELVRKVLDELRKI

SEQ ID NO: 16808 - protein, 56 aa, Artificial Sequence
  Synthetic
AEEIERVIREAERRLKKLLDELRRLVEEVRRELEELDERLKRSSEEAKKRLDELVK

SEQ ID NO: 16809 - protein, 60 aa, Artificial Sequence
  Synthetic
SEVERVLEDLRRLVRDVEEKLRRIIERDRRLVEEVERENRKTIRKIEELLRKVLEELKDI

SEQ ID NO: 16810 - protein, 56 aa, Artificial Sequence
  Synthetic
AERIEDVVREAEKRLRELLKELEKTSRDLKKRLEELDRELKALVEKVERDLEELRK

SEQ ID NO: 16811 - protein, 60 aa, Artificial Sequence
  Synthetic
SEAEELLRRLKELVDEVLKRLRDMIKRSEDLARDVLRKHEDLIRKLEELMKKVEDLADKI

SEQ ID NO: 16812 - protein, 59 aa, Artificial Sequence
  Synthetic
EEVVREIERIVREVTERLRRLVEENAEVVKRVEKELKELNDELRRVVEEIVRKAKEKTK

SEQ ID NO: 16813 - protein, 60 aa, Artificial Sequence
  Synthetic
SEAEELLKRLEDRAEEILRRLEEILRTSRKLAEDVLRELEKLLRESERRIREVLEELRRI

SEQ ID NO: 16814 - protein, 59 aa, Artificial Sequence
  Synthetic
KEVVDEIKRIVDEVRERLKRIVDENRKIVEDARRKLEKIVKENEEILRRLKKELRELRK

SEQ ID NO: 16815 - protein, 60 aa, Artificial Sequence
  Synthetic
DMRKELEKRVEEIRRAVTELVKRNEDIVREVKKRVEELVKRNEDITKKAEDDIRDLVRKR

SEQ ID NO: 16816 - protein, 59 aa, Artificial Sequence
  Synthetic
EEKLRRLLERLEDIARRVLKYLEEDLRETEKLAKEVLDRARKILEETKELVKDVLEKAR

SEQ ID NO: 16817 - protein, 60 aa, Artificial Sequence
  Synthetic
DMDEELRRVVKEIEDELRRLVEENRDVVRKVEKLNRDLLKRNEDITDEARKRVEDLVRKR

SEQ ID NO: 16818 - protein, 59 aa, Artificial Sequence
  Synthetic
REKLEKLIRRLREIAKEMLEYAKRDIERTKELAKRSLERHKESLDRTEKLVKEVLDKAR

SEQ ID NO: 16819 - protein, 60 aa, Artificial Sequence
  Synthetic
DMVRDLERIVEKIKEDIKELVKRNREVTEKVVRDVEELVKTNREVVREATRRVEKLVEEE

SEQ ID NO: 16820 - protein, 59 aa, Artificial Sequence
  Synthetic
EDTLRKLLKTLRELARRVLEEARKIIERSKELAERVLRYLKRDIEESKKIVKEIEDRAR

SEQ ID NO: 16821 - protein, 60 aa, Artificial Sequence
  Synthetic
DMERELDDVVRKAEEDNRRLLKENEDIVREVVDRNARLLEENRRVVEEAVRRVEDMLRRR

SEQ ID NO: 16822 - protein, 59 aa, Artificial Sequence
  Synthetic
ERKLRKLIDDLRKLVRESLEYNKDDLEKTKELARRSLKYNKEDIDRSREIVRDVRRKAQ

SEQ ID NO: 16823 - protein, 60 aa, Artificial Sequence
  Synthetic
SVIEALEEIAEKIERDVRKLVEENREVVKEAEKRVEEILRTNSKRSEEVRREVEDLVRKD

SEQ ID NO: 16824 - protein, 59 aa, Artificial Sequence
  Synthetic
ERVLEELLRRLEEIAKRALEYLTRDIEETKRLVEEVLKRLKEILDKTDDLAREVLERAR

SEQ ID NO: 16825 - protein, 60 aa, Artificial Sequence
  Synthetic
SEVEKIEEDLKRLVKRLREINEESKKRLEELIRTAEEINKKTTDELERLAEEVDRLVKRV

SEQ ID NO: 16826 - protein, 59 aa, Artificial Sequence
  Synthetic
REAVDRLRRVVDEIRKEARKLNEEIRKRVEDVVRKLDKMDEDLRKRVEEIERKVREATR

SEQ ID NO: 16827 - protein, 60 aa, Artificial Sequence
  Synthetic
SEVEEILERLRRLVKEVDKRNTDSLDTLKRLIDELERKNRDSLRRVDELAKELEKLARRV

SEQ ID NO: 16828 - protein, 59 aa, Artificial Sequence
  Synthetic
KDAVTELEKDVREIKKRLDEMDKRLKDVVDEVRRRAEEVNRRIERLVREIEKRAREEVR

SEQ ID NO: 16829 - protein, 60 aa, Artificial Sequence
  Synthetic
SEAEEVLERLKRLRETVKEENDDSLRKDRELVDRLEKDNRDSLRKLKELIERVREILKRV

SEQ ID NO: 16830 - protein, 59 aa, Artificial Sequence
  Synthetic
KDVVETVKRVVEEIEKELEEANRRLEKSSREVEDRIRKANKRLEEVVDEVREEVDKATR

SEQ ID NO: 16831 - protein, 60 aa, Artificial Sequence
  Synthetic
DEVREVLTRLEELVRRVTKELEDSLRNTERVRRTIRKLAEEVNRDSKRLKDEVKKVLEKI

SEQ ID NO: 16832 - protein, 59 aa, Artificial Sequence
  Synthetic
EEAVETLKRKVEEIERRLKRMVEEDRKTIEEIEEEVRRLVKTNREIIKEIVETLREAVR

SEQ ID NO: 16833 - protein, 60 aa, Artificial Sequence
  Synthetic
KEVEEVRTRLKKLRDDVKRLLDEVNEESKRLAEEVRRRLEESNRNTERVVEEIERVIERI

SEQ ID NO: 16834 - protein, 59 aa, Artificial Sequence
  Synthetic
DKVVDEVRRRVEEAEREVKDMVRTNNEIVRRIVEEARRLVDEDRDRIKKIEERLRRELQ

SEQ ID NO: 16835 - protein, 60 aa, Artificial Sequence
  Synthetic
SEAEEVLREVDELAKRLERVATESLKNTKKVVDDVRREVKRVNERSEEIMRRIEDVLRKI

SEQ ID NO: 16836 - protein, 59 aa, Artificial Sequence
  Synthetic
EELIREIERIVREIDKRARELVERDNREVERIVEELKELVKTNNDIVRRVVEKLKETVR

SEQ ID NO: 16837 - protein, 58 aa, Artificial Sequence
  Synthetic
SEAEKILEDLKRIVRRIKEELRRVLDHTRELVERIRRLAKKILDDTEKIVRDIRDKAE

SEQ ID NO: 16838 - protein, 59 aa, Artificial Sequence
  Synthetic
EDVVRELKREVERIKREVKKMVDDNRRTVEKIKRDAEKMVRDNEELSRRIEKDVDDKTK

SEQ ID NO: 16839 - protein, 58 aa, Artificial Sequence
  Synthetic
SEAEKIEERLKRVVEKLRRDATRVRKHTDDLVKEITDLAEESKRRVEEIRERVKRLRE

SEQ ID NO: 16840 - protein, 59 aa, Artificial Sequence
  Synthetic
EKVVKRLEDEVKRIKDEAKEMVDENKRKVDEIRKELRRLVEENRRESEKIKKKLDEDLK

SEQ ID NO: 16841 - protein, 58 aa, Artificial Sequence
  Synthetic
DEIREILRRIREVVADATRRAKESLDNLKRVVEEVDRRVKESLDRLKEIVDRVRELSK

SEQ ID NO: 16842 - protein, 59 aa, Artificial Sequence
  Synthetic
KDVVKRVEDEVRDIRRVLEEMVRRDKKVVDEIRERLKEAVRRNEEVSRKIKKDLKDETK

SEQ ID NO: 16843 - protein, 57 aa, Artificial Sequence
  Synthetic
SMEERLREVVTEIRKKVEKLLRDNRKSNKEIKETVDDLVRRNRELTERAKRRVDARG

SEQ ID NO: 16844 - protein, 59 aa, Artificial Sequence
  Synthetic
EREAEELLRELADVVRRAEELAERSLRESEKVMEDITREAERILRDTKRLIEEIERRAR

SEQ ID NO: 16845 - protein, 57 aa, Artificial Sequence
  Synthetic
SLREDLEKDVRDIVREIDEAVERNRRSVEEVDKRVEDMLKNNRDSNKKIEEDVRRAG

SEQ ID NO: 16846 - protein, 59 aa, Artificial Sequence
  Synthetic
EEDAKRLKDELREVVDKIRRDLKKSNDDIRRLVEKIKRELEELNKRSRELVERARETVR

SEQ ID NO: 16847 - protein, 57 aa, Artificial Sequence
  Synthetic
SLEETIEEKVRRIREEVRRMLENNRRINEEVDRRVTEMVERNRKTVEEVVREVDRDG

SEQ ID NO: 16848 - protein, 59 aa, Artificial Sequence
  Synthetic
EEDAKRLLEEVEDIVRRLRKELEDSNRKSRKLVEEIRKRAEESNRELRELIKRIKDRAR

SEQ ID NO: 16849 - protein, 56 aa, Artificial Sequence
  Synthetic
DVLERLAEVVRRVVKEAEDLVRNNRRLNKEVEDEVDELVRNNRRLTKDVVKKVEDA

SEQ ID NO: 16850 - protein, 59 aa, Artificial Sequence
  Synthetic
KEEVKRLEDELRKVVDKVRKDMKRSNDDSERLREDITRKAKRLNEETRKVMEDVTRRAT

SEQ ID NO: 16851 - protein, 60 aa, Artificial Sequence
  Synthetic
KEAEELIREIERKAEEVRKENERSIRENERLAREVEKRLKRTNEELKRLVRELEEKLKRD

SEQ ID NO: 16852 - protein, 59 aa, Artificial Sequence
  Synthetic
EELIRRLEEVVKRIREDLKKLDDDLKRSVEEIERRLKKVIEDNRETLERARRRLDERVK

SEQ ID NO: 16853 - protein, 60 aa, Artificial Sequence
  Synthetic
DEAEEILEELRRLIEEDKKTVEEVLRRDEETIKRLEEENREALKDNRRLIEELEDIVRRI

SEQ ID NO: 16854 - protein, 59 aa, Artificial Sequence
  Synthetic
EKVREKVERILDDLRRVVEETVKRAEDLLRKSREVVKRVDEELKESHDRLDERIKRDLK

SEQ ID NO: 16855 - protein, 60 aa, Artificial Sequence
  Synthetic
DEAREILKTLKDLIKELEDRNREVLERDKKTIEDLERRNARVLEENKKLIDEIRRIAKDI

SEQ ID NO: 16856 - protein, 59 aa, Artificial Sequence
  Synthetic
RSVEEALKKILRELEKKVEEVDRRLKRILEDSRRVVRRVDEEARKSHEELKRELDRIRK

SEQ ID NO: 16857 - protein, 60 aa, Artificial Sequence
  Synthetic
KEAEDLLRKLRELIKKLDDTNRRVLERDRKTIEELERRAEKILTDIERLIRELEDRVRRT

SEQ ID NO: 16858 - protein, 59 aa, Artificial Sequence
  Synthetic
EKVVEKARRILKELRDRIREVDKRLRELLEESRKRVEEVERELERLVRELEKKVREAEK

SEQ ID NO: 16859 - protein, 61 aa, Artificial Sequence
  Synthetic
SEVEDVVRKIKEILERLKKEVDDVLDRNRKLLEELKKRADEVLKRNKDLLETLKREADRDG

SEQ ID NO: 16860 - protein, 56 aa, Artificial Sequence
  Synthetic
KDELKRLLDELREIVKEAEERLRKSDEDLERIIREVKKRLKESNEELERTIREVER

SEQ ID NO: 16861 - protein, 58 aa, Artificial Sequence
  Synthetic
REVEEVVKEAEDLLRKLRELAKEFLTRHKKLIRDVTEKVKEVLKRSADSIRELEKIID

SEQ ID NO: 16862 - protein, 59 aa, Artificial Sequence
  Synthetic
EDAVRKLEEMVERLARIVEDVERKLKKLNKELEEIVRDAKRRLERLNEELRRRIREAER

SEQ ID NO: 16863 - protein, 58 aa, Artificial Sequence
  Synthetic
DEDEDIERKLKELIDRLREEVKKAEDEHKELIKRDHRRVEEVERRSEKSIKDLRDLAK

SEQ ID NO: 16864 - protein, 59 aa, Artificial Sequence
  Synthetic
EDVARRLEELVEELEDIVRKVKESLRRLNEELRKNSETVKKKLEDLNRELRKDIEEKRR

SEQ ID NO: 16865 - protein, 58 aa, Artificial Sequence
  Synthetic
SEAEKVLEEAKRLIEELERRVREVLKRSKKTIEDLRREVDRVVKEHKKLIRELREIIK

SEQ ID NO: 16866 - protein, 59 aa, Artificial Sequence
  Synthetic
EEVAKRLKDVLRELKDLVEKIEEEARRLNEELKEIIDRARKTLEDLNRELEEVVRRARK

SEQ ID NO: 16867 - protein, 59 aa, Artificial Sequence
  Synthetic
SEVDEVRRELERVITDDKRLVDESRRKNEKSIRDDEELIKTSRRINEESIRRLKELVER

SEQ ID NO: 16868 - protein, 56 aa, Artificial Sequence
  Synthetic
EETLRRLVKRLDETSEELEDENRRLNETLKRSSDELRKTNEELNKRLKEVVDRAKK

SEQ ID NO: 16869 - protein, 61 aa, Artificial Sequence
  Synthetic
SVEEKIKEMVDKIKDSVRRSTEENDRLVKEIDKVLKEAEKRNRDLLKEAADVLKRVLDKRR

SEQ ID NO: 16870 - protein, 56 aa, Artificial Sequence
  Synthetic
IDTVLKDMKKILDDNKKLVDDSRKKHKESIDRLRKLVKDSLDEHRESIERLERAAR

SEQ ID NO: 16871 - protein, 60 aa, Artificial Sequence
  Synthetic
REVEELERELEESNKELRKLIKELDDLLRETNKRLNDLIRELKERLDRVLEELRKIIKDD

SEQ ID NO: 16872 - protein, 59 aa, Artificial Sequence
  Synthetic
REVEKLVEEAIKRNEDLVRTVERKVDEAIKENRRSVEKVAEEVKKAEEELERIVDTVRR

SEQ ID NO: 16873 - protein, 60 aa, Artificial Sequence
  Synthetic
REVEELKKEADKTNEDLNRLIKELEERARESNRELKRLIDELRRRLEEVLKRLKDIIDKE

SEQ ID NO: 16874 - protein, 59 aa, Artificial Sequence
  Synthetic
EEVERLVTEMIKRNRTSVDAVRRKVKEMIDRNKALVETVRDEVRRAREKLRDILRKAEK

SEQ ID NO: 16875 - protein, 59 aa, Artificial Sequence
  Synthetic
SIEEIVRKVKEDLKRSLDELRKVSEDMARRLRESLKELEEVVREMEERLKRILDDIRRK

SEQ ID NO: 16876 - protein, 56 aa, Artificial Sequence
  Synthetic
ERDLKRRVDEVLTRSKESVDENKRTADRVLEESRESIKELKERAKRLLERLEEERK

SEQ ID NO: 16877 - protein, 60 aa, Artificial Sequence
  Synthetic
KEVEELEREARRMLEHTKRLIDEVRDRAKKSLDNTRRVDREVEKLVEDTERRLDELRKRG

SEQ ID NO: 16878 - protein, 59 aa, Artificial Sequence
  Synthetic
EELKRTAERMIEENRRLVETLKRVLEEAIRRNEELVKTLLRKLEESDKKIRKLIEETRT

SEQ ID NO: 16879 - protein, 60 aa, Artificial Sequence
  Synthetic
SELEELRDRLKEILEHTKKLIKESVERLEESLRNTRRVIRKVEEEVERTRTKLDDLRRRG

SEQ ID NO: 16880 - protein, 59 aa, Artificial Sequence
  Synthetic
EEMADVARRVIEENKRLVEENEDRLRKAIERNRELVEEVKKRLEDSDREIERLIREVKK

SEQ ID NO: 16881 - protein, 60 aa, Artificial Sequence
  Synthetic
DEVETLRREARKLLERIKREIEEVRRRLKESLDNTKRVEDEARKLVKETKDKLKRLAERG

SEQ ID NO: 16882 - protein, 59 aa, Artificial Sequence
  Synthetic
EEMRKVAEDMEREIRRLITDLRRELEEAIERNEELVRRLARELERSDREIKKRIDEIET

SEQ ID NO: 16883 - protein, 60 aa, Artificial Sequence
  Synthetic
SELDELRKRAKRSLETTEELIRRSRKLMRESLDNTRRVEEKVRRLVEKTLRDLEDLKRRG

SEQ ID NO: 16884 - protein, 59 aa, Artificial Sequence
  Synthetic
REMEETAREAIERNRKLVEDNERDLKKAIEDNEKLVRDLKRELERSDEEIKKLIREVKN

SEQ ID NO: 16885 - protein, 60 aa, Artificial Sequence
  Synthetic
DSREELRREAKRLLDDIKRLEEKVERLAREVLKHTEELDEKLKRLVEETLKKLEDLRRRG

SEQ ID NO: 16886 - protein, 59 aa, Artificial Sequence
  Synthetic
EELKRTAEEMERRIRELIKRLKDRLEDMIRRNKELVDRLKKKAERSDEEIERLIRETKK

SEQ ID NO: 16887 - protein, 60 aa, Artificial Sequence
  Synthetic
KEIEDVVRELERKVRENKRRNDEVIKRLERLVEKNTELVRRLIRTLEKLVEDLEDIVRRI

SEQ ID NO: 16888 - protein, 59 aa, Artificial Sequence
  Synthetic
EEAKKVAEDVERRIRRSVEEARRLLEEVKRKMEESVEESKRLLKKVEDEAKDVVDRARK

SEQ ID NO: 16889 - protein, 60 aa, Artificial Sequence
  Synthetic
SEIDKVIEELKDLVRKNEKRNRDVVRRDDKSVKDNTKRVEDVIRDLDRLIRELREIVERI

SEQ ID NO: 16890 - protein, 59 aa, Artificial Sequence
  Synthetic
KRAAELAKEVIDRMEESVKEAERLLRELKRKSEDSVRKSKELLDEVEKKVEEVVREAER

SEQ ID NO: 16891 - protein, 60 aa, Artificial Sequence
  Synthetic
EEIERAIEKVEREIRELEERVREIIERDRKSVEDNSRRVRTVIKELEKLVEELRKTVKDI

SEQ ID NO: 16892 - protein, 59 aa, Artificial Sequence
  Synthetic
EEARKLAEELRKEIKRVVDEVRKLLRDLERKSKESVREAEELLKRVRDELKEVVDRTEK

SEQ ID NO: 16893 - protein, 56 aa, Artificial Sequence
  Synthetic
SLREAVERLRKRHEDVVRELEKLVRRVKEELERVNKDLRKVVEEVRRRLEKVLEDA

SEQ ID NO: 16894 - protein, 55 aa, Artificial Sequence
  Synthetic
TDLLKRADDNVKRNRDLIRRLKEKADEIVKRNEDLIEDARRKADEMIKDLEEKAR

SEQ ID NO: 16895 - protein, 59 aa, Artificial Sequence
  Synthetic
SEVDELRERAKRIVDDLRRKIEEVVKRLEDSDEENKKLIEKAVRELEKIIRDLEEVIRR

SEQ ID NO: 16896 - protein, 59 aa, Artificial Sequence
  Synthetic
RELKELVDRLDKEATDVLRKVREDLRKAIERSERSHRRLEKLIEEIERELKRVVDEVTR

SEQ ID NO: 16897 - protein, 57 aa, Artificial Sequence
  Synthetic
DIEELLRKVAEEITRSVKESRDRLDEVEKKAREVVERSEKRLREVEEKIERVVRRIV

SEQ ID NO: 16898 - protein, 59 aa, Artificial Sequence
  Synthetic
EEDADKVLKEAEELVRRNRRLVEEVLRRLEEIVKRDEDLVRKVLKEADEIVRRLEEAAR

SEQ ID NO: 16899 - protein, 59 aa, Artificial Sequence
  Synthetic
SRVEDVVRRLKELNDENSEDSRRVLEKLKDEVRKNSDEIEKAAEELKEKLTRLKRLIEG

SEQ ID NO: 16900 - protein, 59 aa, Artificial Sequence
  Synthetic
KEVKELVKRVRETSKKSLKEDEDMVREVKKKLDDSLRRVDELVRRVEEEARRVLEEVKK

SEQ ID NO: 16901 - protein, 59 aa, Artificial Sequence
  Synthetic
DEVERVVKELRDKVDRNSREIEKAVTELRKIVKRNSDESKEVIERLEELLRRLEELIKS

SEQ ID NO: 16902 - protein, 59 aa, Artificial Sequence
  Synthetic
SRVKTLVDEVRKRAEDSLDTVKKLVDRVRERLDESLRDDKRLVDRVREEAERVVREVEK

SEQ ID NO: 16903 - protein, 60 aa, Artificial Sequence
  Synthetic
SDVEKIFDELRKLLEDLRRKVEEVFRRLKELVERNTRLNREVVKELKKTSDDLRDMVRRT

SEQ ID NO: 16904 - protein, 59 aa, Artificial Sequence
  Synthetic
EKVRKLVKEIRERIEKVLRDAEELLKEIEERVKESKKEAKKLLDEVRESVDDVKRKAEK

SEQ ID NO: 16905 - protein, 60 aa, Artificial Sequence
  Synthetic
SDVEEIVRKLDKLVEDNTRENEEAFKRLDETSKKLEEEVERVFRELKKLVDDLEKIIRDI

SEQ ID NO: 16906 - protein, 59 aa, Artificial Sequence
  Synthetic
EKVRKLVREVEKKVDESTERAERLLKRVEDSVRDVLRRAKELLDEIRKRVKDVERKAEK

SEQ ID NO: 16907 - protein, 60 aa, Artificial Sequence
  Synthetic
DEAREIRRRLKEVVDEVRKRLEDSLEEIDRRAKEVLEKVKRSLDRLRKVAEEVLDKLRRK

SEQ ID NO: 16908 - protein, 55 aa, Artificial Sequence
  Synthetic
ERVKRRVDEVVRKLREIVRKLTEENKRTVEDLERIVERLDRDNRKMVEDMEREVK

SEQ ID NO: 16909 - protein, 60 aa, Artificial Sequence
  Synthetic
REVEELKKRLEKIVEELKRIVDDHKRKVERIVEELEKLVEDHKRTVEEIVERAKRIVEKD

SEQ ID NO: 16910 - protein, 58 aa, Artificial Sequence
  Synthetic
ERLEEVAREIEEALKKVKRDLKESNRELEEVADRVRKELDRSDEDLERRMREVREELK

SEQ ID NO: 16911 - protein, 56 aa, Artificial Sequence
  Synthetic
SVLETLAERVKEVKDNLRKLVEDLKRLVDRIKETLDKLVEELRELVERLDDRLRKN

SEQ ID NO: 16912 - protein, 62 aa, Artificial Sequence
  Synthetic
RDLLKRLEEIMRRLEKEHKDVSKLLRDIEREIDRVHREVKRKIEEIVRKVRKSLEEVKRRAK

SEQ ID NO: 16913 - protein, 57 aa, Artificial Sequence
  Synthetic
SRAETVLKEVTDKIKKLKDSSDELLRRNKENIDELKKSSEELLRRLTKAIEEIEKAN

SEQ ID NO: 16914 - protein, 56 aa, Artificial Sequence
  Synthetic
DEVVKRVRDLLDTVRRRNEKVNEDVKRMNDKLRRDNEDVIRRVEKLLRELEEKRRT

SEQ ID NO: 16915 - protein, 59 aa, Artificial Sequence
  Synthetic
DLEEVVKEARRLLDTVRKKLDESIKEARELLREIEERFKKSADEVREELKRVEDELRRK

SEQ ID NO: 16916 - protein, 56 aa, Artificial Sequence
  Synthetic
VRELRKEVEDIIRRLDELVKKNTEDNRRVIKELRELVEEHTRRVKKIIEDLEREVR

SEQ ID NO: 16917 - protein, 60 aa, Artificial Sequence
  Synthetic
SVEEVVEEAKELLKEVEEELKRSAEEAEKLLRDVARKMEESVERLRRLLKDVERALREKN

SEQ ID NO: 16918 - protein, 56 aa, Artificial Sequence
  Synthetic
LRRLREKIEEIVRRLRELVRRHNEEVRRIIETLEELVRRNTETVEREVRRLRDEVR

SEQ ID NO: 16919 - protein, 59 aa, Artificial Sequence
  Synthetic
SVEKVLEDARRLLEEVKDRLKKSIDDAEKLLRELEKRLRESADEARRLLRRVKELLERK

SEQ ID NO: 16920 - protein, 56 aa, Artificial Sequence
  Synthetic
LRELKREIEEIVKRAEDLVRENTEKNKRVVDTVEELVRRHNEEVRRVVKELEERVR

SEQ ID NO: 16921 - protein, 59 aa, Artificial Sequence
  Synthetic
GLDEIIKRLREVLEKIREELRKSSEELERLLKRVDDDLERSNKELEELLERVRKKLEDS

SEQ ID NO: 16922 - protein, 59 aa, Artificial Sequence
  Synthetic
EELLRELEKEIKRVDEDLKRLVEEHEELVRDVLRKLEKLVREHKEKVRERVERADDKVR

SEQ ID NO: 16923 - protein, 59 aa, Artificial Sequence
  Synthetic
SLEEVLKELKKIVEDVTRRLEEMLRESKETSKEVEKELKKLDDEIREIIERAEEDLRRA

SEQ ID NO: 16924 - protein, 56 aa, Artificial Sequence
  Synthetic
EEILKEVAERLKKTAEEVKRELEKFIEDDRKRADEVRRENEETLKRIEDIVRELKR

SEQ ID NO: 16925 - protein, 58 aa, Artificial Sequence
  Synthetic
SALEKIMKDLEKSIEDVRRKLEDILRKLRKSSEEVKRRIEDIERKVDRAAKEILRSKG

SEQ ID NO: 16926 - protein, 59 aa, Artificial Sequence
  Synthetic
EDVVRRLKRTVEEVHKRNEDVVREAEKLVEKLSRINEEAVRRLADIVRRLEEELRKAEK

SEQ ID NO: 16927 - protein, 57 aa, Artificial Sequence
  Synthetic
REKEDVLRRIERIVREIERRLRESLKRNREIVKDLERLARRVLKESEDNLRKLKEDR

SEQ ID NO: 16928 - protein, 56 aa, Artificial Sequence
  Synthetic
REKLRKRLEEMKEELRKADERAKEIDTRTKRLVDEAVRKLEKLVEEHRRMTDEIRR

SEQ ID NO: 16929 - protein, 63 aa, Artificial Sequence
  Synthetic
REDETLEKILRRIEEIVRRLVREAEDVVRRDRETIERLVRENEKAVKEIKDIVDELTRLKKDK

SEQ ID NO: 16930 - protein, 58 aa, Artificial Sequence
  Synthetic
ESVREAAERLKDILRRLEELLRKVAKDLKKSNDELERLSEESVRRLREILKRLEDALR

SEQ ID NO: 16931 - protein, 60 aa, Artificial Sequence
  Synthetic
SEVEKILEDLDRSAKEAADRIKEIVDRLTELVKDLKKKNEESLEELDRLVKELADLLRRG

SEQ ID NO: 16932 - protein, 59 aa, Artificial Sequence
  Synthetic
EDKLRDIARRVREVNKRLEDLIRTVARAVRKALKDSEDLVREIAKRVEKALEDVRRAAK

SEQ ID NO: 16933 - protein, 58 aa, Artificial Sequence
  Synthetic
REVEEVIRKLERILEEAERMSRESERKLREILEKLERAIREIREELERIHKELEEKAG

SEQ ID NO: 16934 - protein, 56 aa, Artificial Sequence
  Synthetic
RDRLDKAVEELRKEIEEMLRRSDELVKRLDEKVKKVLKELREHVKRDKEKVDKDAE

SEQ ID NO: 16935 - protein, 58 aa, Artificial Sequence
  Synthetic
SSRERVIKKLEESLERLERLARKIKEDLERINRDLERLARKVEEELKRIHEELERRSG

SEQ ID NO: 16936 - protein, 56 aa, Artificial Sequence
  Synthetic
EDELDKRVKDLHRENEREIRRLEDHVRRDRERLEEALRDLEAHVKRDKDKLDKDAK

SEQ ID NO: 16937 - protein, 56 aa, Artificial Sequence
  Synthetic
SEIEDVARRLEEINKKSEDMARRIKEELEKVDEESERLVREVAKRLDEVLKRVRDD

SEQ ID NO: 16938 - protein, 56 aa, Artificial Sequence
  Synthetic
AEELKKRVEDLKRKNEDLIRRLEEKVRRLKKRNRDLIEELKKLVKELKDEAKKTSD

SEQ ID NO: 16939 - protein, 56 aa, Artificial Sequence
  Synthetic
SEEERIEKRLREIHERHKRMLDEIKKRLDDSLKTLEDLIRDVTRELEKVLKKAEDD

SEQ ID NO: 16940 - protein, 56 aa, Artificial Sequence
  Synthetic
AEDLDREVKRLEREIERSIKELEELVRKLHKENEELIRELEELVERLKRKIDETSR

SEQ ID NO: 16941 - protein, 60 aa, Artificial Sequence
  Synthetic
SEVEDAERVVRELEREVREEVKKLRKHVKETRDRDKDTVRRVEEKVKRLREKVKRVEDAR

SEQ ID NO: 16942 - protein, 58 aa, Artificial Sequence
  Synthetic
RAVREVLKELERVLRDAKRELDRVREEHERSHKELRDMLDRVKKELEKILEKLERALR

SEQ ID NO: 16943 - protein, 56 aa, Artificial Sequence
  Synthetic
EDKERVEEKIKRSLEEARREAERVRDKLRKSEEEIDRVMKRVLAEIDRVLKEVKEA

SEQ ID NO: 16944 - protein, 56 aa, Artificial Sequence
  Synthetic
SKELEDIVRRLEERNRRTVEEVERLVDEHNKRLREAAKELKKLVDDLERKLREDTR

SEQ ID NO: 16945 - protein, 56 aa, Artificial Sequence
  Synthetic
SEIEEVKKKLEKILRDHNRVVEEVAKEHEKILRDHNRVIREVKEELDRVLKKLRDD

SEQ ID NO: 16946 - protein, 56 aa, Artificial Sequence
  Synthetic
AEKLERLVKRIKEEVEESVKRLKDHAKENREDVKRSVEELRDVVRRLEERIKESAD

SEQ ID NO: 16947 - protein, 56 aa, Artificial Sequence
  Synthetic
SEIEEVARRLDEILERHNDVLRKVKEKHEEILRRHRKRVREVEEELKKILKELREK

SEQ ID NO: 16948 - protein, 56 aa, Artificial Sequence
  Synthetic
AKDLKRKVDELRRKAEESMKEVERHVRENAEHVKRSVEELEEDVRRLRKKLEEKER

SEQ ID NO: 16949 - protein, 56 aa, Artificial Sequence
  Synthetic
DEKEKVKEDLDRILEEHRREVEDVERKHRKILKDHEEVVRRVREEHEKILKRLKDN

SEQ ID NO: 16950 - protein, 56 aa, Artificial Sequence
  Synthetic
AKKLEDLVRRLKEHVDRSRERLEKHLRENKRHVEESAKRLEKHVRDNEEDVKRKST

SEQ ID NO: 16951 - protein, 60 aa, Artificial Sequence
  Synthetic
KEEEDLEREVKRLEDKVREDAKKLEEVVKTVEKLVRDDARRNEEVVKEVADRVRRLTERK

SEQ ID NO: 16952 - protein, 55 aa, Artificial Sequence
  Synthetic
EDVIRKMEEIIKRLEEVSREVEKRLRRIIRELERVSKEVLDRLREIIEKLDRDAT

SEQ ID NO: 16953 - protein, 56 aa, Artificial Sequence
  Synthetic
SVEDDVRRKLKEIEDEHRKVVKDARDELEKSHRRLRKVIEDVKRKLDRVLEELERS

SEQ ID NO: 16954 - protein, 56 aa, Artificial Sequence
  Synthetic
EKDLEEVIRRIRKKVEDSKRDLERLLEKSKRDVEEVMKDLKRRIEELEKLVRDETT

SEQ ID NO: 16955 - protein, 59 aa, Artificial Sequence
  Synthetic
SLKDELEKLLKELKEHVDRSEKKARENLKRLEEHVRKSKEELEDRLRRIEEKVKRLTES

SEQ ID NO: 16956 - protein, 59 aa, Artificial Sequence
  Synthetic
EEMVERAIRKLEDIHRRHREVVERVEREHRRIKEEHEKVVREAEETLKRIIEDLRRSAD

SEQ ID NO: 16957 - protein, 59 aa, Artificial Sequence
  Synthetic
KLEEEARELLRRLEEHVRKSKKEAEDNLRRLEKHVEDSKRRLKELLDRLRKTVEDLKRA

SEQ ID NO: 16958 - protein, 59 aa, Artificial Sequence
  Synthetic
EDVVRRAADALRRVHEAHKRMVEEVKRRHDEIHKRHEKVVRDAERALREVLKRLEEAAR

SEQ ID NO: 16959 - protein, 56 aa, Artificial Sequence
  Synthetic
SLRETADKRLRDVNRDLKRVIEELRERLKESNKKLEDLIRELRERAERILDDLRRS

SEQ ID NO: 16960 - protein, 60 aa, Artificial Sequence
  Synthetic
EEDLARRLEEIVKESKEIVDRARRRLEEIVERSEDRVRRVEERIKELVKRLEDIVRREKT

SEQ ID NO: 16961 - protein, 60 aa, Artificial Sequence
  Synthetic
KEIEEVLRRLEELIRRVREELRKNNEDIEREADKLRKELKRVNDELEKKIKDVKDRARRD

SEQ ID NO: 16962 - protein, 59 aa, Artificial Sequence
  Synthetic
KEVLDELRRVVEEVTREIREVLETSRELVRRIVETVKEVLRSHDEKIKKVEEELDRDRQ

SEQ ID NO: 16963 - protein, 57 aa, Artificial Sequence
  Synthetic
DVDEKVRELLRKIEEDLRRSVKELRELAKRIEEDLRRISKKSKDLLKKIKDDVKRAG

SEQ ID NO: 16964 - protein, 56 aa, Artificial Sequence
  Synthetic
EEDLKRVIEELKKEVEELHRRNEKIIRELEDKVRRVREDNERVIEELARDVERAER

SEQ ID NO: 16965 - protein, 59 aa, Artificial Sequence
  Synthetic
SLREEAEKIIRDLEDHVRRDEERVKEMVDRSRKLVKELEKRLRDLIREITRRVDKLRKD

SEQ ID NO: 16966 - protein, 59 aa, Artificial Sequence
  Synthetic
EKVLRKAEELLKRIIAELKKIHEELRRLSKESKERLERILDEARKMLEEVKKRLEDIEK

SEQ ID NO: 16967 - protein, 59 aa, Artificial Sequence
  Synthetic
SLEEKLEKLLKELRDHVRRDKKEVREALERLKDHVRKDREKLERAIAEIKKAVEKLKRD

SEQ ID NO: 16968 - protein, 59 aa, Artificial Sequence
  Synthetic
EKVLRKLEKAAREVAEAVKKVHEELKRALEEIRRELEDINRKLKEAADEVRKKLRDIAE

SEQ ID NO: 16969 - protein, 60 aa, Artificial Sequence
  Synthetic
SLEEELREVIKRLRDHVRRDKERAKEAIKRAEDHVRRDEEAVEEVIKELKRLVDELRKAK

SEQ ID NO: 16970 - protein, 59 aa, Artificial Sequence
  Synthetic
EDVLRRATKALEDIRRELEKINEELKRAAERIEKRLKEIHDRLKKALDDVRRELEETRR

SEQ ID NO: 16971 - protein, 59 aa, Artificial Sequence
  Synthetic
SLKEKLEREIERLRKHVEDDERRLREVIRRLEEHVKRDEDRLKKELDRLREEVERLRRA

SEQ ID NO: 16972 - protein, 59 aa, Artificial Sequence
  Synthetic
EEVLKEAEDLLRDVTRALEEVNRRARKLLKEIKEKLDEIHKRLNKMLEEVKRRLDEIRR

SEQ ID NO: 16973 - protein, 56 aa, Artificial Sequence
  Synthetic
SRAEEMIKDVRRIVEEVRRENKRVLEEIEEIIKRSKEEWEKILKELRDIIEEVERR

SEQ ID NO: 16974 - protein, 59 aa, Artificial Sequence
  Synthetic
EELLRRIKEVVDRARDTLRRLDEELKRIVEAVHDTDDKVKKELEKIVREVEEIARRRSK

SEQ ID NO: 16975 - protein, 57 aa, Artificial Sequence
  Synthetic
SEAERVVRENEENLERIKREVERDLRRNEEVLEDLRRKVKKVLDEIRETLRRLREAK

SEQ ID NO: 16976 - protein, 59 aa, Artificial Sequence
  Synthetic
EEAVRKLDDLDRRLEEIVRRASEALKRSLEEIERILRKAEEDLRRLLKRLEEIIREVER

SEQ ID NO: 16977 - protein, 60 aa, Artificial Sequence
  Synthetic
SVEDTLREMLKRLEEIVRRAEETLKRLNEEIERVVREAARRLDKLNKELRDIVRDIKRRK

SEQ ID NO: 16978 - protein, 56 aa, Artificial Sequence
  Synthetic
KDDLKRRLEEILKELKRIVDEAEERHREIIKRLRDIVREATEKSREVLKRLEDKAK

SEQ ID NO: 16979 - protein, 60 aa, Artificial Sequence
  Synthetic
KVREKLERALRRSTTSSRDIERRLKELLDTNREIVDRIVKRLKEMLDRLREEIRRIEERR

SEQ ID NO: 16980 - protein, 59 aa, Artificial Sequence
  Synthetic
DELVKRLEDDLRRWEKESKEIVDRVKEEIDRVNRESKETLKELEKEAKRVLDELERDER

SEQ ID NO: 16981 - protein, 60 aa, Artificial Sequence
  Synthetic
DVERTLDEMLKRSEDVTDEVREELKRALESNNKLIKEIVDTADKVLKDIEDTVRKIIEKK

SEQ ID NO: 16982 - protein, 59 aa, Artificial Sequence
  Synthetic
EKLVKEVEDRARKWLKDLRDKIERLREELEKVNRDTERILEKVERDLRRLLEEVRKRDR

SEQ ID NO: 16983 - protein, 56 aa, Artificial Sequence
  Synthetic
DEVEKVLREIEEIIKELKKEVDKDLEELKRTIERLKKKADEVVKRNEEVIRTLREG

SEQ ID NO: 16984 - protein, 59 aa, Artificial Sequence
  Synthetic
KEAADKLRELLKRLEEVVRRWKEAIEDINRKLEKVVRDIERLLRDLDRKAREVLERLRK

SEQ ID NO: 16985 - protein, 56 aa, Artificial Sequence
  Synthetic
SSVEKVLRELDDLIRRNRDLVEEDRKELKRTSDENRERVERIVRKNEKAIRDLRRN

SEQ ID NO: 16986 - protein, 59 aa, Artificial Sequence
  Synthetic
KKAADDLKRVLDKLRKSHREWNELIKKANKENTEILREAEERLRELDRRLRKVLEDLRR

SEQ ID NO: 16987 - protein, 60 aa, Artificial Sequence
  Synthetic
SEVERVLKELKELLDRLRELVEEILRRLEKIIKETKREIEESLRTLEEIIRRLEELAERV

SEQ ID NO: 16988 - protein, 58 aa, Artificial Sequence
  Synthetic
DADRALRKVLEDIKEIVKKAKEDLERVYKKHKKLVDEVKKAHEDVLKKAREVLEEIRR

SEQ ID NO: 16989 - protein, 60 aa, Artificial Sequence
  Synthetic
DEVEDVLRKIKEIIKRTEDKVRESLKTLKEIIRRTKEEVKKILKEIKELIERVEREARRV

SEQ ID NO: 16990 - protein, 59 aa, Artificial Sequence
  Synthetic
ERAETKLRELYERHRKVIKEVRERHKEVHKRHRDVLEEIRRRLEKLLKDLEDVIREIER

SEQ ID NO: 16991 - protein, 56 aa, Artificial Sequence
  Synthetic
DEEKDVVRRLKRNVEENTKNVERMVRELERNIRENTENAKEVITRLKKIIDELRRR

SEQ ID NO: 16992 - protein, 55 aa, Artificial Sequence
  Synthetic
EDVKRVRKLARESLERVRRLHREVLEKLKKSHDDVKRLHEEIDERAKRVVEEREK

SEQ ID NO: 16993 - protein, 56 aa, Artificial Sequence
  Synthetic
DAEELLKEIERELKRSIEEARRLLEEVEKRLRKSKRDVEKLLKEVREKLEKVVREI

SEQ ID NO: 16994 - protein, 59 aa, Artificial Sequence
  Synthetic
RDVVRRLVEEARKLVEENTRENRDMIEKLRRLVKRHSEEVEEIIRRLDKLIDDVRREAE

SEQ ID NO: 16995 - protein, 59 aa, Artificial Sequence
  Synthetic
SLEELLREVERRLRELNKKLEDMIREVEERLRKVIRETEKLIEDVKRELEKILEKARER

SEQ ID NO: 16996 - protein, 56 aa, Artificial Sequence
  Synthetic
EKELEKEVRDDLRRTDEDIRRLLDEARKDVERHKEELKKLLEDAKRLLERVERTIR

SEQ ID NO: 16997 - protein, 57 aa, Artificial Sequence
  Synthetic
RELEEVVKKVREEVKEHTEKVKRLVEEAEELNRRYEEEVKKLVTTAKRLNDEARKRN

SEQ ID NO: 16998 - protein, 56 aa, Artificial Sequence
  Synthetic
KELLDEVAKLVEESLRRLDRLLEEIKRTSDELIEKNERLNRELNKTSDKVVEDMRR

SEQ ID NO: 16999 - protein, 60 aa, Artificial Sequence
  Synthetic
SLEDLIREVEDRNRKSVEEVERLLEEVRRKLDESRKRLEELLKRVEEKLERVIEEAKRRL

SEQ ID NO: 17000 - protein, 59 aa, Artificial Sequence
  Synthetic
EKVVEELAREMKKSVEEHTREVRRMVAELEKLVKRHTEEVERAVREAEKLVETLREELR

SEQ ID NO: 17001 - protein, 60 aa, Artificial Sequence
  Synthetic
SLEDLIREVEKRNKESVDTARRLLDEVRKKLKDSIDRSRKLLEEVRRKLEEVIKDAKRKL

SEQ ID NO: 17002 - protein, 59 aa, Artificial Sequence
  Synthetic
ERVVEEIMRRLEKSVERHTEEVKRVVREAEELVKDNTRKVEELVRRAEKLVEDLERRTR

SEQ ID NO: 17003 - protein, 60 aa, Artificial Sequence
  Synthetic
SLEELIREVEERLRKSVDDSRKLLEEVKRKLEDSKREVDRLIEEVKRELERVIEDVTRKL

SEQ ID NO: 17004 - protein, 59 aa, Artificial Sequence
  Synthetic
EKVVKELADEMRKLVRTNTEIVKDVVKKLDELVERNTRTNRDVVRRARELVEELERRER

SEQ ID NO: 17005 - protein, 57 aa, Artificial Sequence
  Synthetic
RELERVVEEARRLVEEHTEEIERSADKARKLNEEHSRRVDEIFERLERLIREAEKKN

SEQ ID NO: 17006 - protein, 56 aa, Artificial Sequence
  Synthetic
RELLEEIRKLVEESVERVKRLNEDVNRTSKESVKRLEDLVDEIRKRVEEVVRRLKK

SEQ ID NO: 17007 - protein, 56 aa, Artificial Sequence
  Synthetic
SELERVAEEAERIVREAEEKIKKSVTELKELVKRHSERVKRIFKELEELLRRLREK

SEQ ID NO: 17008 - protein, 56 aa, Artificial Sequence
  Synthetic
EDLLREVRKKVEEVVKKIKRLNEEVNRDVKRSAEELKRLIDDIRRILKKVIDDLKT

SEQ ID NO: 17009 - protein, 56 aa, Artificial Sequence
  Synthetic
DEMEEVVKRAEEIVKEARERIEESFRRLREENKEALERLKRIAEEMRRLLKEVLER

SEQ ID NO: 17010 - protein, 56 aa, Artificial Sequence
  Synthetic
EELLRRVEKEVRRVEEEIRRLNKEVNETSDRVEREAEKLVRELEEAVRKVVEDLER

SEQ ID NO: 17011 - protein, 59 aa, Artificial Sequence
  Synthetic
DLEEVIKEARKRLEDSHRRLEKLIREVEKEHEDSHRKLRELVERVKKKHKEVEEKIKRN

SEQ ID NO: 17012 - protein, 56 aa, Artificial Sequence
  Synthetic
VEELLKDLERMVRELNEEIERALEDAKRNVDRLDDEIRKLEERVDRNVKRLEEDIK

SEQ ID NO: 17013 - protein, 59 aa, Artificial Sequence
  Synthetic
SLEDVAREAKKRLEDLKKKITDLIREARRKHKESHDRLRELVEKIKEDLKRVLKKLEDD

SEQ ID NO: 17014 - protein, 56 aa, Artificial Sequence
  Synthetic
VREVKEKLRRTVEALDERIDKLRKELDENVRRLDKEIEDMVRKAKKVVDELREEIR

SEQ ID NO: 17015 - protein, 59 aa, Artificial Sequence
  Synthetic
DLDEVVKEVDRRLEESHERLRRLIKKVDEDHRRSHEDLKRVIDEARRLLEEVLERLRRN

SEQ ID NO: 17016 - protein, 56 aa, Artificial Sequence
  Synthetic
VEEVLKEVKKAVEKLNEDIDRLFEKARENVKRLDEDIKRLLEELRRKVKKAEDEIR

SEQ ID NO: 17017 - protein, 59 aa, Artificial Sequence
  Synthetic
DLERVVEEVKKLLRDSHEEHKKVVKEVKERLDRSHKESKRVSDEVRKKLEEVLKELEDR

SEQ ID NO: 17018 - protein, 56 aa, Artificial Sequence
  Synthetic
VEKVLRDVRRVVTELNKHIEDLKRKVTEDVERLNTEIKELKKRNDEAVRRAREEIK

SEQ ID NO: 17019 - protein, 60 aa, Artificial Sequence
  Synthetic
KEDEDLDRDVKRHIEETEKRVKEVEKRHKDEIRKVREDVKDVERRHKEKIDDVRRKLRDG

SEQ ID NO: 17020 - protein, 55 aa, Artificial Sequence
  Synthetic
EEILRKLRKRTEEIKREAERIHDRTREEIEKIKRDLDEIHKRTREVIKELEERSR

SEQ ID NO: 17021 - protein, 60 aa, Artificial Sequence
  Synthetic
KKEEDIEREIRDHIRRTREKLEKLAKELRDDIRRLREELKRIEDEIREESKRLEDILRKG

SEQ ID NO: 17022 - protein, 55 aa, Artificial Sequence
  Synthetic
EDILRRLREETEELRKEAERLLREYKRLTEELARELRELVKKLEEEVRDLERRSR

SEQ ID NO: 17023 - protein, 60 aa, Artificial Sequence
  Synthetic
SEEERIEEDIRRHIKRTRDRLDELRRRLEEDIKRLRERVEDLKRDLERNIRELRDRLRRG

SEQ ID NO: 17024 - protein, 55 aa, Artificial Sequence
  Synthetic
EEILRRMERLTRELAKDADRLLKKYRKLTEDLKRELEKILKTYRDLTEELKERSR

SEQ ID NO: 17025 - protein, 56 aa, Artificial Sequence
  Synthetic
SELDELRKRIEEAAKELKKRLEDHKRRLEEAEERFERDLERIHRRSREVVRDLKER

SEQ ID NO: 17026 - protein, 62 aa, Artificial Sequence
  Synthetic
DRILREVEDIVRKLKEILKEVRDRLRELSKRLEDRLKEVEDKLDKDVKDVEEELRRILEERK

SEQ ID NO: 17027 - protein, 61 aa, Artificial Sequence
  Synthetic
SRLEKAEEDIKRYIEEHKRRSEETLKELTDKAREITRRLDESLKTVEDTSREIKKDVEDRG

SEQ ID NO: 17028 - protein, 59 aa, Artificial Sequence
  Synthetic
EDLRRVIKRIRELLERLEREDRRIIEEIKKLLDRLKKKVEDIIERIERSLKRLEEELRR

SEQ ID NO: 17029 - protein, 60 aa, Artificial Sequence
  Synthetic
SEEELLRKLEEISRRVTRALEKLLEDHERLSREVAERLEDLLRRHKKLLEELIKLAEERV

SEQ ID NO: 17030 - protein, 56 aa, Artificial Sequence
  Synthetic
EEELDERIRRLKDKNKKNLDDLREHSKEVLERNKENLDELRKHSKKVLDEARKELK

SEQ ID NO: 17031 - protein, 59 aa, Artificial Sequence
  Synthetic
DEKERAKEEVKKLRDDAEKTDRDLEKEVEDTARELKETLERLRREVERLEEELERISRR

SEQ ID NO: 17032 - protein, 55 aa, Artificial Sequence
  Synthetic
KDLTEELKRVLDDHERTLRKIEEDLRRILEEHKKETKKITEELERILEKMRKDEE

SEQ ID NO: 17033 - protein, 56 aa, Artificial Sequence
  Synthetic
STKEELLERAKEIIKRLEELLRRNNRTLREILKDLKKRLEESNREIKRLIDEVTRN

SEQ ID NO: 17034 - protein, 56 aa, Artificial Sequence
  Synthetic
DEDLRRELERLKEEVDRAHKESEEIVKKLEKRIRDAIRRSKKRVDELEKELREAEK

SEQ ID NO: 17035 - protein, 56 aa, Artificial Sequence
  Synthetic
SEKEEVDETLRRLEEEHERVVRDAKRRLEEDHEKLRRVIRDSDRINDEINKKAEED

SEQ ID NO: 17036 - protein, 56 aa, Artificial Sequence
  Synthetic
AEELKRILDETRERIRESMEEIKRKLEESRRESEDIRRKLKEDNDRLKKELDDRAK

SEQ ID NO: 17037 - protein, 59 aa, Artificial Sequence
  Synthetic
SSEEEIRETVKRLKEIVKKHKKDVDEIAEELRRIVEELRRRNEEEIKKIRKILRELEEK

SEQ ID NO: 17038 - protein, 59 aa, Artificial Sequence
  Synthetic
EKLVRELERIVEEIKEELEKSDRELEKIIREIAKRLEEIHEETERAVREVKKRLDEVAK

SEQ ID NO: 17039 - protein, 56 aa, Artificial Sequence
  Synthetic
SEEEKLLERLERTVERLEREARRLLEKSKEKLKRLEDSSRELLDKLRKEVERLRRE

SEQ ID NO: 17040 - protein, 59 aa, Artificial Sequence
  Synthetic
EDFLRELEKLLEEIKRKIEEARERLERSNKELEDVIRDSERRLRKLLKEIEEVIRRKAT

SEQ ID NO: 17041 - protein, 56 aa, Artificial Sequence
  Synthetic
SEIERLLERLKKALEEIKRSSERLIRKLEEVLRDLEREVRKLLEDSRRTLERIRKE

SEQ ID NO: 17042 - protein, 59 aa, Artificial Sequence
  Synthetic
RDAVEELERLLKEIEKTIEESRRRLEELLERIERLIRKVIEELRRSNEELERVIREKSK

SEQ ID NO: 17043 - protein, 59 aa, Artificial Sequence
  Synthetic
KVEKRLRELVERIRESHERVLREVERLVEEHRETLKRILDRIREILKRIEEDIESIRRR

SEQ ID NO: 17044 - protein, 59 aa, Artificial Sequence
  Synthetic
EEVVREELERLERNIKESRDDIRRALKELKDTNEKAKEELERKLEELDRDLKRLREEAR

SEQ ID NO: 17045 - protein, 60 aa, Artificial Sequence
  Synthetic
SEVEDELRKSRKEIEDLAREAERELEEIKRHIERSERKAKEDIDRIEREIEELDKLRKEN

SEQ ID NO: 17046 - protein, 56 aa, Artificial Sequence
  Synthetic
EKALRKSHKELEDLVREVEKKLRELLERYRKRIEEVAKKLDDLLDKLREVVDRAKK

SEQ ID NO: 17047 - protein, 59 aa, Artificial Sequence
  Synthetic
SEVERELKRIKDEIRELAREAREDLERIKEHIKRSKERVEEELRRSEEEIKEIERLARE

SEQ ID NO: 17048 - protein, 56 aa, Artificial Sequence
  Synthetic
KDDLDRLLEELERVVREVKKRLRKLLEDYKELVDRVRKKLEDSHRRLKELAERTKK

SEQ ID NO: 17049 - protein, 60 aa, Artificial Sequence
  Synthetic
DVERELDRIHREHEELLRDIEKKLREILREHEELLKRIKEELDEILERLRKLVEDVKREK

SEQ ID NO: 17050 - protein, 59 aa, Artificial Sequence
  Synthetic
EEEVRDILRRLKEEIDRSRREAEEILRRLKKEIEDTKREVDETKKDLKRTLDEIREEAK

SEQ ID NO: 17051 - protein, 59 aa, Artificial Sequence
  Synthetic
SEVEEEVERIDRNIDRLRKEVEDNIRRSEEEIKRIKEEVEKNLEDLRREIDRIRELVEA

SEQ ID NO: 17052 - protein, 60 aa, Artificial Sequence
  Synthetic
MERMKRKLKELLDKHKKLVDDAKKKHDDSNRKLERLIREATKEHKKALEDLKKLIDDSRR

SEQ ID NO: 17053 - protein, 61 aa, Artificial Sequence
  Synthetic
KDTEEAEERWKAKDKKLEDDVRENLKRLREEITRLEKEVKDNVRRIKELIDKLRRDVEREG

SEQ ID NO: 17054 - protein, 59 aa, Artificial Sequence
  Synthetic
EEAKDSLRKLKKHSDDTVRRVKEEHERVLKEAKELLDKVEKEHRRLLEELERLLREARK

SEQ ID NO: 17055 - protein, 61 aa, Artificial Sequence
  Synthetic
SEEDKERKKWERRDEELRKRVERNEREWERADKELEEEVKREVERIRREIEELRRRVEKDG

SEQ ID NO: 17056 - protein, 59 aa, Artificial Sequence
  Synthetic
DEARKELERLLEHSRKLLEDVRRSHEELVKHSKERADRIRETLKKLLDDLRKLLEDARK

SEQ ID NO: 17057 - protein, 61 aa, Artificial Sequence
  Synthetic
SDIERRKEEWKREDEKLEKRSRKNVEDWERRDEELKRRSEENVRRIKEMIERLEDRVRRDG

SEQ ID NO: 17058 - protein, 59 aa, Artificial Sequence
  Synthetic
EEARKELEKLLRNSKRLVDESERRLRELERHSRELLKRSRRELERLMKELEDLAREIRR

SEQ ID NO: 17059 - protein, 59 aa, Artificial Sequence
  Synthetic
RESEKIKEDMDRSNEKHNKEVEETLKRLEEELKRLEDEVRDAKRELDELLERLERRARD

SEQ ID NO: 17060 - protein, 59 aa, Artificial Sequence
  Synthetic
KELEDLARDVAKKNKESVDRVKKELKRVDEEVKRLLDEVKKDLDKVREDLKRVIDEIRR

SEQ ID NO: 17061 - protein, 61 aa, Artificial Sequence
  Synthetic
SEVEKVITEVEELVREYRKRLEDKRREAKKRVDEYEERLKRMEDEVRKLLEEIERRIRKDG

SEQ ID NO: 17062 - protein, 56 aa, Artificial Sequence
  Synthetic
KDALRRAEEKLKKLIKENKEINDEINERSKELNERSKEVLKKIEEDLRRLIEEVRR

SEQ ID NO: 17063 - protein, 59 aa, Artificial Sequence
  Synthetic
SREDLVREVRERLKKLLKHSAELIKRVKEELEELLRHSEENVREVKKRLDEIKEEAKKR

SEQ ID NO: 17064 - protein, 56 aa, Artificial Sequence
  Synthetic
IEDERRAVEETEERWRRKDDTVRKEVEEEKEKWRREDEKHHRDVERALRKLKRDIE

SEQ ID NO: 17065 - protein, 59 aa, Artificial Sequence
  Synthetic
DEDELVREAKDRLDKLLEHSRKNVEEAEKRLRDLLEHSKKNVEEAERLLEEIEEEARRS

SEQ ID NO: 17066 - protein, 56 aa, Artificial Sequence
  Synthetic
LEEVRKEVKKEIDDWRARDEEHHRDVKRREEEWERKDEEHHRKVEEVIERLKRELK

SEQ ID NO: 17067 - protein, 59 aa, Artificial Sequence
  Synthetic
SVEELIKEVEERLKRLKEHSEDLAREVRERHKKLIEELRRILEEVKKRHKDLTEKLEKD

SEQ ID NO: 17068 - protein, 55 aa, Artificial Sequence
  Synthetic
EEMKKRVEEEEKKWKRDDERLEKRVRENIERLRRLLERLRKRVEDNIKRLDDERR

SEQ ID NO: 17069 - protein, 59 aa, Artificial Sequence
  Synthetic
REEDLIREVERILEELLKHSKRLIDEARDSHRRLLEHSKRLVEEVERLHKELLDRAREN

SEQ ID NO: 17070 - protein, 55 aa, Artificial Sequence
  Synthetic
DRMREEVRKTEERWRDKDRELEKRVRDNERRWEDRDRKLEKRVRDNIKRLRDELE

SEQ ID NO: 17071 - protein, 59 aa, Artificial Sequence
  Synthetic
KAEELVEKVRRDLEALLEHSKTLAEKVRRDHRKLKEELKELLERVKRRLEELKKRLEDS

SEQ ID NO: 17072 - protein, 55 aa, Artificial Sequence
  Synthetic
DELRKKVDEDRRRWEEDDRRLEKRVRENLRRLEKIIKDLEDRVRREVEKIDKDRK

SEQ ID NO: 17073 - protein, 59 aa, Artificial Sequence
  Synthetic
DREKLIEEVKDRLRRLLKHSRELLKEAEDRHRELLKHSERLVRESERRLEELLRRARKS

SEQ ID NO: 17074 - protein, 55 aa, Artificial Sequence
  Synthetic
DEVRKEVKKDEDDWRKADDDLRKRVEDNVRRWEERDRELKERSERNLEKLERERK

SEQ ID NO: 17075 - protein, 59 aa, Artificial Sequence
  Synthetic
SREDLVRRVDKALRDLTRHSEELMRRSDETLKELLKHSRRLAKESEDRLKELLDEARER

SEQ ID NO: 17076 - protein, 55 aa, Artificial Sequence
  Synthetic
ERLEEKVRREEEEWKKKDEELKKRSEKNVDEWRKRDDKLRRDSKRNLDKLREEIR

SEQ ID NO: 17077 - protein, 55 aa, Artificial Sequence
  Synthetic
SLVDEIRERVRRLDEDVRRLIEEIEKRIREIDKRAEDLIRKIEDDSRRTLEEVAK

SEQ ID NO: 17078 - protein, 58 aa, Artificial Sequence
  Synthetic
EELEKVVEENERSLRELVKTLEDVLRKNDKTVKELEKRLREVLDRTRRFMEELIRRAR

SEQ ID NO: 17079 - protein, 55 aa, Artificial Sequence
  Synthetic
SLKDKIREDSERTLKTVERLLREIEKEIRKLDRDIERLIEEIRRRIEKLDKDIER

SEQ ID NO: 17080 - protein, 58 aa, Artificial Sequence
  Synthetic
EELEKVLKDTRDEAERLKEEVRRVLEDNDRTAKELRKTLEEVLKRNEESARELKKRIT

SEQ ID NO: 17081 - protein, 56 aa, Artificial Sequence
  Synthetic
DEERRVEEELREVDKRLKKLLEESKRKLDEVIRRVREVVKKLKKRLDDVNRLVARD

SEQ ID NO: 17082 - protein, 55 aa, Artificial Sequence
  Synthetic
EKILRTVEKLVRDIERELRETNKRVREDVEKIIEDLKRILEENDKRADDWRRADK

SEQ ID NO: 17083 - protein, 56 aa, Artificial Sequence
  Synthetic
DESEEVARELEKVDRDVDKLVKDSRKELEDSNREVEELLRRSTERLKEVNTLVARD

SEQ ID NO: 17084 - protein, 55 aa, Artificial Sequence
  Synthetic
EKLVREVERRVEDIKRKAEKTLDDNRKLIEEWVRRLEKSLEDNRRLAKKWKDEDK

SEQ ID NO: 17085 - protein, 57 aa, Artificial Sequence
  Synthetic
SELDELKKEVDDVAREVRRHNKKLEEEVEREVRRMRRHNEENVKRVEESAKEARKDV

SEQ ID NO: 17086 - protein, 56 aa, Artificial Sequence
  Synthetic
LREVKKLVEEVTRRLERINKELERLIREVRKRMERVNDELHKRNRDVERKLREVVR

SEQ ID NO: 17087 - protein, 57 aa, Artificial Sequence
  Synthetic
SELEALEEDVKRVVKEIKDHNEKLIRELEETIRRIDRHNDENIRRTEEEIKRVLDKK

SEQ ID NO: 17088 - protein, 56 aa, Artificial Sequence
  Synthetic
EEDLRRLLEKLKEDLRKVNEDLERLLREAKRRLERVNEKLHELSRRIREKLEEVDR

SEQ ID NO: 17089 - protein, 57 aa, Artificial Sequence
  Synthetic
SELEKLVEKIKERVERARRHNERLREDVERVLTESDKENKDLIDDARRAVKEVLDRK

SEQ ID NO: 17090 - protein, 56 aa, Artificial Sequence
  Synthetic
EEELDRLIREIIKELEDVNRTLRKLLEEIKRRSKDVNRDLRRLLEEIKEKLRRKSK

SEQ ID NO: 17091 - protein, 57 aa, Artificial Sequence
  Synthetic
SEIDELKKDVERRVREVEETNRRLEKEVRERLERSRKHLKELIEDARREVERVEREV

SEQ ID NO: 17092 - protein, 60 aa, Artificial Sequence
  Synthetic
KKKVLDELKKVIKEVEDRLRKIDEELKKVIDEVRKELEKINRDLERVIREVKKRAEEVRR

SEQ ID NO: 17093 - protein, 57 aa, Artificial Sequence
  Synthetic
REIEELAKTVRKEVDDSRKHLKELREDAKRTLDEVKRETKKLEEDVRREVERVKREV

SEQ ID NO: 17094 - protein, 60 aa, Artificial Sequence
  Synthetic
KEKVLRELKKVIDEVRKLLEDINRELEEAIRDVKRKNEDTLRELRKVIKEVEKRLKDVTR

SEQ ID NO: 17095 - protein, 58 aa, Artificial Sequence
  Synthetic
KEVEDVVRELKKSLEENEKRVRDIERELREVVKKIAKRVEETREEVERMLEEIRRRSG

SEQ ID NO: 17096 - protein, 56 aa, Artificial Sequence
  Synthetic
IKKVVDEARKVLKEVHENTERIVDEARKLLKRMEEKNRKTEEDIRRVADEVREKAR

SEQ ID NO: 17097 - protein, 58 aa, Artificial Sequence
  Synthetic
SKVDKVREEVTRSLEDNKRKVEEIEREARESLERNRKKVEDSIREARKVVEEIERKKG

SEQ ID NO: 17098 - protein, 56 aa, Artificial Sequence
  Synthetic
IDTVTRRIREVMKKVHDNTRRIAEELRRLMKRVHDNTERSHEELKRLLEEVKRKAD

SEQ ID NO: 17099 - protein, 58 aa, Artificial Sequence
  Synthetic
REVEEVVKELKKSLDDNRDEVRKIIEEVTRLNKRNEEDVKRVTDEAEEVVKRIVEKKG

SEQ ID NO: 17100 - protein, 56 aa, Artificial Sequence
  Synthetic
IRKVVEEARRLLERVHRNTKRVADEIRKLDKRSSELLDKILKDLRKLLEDVEREAR

SEQ ID NO: 17101 - protein, 63 aa, Artificial Sequence
  Synthetic
DEKDEVRRRVDRELEDVHRETKKSSDDDKRLLEDVHRKLKESEKEVRRIADEVRKKLEDVRRR

SEQ ID NO: 17102 - protein, 55 aa, Artificial Sequence
  Synthetic
REVLEKIKRSLDENKERVEKSKKDSDDSLRENKDRVDKTDEEAKEMIKDLKRKTD

SEQ ID NO: 17103 - protein, 63 aa, Artificial Sequence
  Synthetic
DEKEKVTREVRRILEEVDKRLEESRERVERIAEEVHRRTEESHRRDEEVVERVKEELKEARRD

SEQ ID NO: 17104 - protein, 55 aa, Artificial Sequence
  Synthetic
REVLEELKRELRRLEEDVRRTDRKLEESLKDNERKVRRSKEESDRLLRELEERTR

SEQ ID NO: 17105 - protein, 63 aa, Artificial Sequence
  Synthetic
KEVEDVRRRVEKILEEVHKKTREVTERVRRILEEVHRKTEESHRRDEEVMRRVRDELEKARRR

SEQ ID NO: 17106 - protein, 55 aa, Artificial Sequence
  Synthetic
REVIEKVKESLRENERRARKVEKEIRDSLERNRERVEDSKRTSKKLIEDLREAVR

SEQ ID NO: 17107 - protein, 63 aa, Artificial Sequence
  Synthetic
DEEKELVRELRDILKKVHKETKESSDTDREVLKRVHEDTERSHRDDERVVEEVKKELDKIRDR

SEQ ID NO: 17108 - protein, 55 aa, Artificial Sequence
  Synthetic
REVEDEVRRSLEDNRRRVEESKRRSDESLRRNKRKVERSKEESDRLLKELEDEVR

SEQ ID NO: 17109 - protein, 57 aa, Artificial Sequence
  Synthetic
REVEEALKRNEAVVEESREAVERALRENETMVRESEKEAKRVKDENRKSIEELKRSN

SEQ ID NO: 17110 - protein, 59 aa, Artificial Sequence
  Synthetic
EEVLERVVRKLKELDDKSREDLEKVKKELRDVDTRSEELLREVEKRLREVDDRLRREEE

SEQ ID NO: 17111 - protein, 57 aa, Artificial Sequence
  Synthetic
SEVEEVEKENKKMVEESERELEKLERENDKLLKESEDEARKVEEELKRVVEELDRSN

SEQ ID NO: 17112 - protein, 59 aa, Artificial Sequence
  Synthetic
EEVLREVVKDLRRVDKESKERLKRMADKLRDVDRELKEKLKRALEDLRRIVTELRERAR

SEQ ID NO: 17113 - protein, 60 aa, Artificial Sequence
  Synthetic
DEVETVTRELEDTNRDIEKKVEEVERELRKTDREIREKVKRVEEELTRSDRELAEIVKKK

SEQ ID NO: 17114 - protein, 59 aa, Artificial Sequence
  Synthetic
GEDVKRIVEKARKINEDVRREIEKITEEVRRINEEVDDRIRRIAEEARRINEKVKRRLT

SEQ ID NO: 17115 - protein, 60 aa, Artificial Sequence
  Synthetic
KEVDDVAEELRRTNKEIKDRVKDVLRELEELLTDIEKTVRDVERELRESDERLEREVRRK

SEQ ID NO: 17116 - protein, 59 aa, Artificial Sequence
  Synthetic
GEEVRRIVEKARKINTEVKKKIEEIEKTVRKILKEVRKIIKDIRDEARRINEEVRKKLE

SEQ ID NO: 17117 - protein, 56 aa, Artificial Sequence
  Synthetic
KEVEDIVRELEEEVEKIRDHSRRVSEELDKSVKDNKRRVDEVKKTLEKSVRDIRRK

SEQ ID NO: 17118 - protein, 58 aa, Artificial Sequence
  Synthetic
EVLKDVARRAREMLEEVRRKDRENTERARRLLEEVHRRTEEVERRAREVLKKADEDVK

SEQ ID NO: 17119 - protein, 60 aa, Artificial Sequence
  Synthetic
SELDELRKRVRDLDERLKESDDTLRKLVKELIERVKKSDTELERLVERVIEEIERVLRDR

SEQ ID NO: 17120 - protein, 60 aa, Artificial Sequence
  Synthetic
VKDRLRELEEELRKRMKESDERNRDLRRRLEEMIKDSKRTNDELKKRVEKVAREAEEKLR

SEQ ID NO: 17121 - protein, 60 aa, Artificial Sequence
  Synthetic
DELERLEEEVEEVRRRLEKSDDDLRKLVDEVERRLRESDKRLHDLSEEVIRRIEDVLRKN

SEQ ID NO: 17122 - protein, 60 aa, Artificial Sequence
  Synthetic
VKDELRKLKEKIKKVADESRRRNEELRRKVDKVIKDSRETNKRNTEEVRKVAKDVDDTVK

SEQ ID NO: 17123 - protein, 60 aa, Artificial Sequence
  Synthetic
SEEERIAKEAEDLVRRVKENNARTIKEAREVARKVEAETKKIHDDARKLVEDVKRKVERR

SEQ ID NO: 17124 - protein, 55 aa, Artificial Sequence
  Synthetic
RELKERLERVIKEIEETIRRSARELDEVNRRNEKMVKENEDELRKVIEEIERRIR

SEQ ID NO: 17125 - protein, 58 aa, Artificial Sequence
  Synthetic
DEEEEIKKELRRVAEDVKRETKRIHEEIRRVLKEVKERLKRVHDELRRVAREVKEKLK

SEQ ID NO: 17126 - protein, 55 aa, Artificial Sequence
  Synthetic
RELTEEAKKLIKENEEEIERNEREARKVIEELERVVRTNKEDVKRVEKEIEDATR

SEQ ID NO: 17127 - protein, 58 aa, Artificial Sequence
  Synthetic
KEVEEIAKEAEDVLRRLDETVKEIADEAREVLRRLNESSKRIEEEARKAIKELRDRAR

SEQ ID NO: 17128 - protein, 59 aa, Artificial Sequence
  Synthetic
KDELRKILKEVRDVLEEVKRRNEDILRRLRKIAEEVKRRNDKIREELERVLKEAEDRLR

SEQ ID NO: 17129 - protein, 55 aa, Artificial Sequence
  Synthetic
SRLEKIKDDVKRLDDDSRRTLEEVHRRNKETARRVERLLEEAHRLNKKTVDEARS

SEQ ID NO: 17130 - protein, 58 aa, Artificial Sequence
  Synthetic
DEIRKIKTDVKEMVKKNREDVKRNNEDVKRVEDKLRKELKKNDDDVRRVLEELERRLR

SEQ ID NO: 17131 - protein, 60 aa, Artificial Sequence
  Synthetic
SEIEEVTRRLEELVKTVREVLREAHERTRRLVEKVRKLIEDVIRTNRKIKERVRELLERV

SEQ ID NO: 17132 - protein, 58 aa, Artificial Sequence
  Synthetic
DEIRKLRRRVEEVVRELEEELEKDRREVEKVIEELEREVDRSNEETRRVVKRLREEVE

SEQ ID NO: 17133 - protein, 60 aa, Artificial Sequence
  Synthetic
REKEEVRRKLREAERRVEEIDRRLEKLIRDVKRRVEEADRESEETSDRVRKEVERVDRRG

SEQ ID NO: 17134 - protein, 55 aa, Artificial Sequence
  Synthetic
EEVKERLKKVLEDNRRSIDELRRRIEEVLKENKRTVEEDKKRLEKVLEDVERRAR

SEQ ID NO: 17135 - protein, 56 aa, Artificial Sequence
  Synthetic
SDTEEVEKLTEEIVREVKRLDEEVKELIKEIRKESRRTLEEVRRLIEEVRDRVEKI

SEQ ID NO: 17136 - protein, 59 aa, Artificial Sequence
  Synthetic
SKDLERLRRELEEVLKENADSIRKLETELRDVLRRTREEAEKLKEELKDVLRRVEEKAK

SEQ ID NO: 17137 - protein, 60 aa, Artificial Sequence
  Synthetic
DEERKIREEAKRADDEIRRLLEENKRALDESNKRAEELVKRLADEVREALKRIEDLLRER

SEQ ID NO: 17138 - protein, 56 aa, Artificial Sequence
  Synthetic
VKKVVERLRRLIKEVKKRLEKIHEDSRRMVEESEKLLKEIVRKLRELIKEVEDKVK

SEQ ID NO: 17139 - protein, 60 aa, Artificial Sequence
  Synthetic
DEKEDLKRTAEESDREAKKLLDENRKRLEESNKKAEDLVRRNEETLRKVDTDIKDLLRKR

SEQ ID NO: 17140 - protein, 56 aa, Artificial Sequence
  Synthetic
VKKVLDELRRLVEESKELLKRIHDESEKMVEDSERLLEEVHRRSREVVERVREKIR

SEQ ID NO: 17141 - protein, 60 aa, Artificial Sequence
  Synthetic
SEKDRLSKRAAESDEELERLVRRNAEELDRSNKEIADLLKESKDTLKRAEDEIRRLLAER

SEQ ID NO: 17142 - protein, 56 aa, Artificial Sequence
  Synthetic
VEKVLKELEDVVKKSKELLERIHKESKEMVERSKRNNEKSLEDVRRLIERVLEKLK

SEQ ID NO: 17143 - protein, 60 aa, Artificial Sequence
  Synthetic
DEKRRLKEEAKKSDDELRKLVKDSADRLEDATRRIEELLRENAKRLEEAEKRIREELDKR

SEQ ID NO: 17144 - protein, 56 aa, Artificial Sequence
  Synthetic
VEEVLRRLKDLVERSKENNKRSLEEVERLIKEVEERLKRIHDESEKVVRTVEERLK

SEQ ID NO: 17145 - protein, 60 aa, Artificial Sequence
  Synthetic
REAEEIKKRLERVREEVEKELERIHRETDKIAKDVKRELDEIDKESKKVAEEIKKVAEEI

SEQ ID NO: 17146 - protein, 57 aa, Artificial Sequence
  Synthetic
KVDELKRRVEEVKRDLERKVRENNETIKKVKEDLRREVERNHKTIEDIKRELDERVR

SEQ ID NO: 17147 - protein, 60 aa, Artificial Sequence
  Synthetic
SEAEELLDRIRRVAEEVKRRLEEIHRTTRDIVRRIEELLKEIHERTREIVERIKRVLEKI

SEQ ID NO: 17148 - protein, 58 aa, Artificial Sequence
  Synthetic
DKVKRLEEEIRKIKRELEKIVRDNNEDIKRAKERLRKINKRNHDEIKKVKDELDETVR

SEQ ID NO: 17149 - protein, 60 aa, Artificial Sequence
  Synthetic
SEAEDLRRRIEEVARRVAEKLKKINRDTERIVRDVKKKLEEIHKRTEEVAEEVKEVLRRI

SEQ ID NO: 17150 - protein, 58 aa, Artificial Sequence
  Synthetic
DEVEELRKTIEDIRRRLEEEVRRNHDEIRKAEEELRELNRRNHERIKEIKEELDREVT

SEQ ID NO: 17151 - protein, 60 aa, Artificial Sequence
  Synthetic
SEVEKIDKRAKEVEKELEESNRRNRERIKEADERLRDLLRRNKEEIDRARKRLDEIVRRD

SEQ ID NO: 17152 - protein, 59 aa, Artificial Sequence
  Synthetic
KKRLKEVERRMEEIVKTVKKRSEDSHRESDEIVKRVLERLRKVHEETKEIVKRVEDRLR

SEQ ID NO: 17153 - protein, 60 aa, Artificial Sequence
  Synthetic
EEAERIDKKLEDEVREVERELEDVHRKVKEILEDVKRKHKKVHDELKKVIDEVKRKLEER

SEQ ID NO: 17154 - protein, 55 aa, Artificial Sequence
  Synthetic
KELEEKVRRIVRKLERRVEKNKDDTRRAVEEAEKLNEDNKRTSEKVEEDLRRTTT

SEQ ID NO: 17155 - protein, 60 aa, Artificial Sequence
  Synthetic
SEAEEIVRELRKAVEDVAREHKRIHEEVRKAAEDVKRKLKEILDRLERVVEEVARALEER

SEQ ID NO: 17156 - protein, 55 aa, Artificial Sequence
  Synthetic
DELREEAKEVVRDVRRLNEENRKATEDILRELKEIVERLERRAREVVKELKERAR

SEQ ID NO: 17157 - protein, 60 aa, Artificial Sequence
  Synthetic
DEREEIRRRLREDVKRVKRRLEEIHDEVRRLLEEVDRRLRKVHKELKEEVTEVEKRLRER

SEQ ID NO: 17158 - protein, 55 aa, Artificial Sequence
  Synthetic
RELKKEIDDVRKELEETVERNKRETERALRKAKEDLDRNREEVKRVVDELEKRTR

SEQ ID NO: 17159 - protein, 60 aa, Artificial Sequence
  Synthetic
SEKDEIRDELEKILRRVEELNRRIRKKLEEIRKEVERLLREIHEKLEEVVKEVEEKLRER

SEQ ID NO: 17160 - protein, 55 aa, Artificial Sequence
  Synthetic
EELKRRVEEVLKRARESLRELEEDVRRVLEEARKELERNRERVERVLRRLEETVR

SEQ ID NO: 17161 - protein, 59 aa, Artificial Sequence
  Synthetic
DEVEDLERRLKEVVDRSRRLDEELKRRDKKSVEDVRRKLEEVRKKLEDVARKLADLLRQ

SEQ ID NO: 17162 - protein, 55 aa, Artificial Sequence
  Synthetic
EKLERDVARAREENDRTLKEISKHSEKVLREVADMARKLRKEVKRIEDEIRERAR

SEQ ID NO: 17163 - protein, 60 aa, Artificial Sequence
  Synthetic
KLVEEVKREIEELVRRLEEVLDRVRRENERLAEELKKVVKDVEDNNERIARTVTELLKKV

SEQ ID NO: 17164 - protein, 59 aa, Artificial Sequence
  Synthetic
KEKVDELKRDVDRAEEKVRELIERIKRRSEEVKKRAEELLKKLEDDSRRVKKKLDDDAR

SEQ ID NO: 17165 - protein, 60 aa, Artificial Sequence
  Synthetic
SEVDEVRKEIKRLADEAREVVKEVRKNNEKIADDSRKLNERSIRESKKVTDTVRELLKRV

SEQ ID NO: 17166 - protein, 59 aa, Artificial Sequence
  Synthetic
EERVKELKERVDEVSKELRDLLKKLRDDSERVVEENEKLLRELKERSDRATKELDDASK

SEQ ID NO: 17167 - protein, 60 aa, Artificial Sequence
  Synthetic
KKAEKVDKEIEDLAREVREVLKEVEKDSDRLVKEVEDVLRRVKENNEDIRRRVSELDRRV

SEQ ID NO: 17168 - protein, 59 aa, Artificial Sequence
  Synthetic
EESVERLRRKVKEIEDELRELLERLRKKSEDAKRKLRELLERIKRDSERAKRELEERDK

SEQ ID NO: 17169 - protein, 59 aa, Artificial Sequence
  Synthetic
DTAREVKRKVKEIADEVRELIRRVHEETKKTSETVKKLIKEVHDTTEKIVREVRKLADE

SEQ ID NO: 17170 - protein, 59 aa, Artificial Sequence
  Synthetic
KKLVEELKREVDRISEELKRLLERNEREVRESKKTLERDLERNHEEIERAKRELDERVR

SEQ ID NO: 17171 - protein, 60 aa, Artificial Sequence
  Synthetic
REVDEVRKRVEKVAEEVRRLIEKVHRETERTSREVEKRIRDVHRRSDEVAREVDDLSRRV

SEQ ID NO: 17172 - protein, 59 aa, Artificial Sequence
  Synthetic
KKMVRTLAERVKEISEELKRRLKRNKDEVEESSRRLRELLKRNHDEIRRIKEKLKEETR

SEQ ID NO: 17173 - protein, 60 aa, Artificial Sequence
  Synthetic
EEVDRVKRKLEEVEKRVTEISKRTEELVEEVRKEVERISKRTEEDDRRVAKEVRERLKSG

SEQ ID NO: 17174 - protein, 56 aa, Artificial Sequence
  Synthetic
AKEIKEKVDEVIERLRRSNRKLHERIREVEKKLRELNERLHRHSREVIKELEERAR

SEQ ID NO: 17175 - protein, 60 aa, Artificial Sequence
  Synthetic
KEVEDILRDLERLSEESLRRNEEIHRELEELLRRVDEKNREIHKTLEEMVRRALTELRKR

SEQ ID NO: 17176 - protein, 59 aa, Artificial Sequence
  Synthetic
EKVVREVDRRVEESRKRLEKLLRENEKRVRDARRRARKLSEENERTVREVEKRAREEVK

SEQ ID NO: 17177 - protein, 60 aa, Artificial Sequence
  Synthetic
DEVEEIKRKLDKVADESRKLDEDIRDKLRRVADEIRRLHEESRKELEDVVREIERLLRER

SEQ ID NO: 17178 - protein, 59 aa, Artificial Sequence
  Synthetic
EKVIKEVRDTVEKILRENEKSLEEVRKTVKRIEEESRELLETSRDEVRRVLEKAEETEK

SEQ ID NO: 17179 - protein, 60 aa, Artificial Sequence
  Synthetic
SVADEIRKDLKRVADEVEERLRRLLEHNKKVRDEVKERVDESKKELKEVEEEVTEKLERI

SEQ ID NO: 17180 - protein, 59 aa, Artificial Sequence
  Synthetic
EKVVREIEERIRRVIRRLDEVDKTNEKISRDAARELEESDEELRRRVKEVKDRLDEKTK

SEQ ID NO: 17181 - protein, 60 aa, Artificial Sequence
  Synthetic
DEAEKIKKELDDVAREVERRLKELLDDNRRVAEEVEKRLRDSKRELEEVTRRVRKELERI

SEQ ID NO: 17182 - protein, 59 aa, Artificial Sequence
  Synthetic
KKLVDKIRDDIRRIARRLDEMNKKNKKLSDELEERLKKSNEEHRRRVEKVKEELEKKVE

SEQ ID NO: 17183 - protein, 60 aa, Artificial Sequence
  Synthetic
SEAEEIEKELREVAKEVRELMREMLKNNKEVAEEVKRRLERSRERLEEVEETVRDLLEKI

SEQ ID NO: 17184 - protein, 59 aa, Artificial Sequence
  Synthetic
DKVVKKIEDDIREVEKEARKLNRENRELSKKLAEELDRSNDRHRREVERVERELEKAER

SEQ ID NO: 17185 - protein, 60 aa, Artificial Sequence
  Synthetic
SLQERVRDKVRKVKKDLEDLNRRHREEIERVVRELDKSNEDHEREVRRVEKELEELIRRN

SEQ ID NO: 17186 - protein, 59 aa, Artificial Sequence
  Synthetic
KKFVEDVDRALKRIADEVKRRSEESKKELDDIKKEVEERLRESKEKLKRIVDEARERLR

SEQ ID NO: 17187 - protein, 57 aa, Artificial Sequence
  Synthetic
SELEEVIKRAEDELRDDERENKRVLEKSDRDIKRWEEEVKRVLKKARDELDKLRKEG

SEQ ID NO: 17188 - protein, 59 aa, Artificial Sequence
  Synthetic
KDVVEKLREELEKVLKESRDESKRLKEELDKVNDDARKRLEDLMRKLERVLEEVRRRRK

SEQ ID NO: 17189 - protein, 56 aa, Artificial Sequence
  Synthetic
SELERVIEEIRRALEEDHERNRDVLREAKEELERDKRRNDKVLTDIRKLVKDLERK

SEQ ID NO: 17190 - protein, 59 aa, Artificial Sequence
  Synthetic
EETVRRLTEELRKVLDEVTKRSKELSDRLREVLRRSKELSKELEKELRKVIKEADDRVK

SEQ ID NO: 17191 - protein, 56 aa, Artificial Sequence
  Synthetic
SEIERVLKEARDELRKDEEKNRDLLRRAKKVIEEDHKRNRDVLRRVKEELDRLREA

SEQ ID NO: 17192 - protein, 59 aa, Artificial Sequence
  Synthetic
KDALDRLRRELEEVLRRSKEESDRLAEELKRVLREIEERSRRLAKELKEVLDTAKRDKD

SEQ ID NO: 17193 - protein, 57 aa, Artificial Sequence
  Synthetic
SELERVIRENERTIREDMKKNEDVLREWEKLTRDLEDTIRRVLKKNRESLKRLKDKG

SEQ ID NO: 17194 - protein, 56 aa, Artificial Sequence
  Synthetic
RRELVKRLRDVDERSDDTSRKLKEELERVIRRTEELIRRVMEDAKRVDDEARKKTD

SEQ ID NO: 17195 - protein, 56 aa, Artificial Sequence
  Synthetic
SKVEEVLRELERRVKEDEDENRKVVRENERTVKEDEDTNRDALRRNEESIDKLRRD

SEQ ID NO: 17196 - protein, 56 aa, Artificial Sequence
  Synthetic
VDTLKRELDEALKRSEEESRRLKEEVTRIDERSKRESDRLVEEAKRLDKEAKDRSD

SEQ ID NO: 17197 - protein, 60 aa, Artificial Sequence
  Synthetic
SELEEVLKKAAEVIKEIEKRLRKVLEDSRRLTKEDEKRNKEVLKKLKEKIDEIEKRARDK

SEQ ID NO: 17198 - protein, 59 aa, Artificial Sequence
  Synthetic
DEVLRRLDRELKEVLDRVEREVERLKEENDRMNKKSKDDSEKLERDLERVAERLERELK

SEQ ID NO: 17199 - protein, 61 aa, Artificial Sequence
  Synthetic
SEAEKVLKEAREAAKRIEDEARKVLRESRELAKKAEEDDRRALKRAKEAAEKIKRDADRKG

SEQ ID NO: 17200 - protein, 59 aa, Artificial Sequence
  Synthetic
DKAIKEAADRLKKVLEDAEKKAREAAEENKRANEEWKKKSKRAAEEAKKVLDEAKKELD

SEQ ID NO: 17201 - protein, 59 aa, Artificial Sequence
  Synthetic
SDKERIKERVKKVHKESAKHIEDVRRRNEEINKRIKEEIDDVERRNREINEDIRRLVRE

SEQ ID NO: 17202 - protein, 55 aa, Artificial Sequence
  Synthetic
ERVIEDLERLIEENKRTLTEVIKRHRELLEDWKRRLDEVLKDHERSAREIDEEAR

SEQ ID NO: 17203 - protein, 60 aa, Artificial Sequence
  Synthetic
DEKEEVRRTVEERLKRVEDRVRELEKENEDINRELKERLKKVRRENEEINERLKKLLDEN

SEQ ID NO: 17204 - protein, 55 aa, Artificial Sequence
  Synthetic
EEVIRRVEEEIKRIEKRLRDVIKKHEDSVRKIRTDMERVVRDHERLAKKWEDDAR

SEQ ID NO: 17205 - protein, 59 aa, Artificial Sequence
  Synthetic
DEAKEIEDRVRTEIRDIERKVREARERSKRSDDELKKHSEEVARELEEILRELEEALRR

SEQ ID NO: 17206 - protein, 55 aa, Artificial Sequence
  Synthetic
KSVIDEVRKAVEDIARKLKKVLEDNKREIDKDRKRNEEVLRTAREKAEKIKEDAR

SEQ ID NO: 17207 - protein, 59 aa, Artificial Sequence
  Synthetic
DEKEKIKEDVRRVIRRIEEIVKRVDRESERSDRELEKHSRDVERRLREINDRLRRLLEE

SEQ ID NO: 17208 - protein, 55 aa, Artificial Sequence
  Synthetic
ERVIEEVKRLIDRIREELERVLEKNARLAKEDEERNERVLTENRKLIEDWEREAK

SEQ ID NO: 17209 - protein, 61 aa, Artificial Sequence
  Synthetic
SKLEEVVRRVDKDARDIRRRNEEVKRRNEKSAREIEKKVKKVLEEFRRLVEEIRKRLEEEG

SEQ ID NO: 17210 - protein, 59 aa, Artificial Sequence
  Synthetic
ERVLKELEERVRKVLKDNRDTSKELEERVRRIDEELDKTLRKAKEELRKIIRELEERLR

SEQ ID NO: 17211 - protein, 61 aa, Artificial Sequence
  Synthetic
SELEKVLERVKREAERIEKKNKKVLEENKKSAEEIHRDNERVLREVKDMADKIEDELRKRG

SEQ ID NO: 17212 - protein, 59 aa, Artificial Sequence
  Synthetic
RKVLRDVERRVKKILDDNKRTSDEMKKRLDRLDETNKRTSEKLEEDVRRIIEDLERRVK

SEQ ID NO: 17213 - protein, 60 aa, Artificial Sequence
  Synthetic
SKLEEVLKKLERLAREIERRLRDVIRRNKESADRIRKRNEEVLRKVEDVAREIEDKVRRG

SEQ ID NO: 17214 - protein, 59 aa, Artificial Sequence
  Synthetic
EEALRTLDKRVEDIIKRLKEEVDRVVRDLEELDKENEKSSREVEERLKEIIRELEETLK

SEQ ID NO: 17215 - protein, 61 aa, Artificial Sequence
  Synthetic
SKLEEVLKTLRRLIEEIKKRLKKVKDDNKKSLEDIHRKNKRVLEELEKRLRDIDKKLKDKG

SEQ ID NO: 17216 - protein, 57 aa, Artificial Sequence
  Synthetic
VLKEVEERVERIIRELRRRVEELKRRVEELDRRNEKTSDDLEEELKRIDKELKDRTD

SEQ ID NO: 17217 - protein, 60 aa, Artificial Sequence
  Synthetic
SKVEDVVRRVAEVAERIRRRNEEVAEENERSLKEIHDENKEVVERARKMAKRIEDEVRRK

SEQ ID NO: 17218 - protein, 59 aa, Artificial Sequence
  Synthetic
EEVLKTVADEVREILERNEKTSEELAERVRRLDEENRRTSREVEKRVEEVIEDLKRRLK

SEQ ID NO: 17219 - protein, 61 aa, Artificial Sequence
  Synthetic
SEVDKLEEDLRRIIKEIRRLVEEVKRKSEEIDRELKRLLEEAERTLEEIDRKLEDELRKKG

SEQ ID NO: 17220 - protein, 58 aa, Artificial Sequence
  Synthetic
DKVREVKKDVEKKLKELEEELRDITRRNRESLKRLEERLKEVAKKNRKTVDELRKELD

SEQ ID NO: 17221 - protein, 61 aa, Artificial Sequence
  Synthetic
DEVDDLKRRLEKIITEDEKLVKEVKDRSEKLDREIAKLLEDARRALEKLDKELEEILRKKG

SEQ ID NO: 17222 - protein, 58 aa, Artificial Sequence
  Synthetic
DKVREVVKRVRDEADKSRRKLEEITRRNRDSLERIKRKLERVLEENDRTLRELEERAR

SEQ ID NO: 17223 - protein, 58 aa, Artificial Sequence
  Synthetic
SELEKVVEDSRRKLDAWDDESRRVAEESRRRLEEWRKRLEEVAKRVEERLRDLKRKAG

SEQ ID NO: 17224 - protein, 59 aa, Artificial Sequence
  Synthetic
EELVKKMARELDELNKDLDRLNKESKRELERLNTELAELIKEVERELRELLRKLEEDLR

SEQ ID NO: 17225 - protein, 58 aa, Artificial Sequence
  Synthetic
DSLEDVVRRVKKKLDDNRKDVERVAKESEELLKRWRDRVKKVVRDVERRAEELRRRRG

SEQ ID NO: 17226 - protein, 59 aa, Artificial Sequence
  Synthetic
EELIKTFERTLEELHKTNKKLNEEVKKRLEELNTRLAKLIEDVRKELEKVLKELEDRAR

SEQ ID NO: 17227 - protein, 58 aa, Artificial Sequence
  Synthetic
DELDEVVREVKDRLRENKEEVKRVMDESRRLLERWNEESERVAKKVEEAVRKLTKDKG

SEQ ID NO: 17228 - protein, 59 aa, Artificial Sequence
  Synthetic
EDDIRRITKRLRDLHRENEKLNRDVKKELRELNERLAKLNRDSTRELEELLRKLEEDAR

SEQ ID NO: 17229 - protein, 58 aa, Artificial Sequence
  Synthetic
SELDKVVEESKRLLEEWDRRSKDVAKKVKEMLDRSRKASKEVVKEARDELERLKRETG

SEQ ID NO: 17230 - protein, 59 aa, Artificial Sequence
  Synthetic
EKDIREIKERLKRLNETLAELNERSKKRLKRLLDEDKKLNDDSSKELKELLKELEDRTR

SEQ ID NO: 17231 - protein, 58 aa, Artificial Sequence
  Synthetic
RELEDVARRARKKLEDNKRRVEEVAEEVERRLDESRKESDKVVREVEEVLKRLKEERG

SEQ ID NO: 17232 - protein, 59 aa, Artificial Sequence
  Synthetic
EELVKRMTEELERVHRENEKLNRDVRRELEDILRKDEELNKRSKKRLKDLLDELRRRLT

SEQ ID NO: 17233 - protein, 58 aa, Artificial Sequence
  Synthetic
SELEEVVKKVRTDLDRIDEKSKRVAKEVDRVLKESEDRSKKVAREVEEVLRKLKEEAG

SEQ ID NO: 17234 - protein, 59 aa, Artificial Sequence
  Synthetic
EDLVRRAVETLERLIRELEKLNDESKRRLEEILREDKRLNKESTEELRRLLEELRKTLT

SEQ ID NO: 17235 - protein, 58 aa, Artificial Sequence
  Synthetic
SEVERVAEELKRVLKELEDLDRESEKKLKRLNEELARLIEEVRRRLEEVLRTLEELAK

SEQ ID NO: 17236 - protein, 58 aa, Artificial Sequence
  Synthetic
REVEEVIRRIDEAIKRIEKHSREVIERSRERVEDWRRKVERVIEEVERRARKLREDTR

SEQ ID NO: 17237 - protein, 58 aa, Artificial Sequence
  Synthetic
SEVEKVAEEAKRVLDELEKLDRDSAKELKDLNDELRKRDKESEDALRKITRDLDELDK

SEQ ID NO: 17238 - protein, 58 aa, Artificial Sequence
  Synthetic
KDVEKVIRDLKRELERLAKHSEEVIRTSEELLKRWEDHSRKVIEEVKERARDIKRRTK

SEQ ID NO: 17239 - protein, 57 aa, Artificial Sequence
  Synthetic
SELEKVVKEVEEALERNNRENRRVIRRSRELLKRWREEVEEVVRRLRERAKKIADDV

SEQ ID NO: 17240 - protein, 59 aa, Artificial Sequence
  Synthetic
EEEVRKLEEDLRRILEEIDRESDRLVKRIEDLNRRVAELLKRVEEELEDLARKVEEEAK

SEQ ID NO: 17241 - protein, 60 aa, Artificial Sequence
  Synthetic
SIEEIVEEIERELEKLKRKLDELIKRSEELSRRLAEKTRRSNEEIKREIDKVADDIRKTL

SEQ ID NO: 17242 - protein, 59 aa, Artificial Sequence
  Synthetic
EDTIRRVLEEAREEIKKLERDVDKVRKEVEDAHRKNSELNKTVHDEVRKIIDEIRKEVK

SEQ ID NO: 17243 - protein, 60 aa, Artificial Sequence
  Synthetic
SIEEILREIEELIKDLLRKAEELLKESEKRSKELKDEMKRSNEEIRKLIEDLRRRAKDRV

SEQ ID NO: 17244 - protein, 59 aa, Artificial Sequence
  Synthetic
EDVIRDLLRRVREDIDRLRKELEKVVRELRRIHEEVRRDLKRVHEEVRKRIEDLEEELK

SEQ ID NO: 17245 - protein, 60 aa, Artificial Sequence
  Synthetic
KEVEDVVRRVRKLIEDNERRNKEVHEEVEKRARENVERNRELLEKIRRTVEEIRRELEEL

SEQ ID NO: 17246 - protein, 56 aa, Artificial Sequence
  Synthetic
KDLLDEVRRLLERVKRRTEESNRRVKKIVDDVKRTSEEILREVEELLRRLIDDARK

SEQ ID NO: 17247 - protein, 61 aa, Artificial Sequence
  Synthetic
DEVEKVFREVKKRIDENREKNRRVHEKVEREARRNSEENRRVHEEVRKTVEDIRRELDEKR

SEQ ID NO: 17248 - protein, 56 aa, Artificial Sequence
  Synthetic
EELLRRIEKLAREVRDETRRSNEKVKEIIRRVEKESEDSNREVKRLLDELTRDARR

SEQ ID NO: 17249 - protein, 60 aa, Artificial Sequence
  Synthetic
SEVEDVVRKAREILKRNEDENRRVLEKVREDLKRLTDENDKVVEDVREMVRRIKEMLDRN

SEQ ID NO: 17250 - protein, 56 aa, Artificial Sequence
  Synthetic
EELLREVDERIKDVKRKTDEILREVRERIKRNEERTERLRREIEELARRLLEDAER

SEQ ID NO: 17251 - protein, 59 aa, Artificial Sequence
  Synthetic
DEEDLLEKIERILEEVKRRLEDVIRRVRKSNEDIERELKKAVDRSRELLRKVEEDLRRN

SEQ ID NO: 17252 - protein, 55 aa, Artificial Sequence
  Synthetic
RDVFERLERIARRLTEEIEKALRDSDKLNEELKRKVEEVLRRSEESIRTVLEELR

SEQ ID NO: 17253 - protein, 60 aa, Artificial Sequence
  Synthetic
DEIEKVRKDVDEIIRRLEEELEEVAKRLEDLNREIERILREVKKESDDTIRTIERLRKEG

SEQ ID NO: 17254 - protein, 56 aa, Artificial Sequence
  Synthetic
ESIVKEVRDKLRRLEKRLDDLAKRNEESLRELKRTLEEIIKRSRKENKRIEDEVRK

SEQ ID NO: 17255 - protein, 60 aa, Artificial Sequence
  Synthetic
SEVEEVEKELRELIREDKERLDRLRKELKESIDTNKEKLDRVKEDLERLIEEIREEARRR

SEQ ID NO: 17256 - protein, 59 aa, Artificial Sequence
  Synthetic
RERLTKLVEKIREVLERSKEHSERVAKKIRDELDKLHKETERVDRKLKTEARRLKEELR

SEQ ID NO: 17257 - protein, 60 aa, Artificial Sequence
  Synthetic
DEVERVEEELKESIDRNDEELRRVRKENRESIEKDRRDLKRVEDDLRRLIKKIDEEVRRR

SEQ ID NO: 17258 - protein, 59 aa, Artificial Sequence
  Synthetic
EEALREVVRKLRKLLKELHEETKRVMEKLRKLDRESEEHTKEVDERIKKTIEDLERELK

SEQ ID NO: 17259 - protein, 60 aa, Artificial Sequence
  Synthetic
SEVDEVRKELRKVIKEDEDTMRKLEEENRKSIEEIRKELEKVEEELERVIRRIEDEIRKR

SEQ ID NO: 17260 - protein, 59 aa, Artificial Sequence
  Synthetic
REVLETLVRKIREELKRSKEHSKRVADDLRRMDEEIRREVKRVVDKVRELLKRLEDELK

SEQ ID NO: 17261 - protein, 60 aa, Artificial Sequence
  Synthetic
DEVEDVLRRLKELAEEDKTKLKEVEKENKESIKEDRKRLEDVRRELEKLIEEIRREVTER

SEQ ID NO: 17262 - protein, 59 aa, Artificial Sequence
  Synthetic
EKVLRDVSRRIKEEVEKSKKHSEEVKKELEDADRESKRHTEEVEKKIRELIERLKRETK

SEQ ID NO: 17263 - protein, 61 aa, Artificial Sequence
  Synthetic
DEIDRLREELKRLIDKDKTDLDRVRKENEESIRDDERKLREVEKELRDLIEEIRRKAKERN

SEQ ID NO: 17264 - protein, 59 aa, Artificial Sequence
  Synthetic
RRVLEEVARKIRELIRRSEKHSEDVMEKVRRNDERSKRHTEDVTRKIRTEIEKIDRELE

SEQ ID NO: 17265 - protein, 60 aa, Artificial Sequence
  Synthetic
KEKEDVKKRLDEEAEKNKRTSEEAKRRNRESIRRNKETSKRVKEENRRSFEELDDLLRRG

SEQ ID NO: 17266 - protein, 55 aa, Artificial Sequence
  Synthetic
KRVEEELDKLMEEIRRHNRESNEELKRLVEEIRKHNRESNEELKKLLEEIERKTE

SEQ ID NO: 17267 - protein, 60 aa, Artificial Sequence
  Synthetic
DEDKDVEKKLRDIIKRNKETSRDVARRLEEIIKRNKKTSDEVATEVRKLIKEIEDVLRRG

SEQ ID NO: 17268 - protein, 55 aa, Artificial Sequence
  Synthetic
EKVKEELRRLIEEIKEHNERVLRKLRKLVEEIERTNEDIRRELKELVEDIRRKAK

SEQ ID NO: 17269 - protein, 60 aa, Artificial Sequence
  Synthetic
SEKEEVRKRLRDKVEDNKRTSKEVADKLRKIIKENKDTSKKVMEDLRRIIEEADELLRRG

SEQ ID NO: 17270 - protein, 55 aa, Artificial Sequence
  Synthetic
DDVRRELDELVKRIAEENKRVEDELRRLVKEIEDHNEEVKRELKELVKRIEEKTR

SEQ ID NO: 17271 - protein, 60 aa, Artificial Sequence
  Synthetic
SEKEEVEREVEERLRDNKRTSDKVVEENRDSVRRNKKTSEDVKRENEESVRRIDEVLKRG

SEQ ID NO: 17272 - protein, 55 aa, Artificial Sequence
  Synthetic
EDVKRKAKRMVEEIRERNRKSNEELKKLAEEIRKHNKDSNKKLKELVDEIRRKAK

SEQ ID NO: 17273 - protein, 60 aa, Artificial Sequence
  Synthetic
DEERRVREKLKKIIKDNEDTSRKVREDVKKELDDNRRTSEKVARDNERSIEEIKKALERG

SEQ ID NO: 17274 - protein, 55 aa, Artificial Sequence
  Synthetic
EEVRRELDKLVKEIKERNDEVIEEARERVKRIREKNERSNRKLKKEAKKIEEEAR

SEQ ID NO: 17275 - protein, 60 aa, Artificial Sequence
  Synthetic
DEDREVERDLKKIIKDNKRTSEEVEKKLRDIIRKNEKTSKEVEKELRDIIRRADELLRRG

SEQ ID NO: 17276 - protein, 55 aa, Artificial Sequence
  Synthetic
EEVKKDLDRLAEEIKKRNEEVRKDLDDLVRKIEKRNEEVKEELDRLAREIEEKAR

SEQ ID NO: 17277 - protein, 60 aa, Artificial Sequence
  Synthetic
SEEDEVRRRLRRIIEENRRTSEEVRERLRKIVEDLERTSRDVRRKLREIVERIKEVLTRG

SEQ ID NO: 17278 - protein, 55 aa, Artificial Sequence
  Synthetic
REVEEELRRLIEEIERRNKEVREELDRLIEKLEDDNRKVHKELRELAKEIKDRAD

SEQ ID NO: 17279 - protein, 60 aa, Artificial Sequence
  Synthetic
RELEEVVKRIRDILREIHERSEKSAEENRRLIEKAEEDSKRSAKRIREIIREIREEVKRI

SEQ ID NO: 17280 - protein, 62 aa, Artificial Sequence
  Synthetic
RDVREKLERVAREVEKSNKDNRDHSKRVEEESRELLKKLRKHSEDVAREVKKLLDELREETR

SEQ ID NO: 17281 - protein, 60 aa, Artificial Sequence
  Synthetic
SELEKVVEDIRRLLRKIHEDSKRSVRKNEELVEELKRLSEKSEREIEELLRRIKELLKRI

SEQ ID NO: 17282 - protein, 62 aa, Artificial Sequence
  Synthetic
ERVKRKLDDVEREVRKSNEDNRKHSDEVRRKSEDMLEKLRRESERVADRVRKVLKELEDERR

SEQ ID NO: 17283 - protein, 60 aa, Artificial Sequence
  Synthetic
SELEKLAKEIEEILREAKERSKESAERIRKLVRDLRELSRESEERIRKIETDVKKKIDDI

SEQ ID NO: 17284 - protein, 62 aa, Artificial Sequence
  Synthetic
REVRRKVEDVERRVTKVLKELEDRSREVEEEVERVLRDLKRHSDEVRREVEEVLRRLTERTK

SEQ ID NO: 17285 - protein, 59 aa, Artificial Sequence
  Synthetic
SEREKIAEDIRKLVDESRRNLEDVVRRARELAERVRRNLKRVMETLERLAEEIRRIIES

SEQ ID NO: 17286 - protein, 55 aa, Artificial Sequence
  Synthetic
KDLERELKELLDKHKKDLDDVREEIRRMLETHKEELDRVKKRVEDVLREAAERTR

SEQ ID NO: 17287 - protein, 59 aa, Artificial Sequence
  Synthetic
DERERIREEVRKLARESKENLKRTEEDLKRRLEEVKRNLERVDEEVERLVRTVAEIVRK

SEQ ID NO: 17288 - protein, 55 aa, Artificial Sequence
  Synthetic
EELKKEAKKLLKEHRDKVKEIKEDLKRAHEEHRKRLEEVVEKLKRVLRDLAEKVR

SEQ ID NO: 17289 - protein, 59 aa, Artificial Sequence
  Synthetic
SEREEIVKTLRELVKRVKENLKRVTEEARKLADESRRNLERVAEEIRKIAEEVKRIVER

SEQ ID NO: 17290 - protein, 55 aa, Artificial Sequence
  Synthetic
KDLEKELEDVHREHKRRLDEVVREMEDLLRKHEDDLRKVKREAEKMLKELTETTK

SEQ ID NO: 17291 - protein, 59 aa, Artificial Sequence
  Synthetic
SEREEIAERAERLSREVKKKLEDIRREIEELAKRVLDNLRRVLRDVERLIEEVKDIIRR

SEQ ID NO: 17292 - protein, 55 aa, Artificial Sequence
  Synthetic
KKLKDDLDRADEELERRARKVDEDLKELHERHRRLLEDVRRELERVIKELKEETE

SEQ ID NO: 17293 - protein, 59 aa, Artificial Sequence
  Synthetic
SDRERIAKRARELSERVKEKLEEILKEVRKISKDMKKRLEDILREAEELSRRIKEIVES

SEQ ID NO: 17294 - protein, 55 aa, Artificial Sequence
  Synthetic
DELRKELEEVDDELRRKIEEIKKELETMDKELRDRAKEIEKRLEDSNREVEERRR

SEQ ID NO: 17295 - protein, 59 aa, Artificial Sequence
  Synthetic
SEREEIAKTVRKLSREMKETLKKITEEARRLSEEVKRALKKIVDDLRELMKDVKRIVES

SEQ ID NO: 17296 - protein, 55 aa, Artificial Sequence
  Synthetic
KDLKKELEDVDRELADTIRRVEEELKKVNEELRKRVEDVREEAERALRELEERVR

SEQ ID NO: 17297 - protein, 59 aa, Artificial Sequence
  Synthetic
DERERIAEELKKLTEEIRRRVEDVMREAERLAEEIKRKLEDVLEEVRRLSDRIREIIES

SEQ ID NO: 17298 - protein, 55 aa, Artificial Sequence
  Synthetic
DDLRREAEKVNRKVREDLKRIEDRMRELLKEVEDLLRKIEEEARKSNKELEDRTR

SEQ ID NO: 17299 - protein, 61 aa, Artificial Sequence
  Synthetic
SEAEKAREDVERAAKESKDKLDEIRKEVEKAARESREEAKRNEKDIKDAAKKLRELARDKK

SEQ ID NO: 17300 - protein, 55 aa, Artificial Sequence
  Synthetic
RDVLEELRKIAEDDKRRVDKVARELRELAKRDKEEAKKVHDENKKSAKEAEDELR

SEQ ID NO: 17301 - protein, 60 aa, Artificial Sequence
  Synthetic
SSDETLRRELEKAVEESRRLLEENRKTIEDMVRESKRLLDRNREEIKKLVEELKKLLRDN

SEQ ID NO: 17302 - protein, 55 aa, Artificial Sequence
  Synthetic
RDVLREIRELLKRDKERLKEVHKRNRESAKRDKDRVKDVHRKNRDSARRVKERLR

SEQ ID NO: 17303 - protein, 60 aa, Artificial Sequence
  Synthetic
SSDETARKEIEDMVRESKKLLEEIREELDRVVKRLRRELEENEKDIKRLVKRLRDLLREN

SEQ ID NO: 17304 - protein, 55 aa, Artificial Sequence
  Synthetic
RDVLREIRELAKRDKDTVKKVMEEIRDRLRKLDERIKEVHERNRRSLKDVEDKVR

SEQ ID NO: 17305 - protein, 60 aa, Artificial Sequence
  Synthetic
DEDREAKRRLDEAVKESRDRLEEIRKEVEKMVRENEELNRRNEEEIRKAVEELRELLRRQ

SEQ ID NO: 17306 - protein, 55 aa, Artificial Sequence
  Synthetic
RDVLREIEEELTKDRKRVKEVLEELRRIAKRLKERDEESHERNRRSLDKLKKEVK

SEQ ID NO: 17307 - protein, 60 aa, Artificial Sequence
  Synthetic
SSEDEARKEVDKMAKESEELLRRNEETIRRLVRENEEKNERNRREIERVVRELDRLLKER

SEQ ID NO: 17308 - protein, 55 aa, Artificial Sequence
  Synthetic
RDVLRELREIAERDKKKVEDVHRENRDSARRLKEEDDDSHRRNRKSMKEVKEDVE

SEQ ID NO: 17309 - protein, 60 aa, Artificial Sequence
  Synthetic
REIEEVAKRLRKLVKELKERSKESKDRSRKLMTELKKLSKDSLRELRRLLDELRKILKDR

SEQ ID NO: 17310 - protein, 62 aa, Artificial Sequence
  Synthetic
RDVKKKLDEIRREVKKVIEEDKRLNDESEKDSRRLIREDEDENRRIKEEIDRAVEELRRRRK

SEQ ID NO: 17311 - protein, 60 aa, Artificial Sequence
  Synthetic
SDIERVLEELRRLVERLKRETERFAKELRDLARRVKEMSKRSEEELRELATRLKDTLRRR

SEQ ID NO: 17312 - protein, 62 aa, Artificial Sequence
  Synthetic
RDVEEKLRRIKRELREVIKEDEKRNREIEREVDKVIRELEKLNKRIEDEVRKLEEELERRLK

SEQ ID NO: 17313 - protein, 60 aa, Artificial Sequence
  Synthetic
SDIERMRDRLRKLVEEAREKSDRSREELEKLVRELRRKTEKFLKELRDLARRLKETLKRR

SEQ ID NO: 17314 - protein, 62 aa, Artificial Sequence
  Synthetic
RDVKEKLDRIRKEVEEVARDLKRKNDEIEEEIKKVIRDDERRNEEIEKEVRKMAEELRRTLK

SEQ ID NO: 17315 - protein, 60 aa, Artificial Sequence
  Synthetic
SDIERVRKELRELLERVARRSEKSMRDDKKSMDDLKKEIREVEEELRRLATEVKKTLKDR

SEQ ID NO: 17316 - protein, 62 aa, Artificial Sequence
  Synthetic
RDVKKKLEEIEREIREAIKDLRRKNREIERTNREVIKELREELKRIDTEVKKLVKELRETSK

SEQ ID NO: 17317 - protein, 60 aa, Artificial Sequence
  Synthetic
SELEELERDLERELEEDKRRNEEVMERNERRLRKLKEDVDRVVKELEDLLRKLEKILREE

SEQ ID NO: 17318 - protein, 59 aa, Artificial Sequence
  Synthetic
ESELERLDRRLKKLIKESRETVDEIEERSERAIRDLERKLKELEERLRKKIKELRDETR

SEQ ID NO: 17319 - protein, 59 aa, Artificial Sequence
  Synthetic
DETKKVEDDLRRVDTESKKHLDDVHKESKRVADELRKKLEDVHRRSEEMVRRLRRLLEE

SEQ ID NO: 17320 - protein, 55 aa, Artificial Sequence
  Synthetic
EEVKKRIDDALRENERRAEENRREIERVLKELEDRVDENRRRIEEVRKELRDRAT

SEQ ID NO: 17321 - protein, 59 aa, Artificial Sequence
  Synthetic
DETREVDERLKEADRRSKKHLDDVHKTSKKVLDELRRKIEELERRVRKVVKELEELLRE

SEQ ID NO: 17322 - protein, 55 aa, Artificial Sequence
  Synthetic
EDVRRKVDKIIKENRKMLEDNKRTIEEVLRELKERADEIKERVKKVLKKLEEDRR

SEQ ID NO: 17323 - protein, 60 aa, Artificial Sequence
  Synthetic
DEEEKVERDVERVDKESKEHLDRVHEETRDINRRSEEHLRRVHRDSEDVARRLRDAVRRR

SEQ ID NO: 17324 - protein, 55 aa, Artificial Sequence
  Synthetic
EKVKRRVEEAIKRNRDEARRDEEEVKKAIKRNREEADRNRREIEKVVEELRRRAT

SEQ ID NO: 17325 - protein, 60 aa, Artificial Sequence
  Synthetic
SEKEEVKRRVDEITKRARKKLEDVHRRSEKIDRDSREHLERVHKRTKEILDELRDELRKR

SEQ ID NO: 17326 - protein, 55 aa, Artificial Sequence
  Synthetic
EDLRRRLEKVFRELKETLDRNREEIDRMVKRNRKTLRDNKEEIDRAVREARERLK

SEQ ID NO: 17327 - protein, 60 aa, Artificial Sequence
  Synthetic
REDEEVLKDLKRIVDELRKKLKELHDRSEEIDKRSKKHLDDARRRVEEIMRRIEKRLREE

SEQ ID NO: 17328 - protein, 55 aa, Artificial Sequence
  Synthetic
DKVRKDLKDVAKEMRDRLEENERRIREAAKRNRTELERIERELKEFKDRLDETAR

SEQ ID NO: 17329 - protein, 60 aa, Artificial Sequence
  Synthetic
SEVEKVMEEAKRIVTELEEKIRELERKVKKIDEDSRRHLKEVHDRTAEIAKTLRDILRKE

SEQ ID NO: 17330 - protein, 55 aa, Artificial Sequence
  Synthetic
DKIRREIEEAVERLETEARRLRREVEEAVRRNREMLKRNEKEIKDVAKELRDRLR

SEQ ID NO: 17331 - protein, 60 aa, Artificial Sequence
  Synthetic
REDDRIRDEIRKLVEDNRRLLREILERLKTLADRLREINKKSNDDNERSADELREVLKKV

SEQ ID NO: 17332 - protein, 55 aa, Artificial Sequence
  Synthetic
EEVRREVEKAIRDSKEKLDELEERVRRMIEESEKLVEDNHRRIEEVEREMEEALR

SEQ ID NO: 17333 - protein, 58 aa, Artificial Sequence
  Synthetic
KDEEEIKKAIEELVKRNEDIVEEIKRRSDKLADDLRDINRRSNEDNDRSLKTLEELLR

SEQ ID NO: 17334 - protein, 55 aa, Artificial Sequence
  Synthetic
KEVRDRVRRAIEKSKEDLDKSEDDSRKVIEESKRLVEENHRRIRKAVRKAEEATR

SEQ ID NO: 17335 - protein, 59 aa, Artificial Sequence
  Synthetic
SEEEEARKKLKEAADRNRKVNEDAKKKAEDAARKNKKANEELAKKLKDAAEELKRVSRD

SEQ ID NO: 17336 - protein, 55 aa, Artificial Sequence
  Synthetic
EEIKERAKEVLERHKRSAEKIKEEAKRVLDEHRKRARDWEEEARRVLKEAEEEAR

SEQ ID NO: 17337 - protein, 59 aa, Artificial Sequence
  Synthetic
REEEEVRKEVKKLKKENEDVNDKVRRDLEELLERNRKVNKELEDKIRDAKRRADEMLRV

SEQ ID NO: 17338 - protein, 55 aa, Artificial Sequence
  Synthetic
EEIEEELRKVLKEHKELVERWKREAEEVLEESKRLIDKWKEDLERVLEDFRRKAE

SEQ ID NO: 17339 - protein, 57 aa, Artificial Sequence
  Synthetic
SEAEEIEKRLKEVLDRHDKSAREIKDRLRKVIEEHRKLVEEWEKEARDVVKELKDEN

SEQ ID NO: 17340 - protein, 56 aa, Artificial Sequence
  Synthetic
TRRLRERLRKMEEDNRKINKEIRDEVKELEKENREINKRVEEELKRVRDELKRTAD

SEQ ID NO: 17341 - protein, 57 aa, Artificial Sequence
  Synthetic
DEVEDIKRELEEVVKEHEKSVEDDERKNEDVVRRHDELVKKWEEDLRRVIEKLKRDN

SEQ ID NO: 17342 - protein, 56 aa, Artificial Sequence
  Synthetic
ERDLRRRVKDLKRRNKEMNERSKKHSDEVKEENKRINEEVEKKLRDVKEKLDRDIK

SEQ ID NO: 17343 - protein, 59 aa, Artificial Sequence
  Synthetic
SELEKLIKEVEDLAKEVADKLRKSNKELRELVRKIAKALEETNREIEKVVRRVKRLLES

SEQ ID NO: 17344 - protein, 57 aa, Artificial Sequence
  Synthetic
KLKKIKEDLKRIADEIRKIVEDSKRDLERVADEARKIVEKSKEDLKRAKEEAEKETK

SEQ ID NO: 17345 - protein, 59 aa, Artificial Sequence
  Synthetic
DELDELTKRARELVERNRRHIERSNRELKRLVKEVLDRNRENHKTVEELVKTVLKLAKD

SEQ ID NO: 17346 - protein, 59 aa, Artificial Sequence
  Synthetic
RSDVERVRKELKDSTDDIKRLVDKSREDLKRAKEKDEKSVRDNRERLRRVLRRLEEEVR

SEQ ID NO: 17347 - protein, 59 aa, Artificial Sequence
  Synthetic
SELEKLTKEVRDDVRRVMERLKRSNDDIRRLAEEVIRRNDESRKKLEKLVEEVKDLFRR

SEQ ID NO: 17348 - protein, 57 aa, Artificial Sequence
  Synthetic
KVREIERELDEVRKRLEDLVRKSKEDLDRVREELERLVEKSKRDLDKARRDLDEARR

SEQ ID NO: 17349 - protein, 59 aa, Artificial Sequence
  Synthetic
DELEELEKKVREDVRRVKEKMERSHRETEKLARDVKKRLEDTNREIKKLVKEVEDILRR

SEQ ID NO: 17350 - protein, 59 aa, Artificial Sequence
  Synthetic
KSKVEKVRRDLDEARKRLEELDRRNRKRLEEVRKEIREIVEKSKEDLKRAKDRARETVR

SEQ ID NO: 17351 - protein, 59 aa, Artificial Sequence
  Synthetic
SEAEALIEEVKTLVRRNKEHAKRSHEKTEKLVRDVADALRKTNDEARKLVEEVRRILES

SEQ ID NO: 17352 - protein, 59 aa, Artificial Sequence
  Synthetic
KSKLERLKRELTRSAEELRELDKRNEDELRRAAKRIRDIVRKSEEDLKKVRDDAREKTR

SEQ ID NO: 17353 - protein, 60 aa, Artificial Sequence
  Synthetic
KDVEEVRKELDEIARRVTEEIKRVHDETARIVDRLRERLEKVTRDNRRSVRELEKELERN

SEQ ID NO: 17354 - protein, 59 aa, Artificial Sequence
  Synthetic
EKKLREAKKRLDELAERLKRLIDRNREEIKRVAREADERIRENEKEVEEVEERLDRKIK

SEQ ID NO: 17355 - protein, 60 aa, Artificial Sequence
  Synthetic
KDAEKVVEDLERKADAVMRKLEDVSRRHREIAKRIKDRLEKVHRDNEKSVEDLKRILKRN

SEQ ID NO: 17356 - protein, 59 aa, Artificial Sequence
  Synthetic
EEIVRRAEKKVEDFERRLRKLIEDNKREVDKVEKELRDTIRRNEERIREAVEELKRTSD

SEQ ID NO: 17357 - protein, 60 aa, Artificial Sequence
  Synthetic
EDVRRVVEELRKIAEDAKEKARRVHERDRERVRKVEEDAKKVHEENEESVTRLERLLDRR

SEQ ID NO: 17358 - protein, 59 aa, Artificial Sequence
  Synthetic
EDDVRRIREEVEKVRKDLKDIVKRNKEANDEVEKRLRDIVRRNRERIEEMRRRLEEKKR

SEQ ID NO: 17359 - protein, 60 aa, Artificial Sequence
  Synthetic
EDVKRVVKELEDIAEEVRRRLEKVNRENRESMKRLEEELRKVHEENRESIERLKRTLKDR

SEQ ID NO: 17360 - protein, 59 aa, Artificial Sequence
  Synthetic
EEIVKEAKERVDKVKDDLRRLIEENERDIRRMDRKLEDEIRRNDEELRRVVREAEETVR

SEQ ID NO: 17361 - protein, 60 aa, Artificial Sequence
  Synthetic
SDVERVRRELREIAETVKERLREVNERNRKSVRDVEEIVKKVHEEDKDLARKVEEILERN

SEQ ID NO: 17362 - protein, 59 aa, Artificial Sequence
  Synthetic
KERVDDIKREVDKAREDLRRLIEENKRDIKEVVERLEKLIKDNRDDNDRLRRRLEEKSR

SEQ ID NO: 17363 - protein, 60 aa, Artificial Sequence
  Synthetic
SELEKVEKELKRIVDEVKKELKRVHEDDERLVRELEESLKKVTEDDRRLARELEDTLRKR

SEQ ID NO: 17364 - protein, 59 aa, Artificial Sequence
  Synthetic
EEDARRAEERVRRVVKELKELIERNKKRNKEAVERLRRLIEENKRENREVEKRARDTAR

SEQ ID NO: 17365 - protein, 60 aa, Artificial Sequence
  Synthetic
KDAEEVLERLKKIAEEVAKELRDVDEENRRLLKRWAEILEEVTREDERLARELEERLERR

SEQ ID NO: 17366 - protein, 59 aa, Artificial Sequence
  Synthetic
EEKLRRAKEEVDRAEKELRELIKRNKDNLERAVRELEKLIEENERRNREVEKRLEDRER

SEQ ID NO: 17367 - protein, 60 aa, Artificial Sequence
  Synthetic
KDVEDVVRRLEEIAKRVKERLKEVDKRNKDKAREWLKEVKEVHERNEKLAEEVRRTLKDN

SEQ ID NO: 17368 - protein, 59 aa, Artificial Sequence
  Synthetic
EEIVREAEKRVREMERELRELIERNKRNVEEMDRRLEELIKENEERNKRVEEDLRRKTK

SEQ ID NO: 17369 - protein, 60 aa, Artificial Sequence
  Synthetic
DEVEEAKRRLTELVDRLRKTLEKVSREDRELEERVRKITKDSHDTTEEILKRLKRELEKG

SEQ ID NO: 17370 - protein, 59 aa, Artificial Sequence
  Synthetic
EKDLRELEERVRRAVKKLRDDLRRNKKESEEVKKKLEDENKKNRDRVAEAEEELRRRTT

SEQ ID NO: 17371 - protein, 59 aa, Artificial Sequence
  Synthetic
DEVREMLRTLDEIARRLKKRTKESIDTDRRLVKKLREETDKSIEDDKKLVKEVEELLDG

SEQ ID NO: 17372 - protein, 59 aa, Artificial Sequence
  Synthetic
ERKLRELEKRIRKAEEELRRDNERSKKETEDVERDLERKNEESERRTREAEKRLKERSD

SEQ ID NO: 17373 - protein, 59 aa, Artificial Sequence
  Synthetic
SEVEEVLKRLRDIARELEKLIEEVIRRDRKLVEELKRRSERSIETDRRLVKRLKEMLDG

SEQ ID NO: 17374 - protein, 59 aa, Artificial Sequence
  Synthetic
EEKVRRAEEEIREVERRLRKLLRDSKEETKEVVKELRRLNEESKKETEKVVREAEKRTK

SEQ ID NO: 17375 - protein, 59 aa, Artificial Sequence
  Synthetic
KDAEEVVRRLTKLVEDLKRKIEEVIREDKELVDRVRDTSRKSDETLEKLVREVKKLLRE

SEQ ID NO: 17376 - protein, 59 aa, Artificial Sequence
  Synthetic
EEKLKRLEDRVREAEKELRELLERSEDTTRRAERELEELNRRLEDKIRRVVEELKEESR

SEQ ID NO: 17377 - protein, 59 aa, Artificial Sequence
  Synthetic
SEVEDVLRRLERLVRELEKETKRSLEENEKLARRLKKKLEDVVRDNKRLVDEVKELLKE

SEQ ID NO: 17378 - protein, 59 aa, Artificial Sequence
  Synthetic
EEKLRRLEKLVRDAARRLKELNDRLRKRSKEVKEELERILRELKERSDRAKEDLRRAAK

SEQ ID NO: 17379 - protein, 60 aa, Artificial Sequence
  Synthetic
SELEKVEKDLEKLIRDDEEENKRVLEELERLVREDKEKNKRVHDETRKLEDTLRRILEKS

SEQ ID NO: 17380 - protein, 62 aa, Artificial Sequence
  Synthetic
EEAKEKLRRLKERIREAEEKSRKSLRDIEETLKKVKRESEETDRRNRDTLRRAKKRLKDETR

SEQ ID NO: 17381 - protein, 60 aa, Artificial Sequence
  Synthetic
DEVEEVKKTIRDLLRRNKEISRETLERLKKLVDENRERNKKVHDETKKLTEEIKKILEEI

SEQ ID NO: 17382 - protein, 62 aa, Artificial Sequence
  Synthetic
EEAEKELRKLEKEVKDAKEESERSDRRLEKEIRDVERDSERSDRENRDEIRRVAEELDERSR

SEQ ID NO: 17383 - protein, 60 aa, Artificial Sequence
  Synthetic
SEAEKVLRDLEELVRENEEKSERSLRELEKLVRDNEEKNKEVVKRIKDLAERIRRILEEI

SEQ ID NO: 17384 - protein, 62 aa, Artificial Sequence
  Synthetic
EDAKRKLEEIRKTLEEVKRRSEDSNRELRRRLEEVKRRSEKSLRDLEELVRRIKKELDDRSR

SEQ ID NO: 17385 - protein, 60 aa, Artificial Sequence
  Synthetic
SEADKLREDLERRVREIEKRSRDSDKRLEELLEEIRRRSKRTLDELERRLREVEEELERE

SEQ ID NO: 17386 - protein, 59 aa, Artificial Sequence
  Synthetic
KKKVDRVRDEVRKVKRKLEEEHKKLERKVREARKELEKSHRDLNREVKKAKERLDRKRD

SEQ ID NO: 17387 - protein, 60 aa, Artificial Sequence
  Synthetic
DEVEKLRKELEDLAEKIKRESEKTLRELKKLADEIRKLSEDTLRRLKELLDRVEELLRET

SEQ ID NO: 17388 - protein, 59 aa, Artificial Sequence
  Synthetic
ERKVRELEKTVEKIKRELEKSHEDLNREVEKIKRDLERSHKELNELVKRAEERLRRETK

SEQ ID NO: 17389 - protein, 60 aa, Artificial Sequence
  Synthetic
SRVEELKRRLEELIERIDRESKRTLKELKDLAREIKELSERTLRELERLAKEVKEELDRI

SEQ ID NO: 17390 - protein, 59 aa, Artificial Sequence
  Synthetic
EEKVKELEERVRRVDEELERSNERLRREVKKIKEELKESHERLNKRVEEIRRELRERSR

SEQ ID NO: 17391 - protein, 60 aa, Artificial Sequence
  Synthetic
DEAERLEEEIRRLAEEIKRLSKESLERVEKLLEEVRRESKRTLEDLERLVRDVEDKLRKI

SEQ ID NO: 17392 - protein, 59 aa, Artificial Sequence
  Synthetic
EEKVRRLKKRIDEIKEELKKSNEDLHRRIEEAKRELEELHERLNRDVERVKEKLRRDAK

SEQ ID NO: 17393 - protein, 60 aa, Artificial Sequence
  Synthetic
RELEELLKTLEELLKKIEEESRRSLEELKRLVDDIRRKSEESLERLERLAERVKEVLDRE

SEQ ID NO: 17394 - protein, 59 aa, Artificial Sequence
  Synthetic
KEKIDRLEKRVRDAKKRLEDLHRELNKRVEDVKRDLEESNKRLHDTVREIKKELRERTR

SEQ ID NO: 17395 - protein, 60 aa, Artificial Sequence
  Synthetic
DEVRELEERIDRILKKIEDESRRTLEEIKKIAREVEKRSEDTLRELDDLVRRVEELLERI

SEQ ID NO: 17396 - protein, 59 aa, Artificial Sequence
  Synthetic
EKDVRRLEKKIREAEKRLRESNERLEKTIRDIKKRLEKLNKELKDRVDEVVKRLRDKTE

SEQ ID NO: 17397 - protein, 60 aa, Artificial Sequence
  Synthetic
SELEELLERLKRRADEIRKESEKTLEELDRDARRIEKESRETLEELKKRLDDVRRALEET

SEQ ID NO: 17398 - protein, 59 aa, Artificial Sequence
  Synthetic
KKKIDDLRRKVEEIEKDLKRSNDELRKRVKEIKDRLKELHDKLNEDVKRARKELEERRK

SEQ ID NO: 17399 - protein, 60 aa, Artificial Sequence
  Synthetic
SEAEELLERLDRRLRRVEETSKRTLDELKRLLEDIERKSRKSLKELEDLVRKVKDMLRRE

SEQ ID NO: 17400 - protein, 59 aa, Artificial Sequence
  Synthetic
EKKIRDLERRVEEAARRLEKSNRDLAEEVERAERRLDRSNRELRRRVEKVLKELEDTER

SEQ ID NO: 17401 - protein, 60 aa, Artificial Sequence
  Synthetic
SELEELEKRLEDLAREIKRRSRESLKELEELVKRIEETSKRTLDELKRLLDEVVKELRRI

SEQ ID NO: 17402 - protein, 59 aa, Artificial Sequence
  Synthetic
EEDIRRLEERVEKIREDLERLNRELHETVKRVKKRLEDSNRRLKEEVRKAKRRLDEELK

SEQ ID NO: 17403 - protein, 60 aa, Artificial Sequence
  Synthetic
SEAEELTERIRKILKEIRELSEKSLRELRELVKTITELSKESVERLKRRVEEVKEELRRI

SEQ ID NO: 17404 - protein, 59 aa, Artificial Sequence
  Synthetic
ESKVRELEERIRRAEEELKKRNEDLHREVRKVLKELRDSNKELEKEVKRVKKELRDESR

SEQ ID NO: 17405 - protein, 60 aa, Artificial Sequence
  Synthetic
SELEKLAEDLERLAEEIKRESDRSLEELRELAERIKRESRKTLEDVKKLLKEVKEVLDRE

SEQ ID NO: 17406 - protein, 59 aa, Artificial Sequence
  Synthetic
DKKIEDLRRRVEEIIKRLEKSNRDLRKEVEDIKRELEKLNKELHDTIREAKERLDRTTK

SEQ ID NO: 17407 - protein, 60 aa, Artificial Sequence
  Synthetic
REVEELLKELEKVVRENEKKIEDLHKRNEDVVRKIEKDHRDSEKELKEVADRVRELLERK

SEQ ID NO: 17408 - protein, 59 aa, Artificial Sequence
  Synthetic
EDDVRRLKKRAEESLKKIEDDLRRDEDRLRRVIEKSKRLVDKLREELERVLREIEKRIR

SEQ ID NO: 17409 - protein, 60 aa, Artificial Sequence
  Synthetic
SEAEKLKEDLDRVVEKVKEDLKRLHDENRRVAEKNERVIEELHRRNREVTKELEKRLEEK

SEQ ID NO: 17410 - protein, 59 aa, Artificial Sequence
  Synthetic
EEKVKRLRDAVRKVLKEIEEELERDERAVAKTLRKIEELLKRDKKELDKVRKRLEERLR

SEQ ID NO: 17411 - protein, 60 aa, Artificial Sequence
  Synthetic
SEAEKIEEELRRAAETAKKRHEDSERELEEAAKTAEERAKRIHDRNERAAEEAKKRAEDD

SEQ ID NO: 17412 - protein, 59 aa, Artificial Sequence
  Synthetic
EEKATRIKREADEARKESKKLAEKLKKRADEARRKLEEEAKRDKERADRAAKEIEDRAR

SEQ ID NO: 17413 - protein, 60 aa, Artificial Sequence
  Synthetic
SEVEKLKEDLKRVVERVKRDHERSLKRLEDVAREVEKRIRDLHERSKDVMRRLKDLIDKK

SEQ ID NO: 17414 - protein, 59 aa, Artificial Sequence
  Synthetic
EDELRKLAEDIKRAEDESRKLVERLKKKAEEVRRKIKKLLEENEEELKRILDRLREAAK

SEQ ID NO: 17415 - protein, 60 aa, Artificial Sequence
  Synthetic
SEVEELLERLKKVADDIRREIEKLHKRTKEVADEVRKRHEDSRRELEKVADEVRDRIEKD

SEQ ID NO: 17416 - protein, 59 aa, Artificial Sequence
  Synthetic
SKALKRLSDEIKKIEDEIRKLLEDNRREVEEAEKESRKLVEELERRAKEVEEEIKRARD

SEQ ID NO: 17417 - protein, 60 aa, Artificial Sequence
  Synthetic
SEVEKILEDLKRVVDEVRKRHKESLDRNKKVADEVRELHERSDKELEDVVREVKDKLEKN

SEQ ID NO: 17418 - protein, 59 aa, Artificial Sequence
  Synthetic
SKDVKRIEDELRKANEESRRLVEELRKHSEDVNRESRKLVEDLERKLRKAEKDIEDDAR

SEQ ID NO: 17419 - protein, 60 aa, Artificial Sequence
  Synthetic
SEVEDLLRRLKEVVEEVERLIKKLHKETKEVVDEVRRLHEKSLRELKKAADDARDALRRN

SEQ ID NO: 17420 - protein, 59 aa, Artificial Sequence
  Synthetic
EEKVRRLAEEVKRALDRIKELIKRNRDELKRANEESKRLVERLREEAERILRDLRRKLD

SEQ ID NO: 17421 - protein, 60 aa, Artificial Sequence
  Synthetic
SEVEKIKKDLEKVADEVRRLHKESLDRLKKVVREVEERLKRLHEESEKVAKDVRRKVEEK

SEQ ID NO: 17422 - protein, 59 aa, Artificial Sequence
  Synthetic
EREVKKIKDDLDRVNEESRRLVEKLERDVTRVRKKIKEELKKNADRLKEVEEDIKRRAK

SEQ ID NO: 17423 - protein, 60 aa, Artificial Sequence
  Synthetic
SEVEELERELKEVVDRVRKLHRESLERNREVVRKVDEDIKKLHRESEEVAKEVEKLIEEV

SEQ ID NO: 17424 - protein, 59 aa, Artificial Sequence
  Synthetic
ERDLKRLEDEARKANKESRDLVREIERHSREAMKRIEEELRRNKERLERVLKKIEDKAR

SEQ ID NO: 17425 - protein, 60 aa, Artificial Sequence
  Synthetic
SEVEKLLEDLKRVAREVEKLLEDLHRRTDEVMKRNEDDIRRLHEESDRVVKRVKDEIEKK

SEQ ID NO: 17426 - protein, 59 aa, Artificial Sequence
  Synthetic
ERDLKRLKDEAKRIEDKIRELLERNREKARRTKEKIKKLVERNRRELEKVLDEIRRRIK

SEQ ID NO: 17427 - protein, 56 aa, Artificial Sequence
  Synthetic
KEVEDVEKRNREVHRRIEKLIEENERRLKEVRDRIRKLVREIEDLNRRVREEVDRR

SEQ ID NO: 17428 - protein, 59 aa, Artificial Sequence
  Synthetic
EEVLRDLLRRNEEVVKRVEDNLRRDTERLEKVAKDVEKKLREVLKRNKEMVDEVRKKTK

SEQ ID NO: 17429 - protein, 60 aa, Artificial Sequence
  Synthetic
SEEEDVLRKLEKIVTDLRETLKRMHEDSERIVEESRKHARKVHEDSKKIVRELKKVLDEK

SEQ ID NO: 17430 - protein, 55 aa, Artificial Sequence
  Synthetic
EEVRRRVEEIRREIERELKRNRERLEEVERENRKLLRENKEELDKVEKDLRDTAE

SEQ ID NO: 17431 - protein, 57 aa, Artificial Sequence
  Synthetic
DDIKRLEDEVRKAAEENKDEVRKNREELKRIKDEIDKLVKDVEETIRRAEDEIRKRV

SEQ ID NO: 17432 - protein, 59 aa, Artificial Sequence
  Synthetic
KRVMEKVLRELKEIVDRSRDHLRRVHEDSKRIADELRRKIEELLKRIKKVVDELREAIR

SEQ ID NO: 17433 - protein, 58 aa, Artificial Sequence
  Synthetic
DDLRRIEKELKRLADRARKINRESDERIKKLEEEIRRINEDSLRRDRDLARRLREMLK

SEQ ID NO: 17434 - protein, 58 aa, Artificial Sequence
  Synthetic
REVKKLKEDLDRVKRELEKLNEEIRDRIRRVKEELKRLNDRSKKHTKEVEEEVERRKK

SEQ ID NO: 17435 - protein, 60 aa, Artificial Sequence
  Synthetic
SEAEDILRRIKRLADENRRILKEILDRIKELADRVRKINEDSLRTLRKLAEELRRVAEKV

SEQ ID NO: 17436 - protein, 58 aa, Artificial Sequence
  Synthetic
EKAERLEREVRKIEKESREMLKRIEDEIRKVEEDLRRLNEELERDVRRVEEEVKRAAD

SEQ ID NO: 17437 - protein, 58 aa, Artificial Sequence
  Synthetic
DELDDIRRRLEKLEEEAERINRESEKRDRELARRIREINKRSKEEDRRLAKEVDEILR

SEQ ID NO: 17438 - protein, 58 aa, Artificial Sequence
  Synthetic
EAVEELRKKIEEVEKKLRRLNEKSKKHTKDVRDELRRLNEDSKRHTDEVKDRLEEATR

SEQ ID NO: 17439 - protein, 60 aa, Artificial Sequence
  Synthetic
DELRKIREDLKRLATEAREINKRSDEDIKRLTDDVRRINKESLERLKKLADDLRDALRKV

SEQ ID NO: 17440 - protein, 58 aa, Artificial Sequence
  Synthetic
EAVKELEEEIRKVKEELKKLNKEIEDKIRDVERELRETNKRLEDEVRRVEEEVRRATK

SEQ ID NO: 17441 - protein, 60 aa, Artificial Sequence
  Synthetic
DDAERILDEIRRLTEELREINKESLKKVERLAERIREINKDSLRRDKELADRLRRMLEEV

SEQ ID NO: 17442 - protein, 58 aa, Artificial Sequence
  Synthetic
EKVERIERTIRKVARELEKLNEDIRKRVDEVEEELKKLNKESEDHTRRVREEVRRRTQ

SEQ ID NO: 17443 - protein, 59 aa, Artificial Sequence
  Synthetic
SELETVEERLKRLEEEIRRLLEKVDRDLDRLADEVRKKNKRSHERNKEIEDRIDKLLKD

SEQ ID NO: 17444 - protein, 62 aa, Artificial Sequence
  Synthetic
EELKKMLRKLEERVKEVTRELEDLLKKAEEKVRRVKDELRRSNKKDEDRLREVEEKLREDSR

SEQ ID NO: 17445 - protein, 59 aa, Artificial Sequence
  Synthetic
SELEEVRKRAKDIADEDRELNRRVHEENKRLADDVRRKNEKSHRDNERIATELRELLRD

SEQ ID NO: 17446 - protein, 62 aa, Artificial Sequence
  Synthetic
EELKKLLDELRKRVEDVKEESKRSLDRDRRELERVKKELDDSNDEDRKRIEEVIKEVRDRSK

SEQ ID NO: 17447 - protein, 60 aa, Artificial Sequence
  Synthetic
DEEREVKERLKELIERLRRLHEESLRELKRIADELRRLHEESHKRNEDIARELERLLAEV

SEQ ID NO: 17448 - protein, 55 aa, Artificial Sequence
  Synthetic
DELERRVRKVEEESKKLHEEIRKRIEEIERESRKLHEDDRRRIEEVLKRIKDAVR

SEQ ID NO: 17449 - protein, 58 aa, Artificial Sequence
  Synthetic
SDEDRLREEAKKVADELRKLHEESHKRNKEIADELRKLHKKSHDDNKRIADEITELLK

SEQ ID NO: 17450 - protein, 55 aa, Artificial Sequence
  Synthetic
EELRDRLRRVEEESRELHKRDREEVERIRRESEKLHREDREDVKRIEKKLRDDAR

SEQ ID NO: 17451 - protein, 60 aa, Artificial Sequence
  Synthetic
DEAEKVLEELRRRAEKVLREVKKVLEDHKRLADELRKELKRVSDENRDSLRRLLEEIDRN

SEQ ID NO: 17452 - protein, 59 aa, Artificial Sequence
  Synthetic
EDLLRRLRELLDEIRKELRDLIRKLRELNDRVERDLRRIIRENRELVRRAEKELEDRTR

SEQ ID NO: 17453 - protein, 60 aa, Artificial Sequence
  Synthetic
DEAEEVLERIKDLARKNEEKNRRVLEEHEKLIRESEERDEKSSRDNKRSVDEIRDIIRRK

SEQ ID NO: 17454 - protein, 59 aa, Artificial Sequence
  Synthetic
EEKIKRIRDELARWAEKIKKTIDELRKLNKEAHDRNRKTIKENEDLVREAKEDLERKTT

SEQ ID NO: 17455 - protein, 60 aa, Artificial Sequence
  Synthetic
SEAEEVLKEIKKLADELRKKNRESVEKVRESSKRLKDEIRKVLEDIKRLAEKLREILREM

SEQ ID NO: 17456 - protein, 59 aa, Artificial Sequence
  Synthetic
EKLLRELEKLIRDIKRELDRSDEKLEELVRRSAKELDDLLDTLREIIERIKRDLDEKLR

SEQ ID NO: 17457 - protein, 60 aa, Artificial Sequence
  Synthetic
REAEEVLKRIKELADEIRKRNRESLERIRKSSEDLKRENEDSIRRVRELIDTLRRRLEKE

SEQ ID NO: 17458 - protein, 59 aa, Artificial Sequence
  Synthetic
KELVDRIRDLIRRIKDELKESDDRIKELIDKSKEDLDKSDEDLKREIDKAREELAKAIK

SEQ ID NO: 17459 - protein, 59 aa, Artificial Sequence
  Synthetic
DEVEELLKEVEELAREIVERLEKNLRDTKKLIDEIEEYARRNEERTRKLIEEAERLARR

SEQ ID NO: 17460 - protein, 59 aa, Artificial Sequence
  Synthetic
EELERRLRRLLEELERRLKRLEDEHRRLVEEVRDKLRKIEETHREIVERVRRTLDEEKR

SEQ ID NO: 17461 - protein, 59 aa, Artificial Sequence
  Synthetic
DDARRLLEEVKELLERSKRHLTKNLEDTRRLIKELLDYARRNLEDTRRLIEEVLDLLKR

SEQ ID NO: 17462 - protein, 59 aa, Artificial Sequence
  Synthetic
EEVKETLKRLLDEIRRENEKVARDHKKLVDDVERELEDIERRHKELVDRARKVAEDEKK

SEQ ID NO: 17463 - protein, 59 aa, Artificial Sequence
  Synthetic
SDAERILDEVRKLVEDSKRHLDENLKRTAELSKRSKEYAEENLDRTRRLAKEAADIARR

SEQ ID NO: 17464 - protein, 59 aa, Artificial Sequence
  Synthetic
EKVKEDLKRLLDEIRKENKRAEDAHRDLARRSREELEKAERKHKELVDRIRKALEEIKK

SEQ ID NO: 17465 - protein, 59 aa, Artificial Sequence
  Synthetic
DEVRKLLKDVRELAREIERRLEENLRRSEELLKRIEDYLRKNLEDTRRLIEEVKELADR

SEQ ID NO: 17466 - protein, 59 aa, Artificial Sequence
  Synthetic
EEFKDRLRRLMKRIKERLEDVKRRHKELVKKARKSLEEVKRRHRKLVEDVRRTLEEEKR

SEQ ID NO: 17467 - protein, 59 aa, Artificial Sequence
  Synthetic
DEARKILEDLKRLAEESIRHLEENLRRSEKLVEDVERYAEENLERTKKLVRDVDEIIRR

SEQ ID NO: 17468 - protein, 59 aa, Artificial Sequence
  Synthetic
EEVKKRLEDLAREIRKANEDVKRRHKKLVDDVRKRLKEIEKKHRDLVRKIEEKLRDARK

SEQ ID NO: 17469 - protein, 59 aa, Artificial Sequence
  Synthetic
SEAEELLKTVRDLVEKSRKHLKENLKRSEELSRKSKEYADKNLERTKRLVKTVADILDR

SEQ ID NO: 17470 - protein, 59 aa, Artificial Sequence
  Synthetic
KKLEDELRRLVEEAKRENDEVRREHKRLVEDSERKLEKIERDHRELVDRVEKEMREKKR

SEQ ID NO: 17471 - protein, 59 aa, Artificial Sequence
  Synthetic
SDVERILEDLDRVVKESKRHLEENLRRSEKLTREVEEELKRNLKESEELVKRVEDIARN

SEQ ID NO: 17472 - protein, 59 aa, Artificial Sequence
  Synthetic
EDAKRRLRELVEKVKEDNKKVKEEHDDLVRKVERRLEEIRKRHEELVRRIRRRLEEEKR

SEQ ID NO: 17473 - protein, 59 aa, Artificial Sequence
  Synthetic
SDVEELLRRLEELLKESEKHLTENLRRSEKLVRDSKRHLDENLKRSKDLAREVVRLAEK

SEQ ID NO: 17474 - protein, 59 aa, Artificial Sequence
  Synthetic
RKVKERARELVERIKRRNEKVERDHEELAREVRERNKEVEKRHRDLVEELRRRLDERKR

SEQ ID NO: 17475 - protein, 59 aa, Artificial Sequence
  Synthetic
SEAEELLERVKKLTDESLRYLEENLDRLRKLVKESEDHLKDNLRKSEKRVREVIDLARR

SEQ ID NO: 17476 - protein, 59 aa, Artificial Sequence
  Synthetic
KDMEDKLRRLVEESRRALEEVLKRHEDLVEEVRKSNDKVRKEHEELVKRVRDALREIKR

SEQ ID NO: 17477 - protein, 55 aa, Artificial Sequence
  Synthetic
SVEERLEKLLKEAEERLRESEDRTRKLVEEVRRELEKLKKRSKELADRVREELRK

SEQ ID NO: 17478 - protein, 59 aa, Artificial Sequence
  Synthetic
EEELEKILDTLRRIAEKLVRKNEDILRRLKEIVKKVIRENEEILRRLEEIAKELAKRLE

SEQ ID NO: 17479 - protein, 55 aa, Artificial Sequence
  Synthetic
SLDEEAKRVVEEVRKRLRESKERSREIVERARRELERLKEESKRLADRIREEVKK

SEQ ID NO: 17480 - protein, 59 aa, Artificial Sequence
  Synthetic
TELVKRLLDDLRRIIRELEEKNRALNETLRKIVEEAIKKNREILEELREEVDRVRKRLK

SEQ ID NO: 17481 - protein, 60 aa, Artificial Sequence
  Synthetic
SEVEKVLREAREILKKNKRENEEVHKKSKEIAERNREKNEKVHRDSRKIIEELKELADRG

SEQ ID NO: 17482 - protein, 56 aa, Artificial Sequence
  Synthetic
EDEARKLVKEVRETLEDSARRDEKLIEDLKRTLDESKKEDDKLIEELERRLREAER

SEQ ID NO: 17483 - protein, 60 aa, Artificial Sequence
  Synthetic
SEVEKVLREAEEIAKKNEEDNRRVNDRSEKIIEENERRNRKVHKESEDIVRDLERLAAEG

SEQ ID NO: 17484 - protein, 56 aa, Artificial Sequence
  Synthetic
EEEVRKLVEKLERLLEKSKRDDEESIKKARELLRRSEEADKKLIREAEEAIRTRKK

SEQ ID NO: 17485 - protein, 60 aa, Artificial Sequence
  Synthetic
SRLEELLKKAKKLVEDVEDTNRKMLEKLRKLADDLRRINKRVLDELERLARELEDIARKI

SEQ ID NO: 17486 - protein, 59 aa, Artificial Sequence
  Synthetic
EEVLRELKKLLDEAKKKLEEIDKRLEDELRKIEDDLRRSNERVRRLLEEVRRRIKEETD

SEQ ID NO: 17487 - protein, 60 aa, Artificial Sequence
  Synthetic
DELEEMLKRLEKLARDLDRINKEVLRRVEEEVRKLEEENEEVLRTLRRLAEEVERILDEI

SEQ ID NO: 17488 - protein, 59 aa, Artificial Sequence
  Synthetic
KEVLDKLEKLLEDIARELEKSNRRLEELLKEVERRLREMDERLRKELEEVKRRLEEKRR

SEQ ID NO: 17489 - protein, 60 aa, Artificial Sequence
  Synthetic
SRVEKVLEELKELMKELDDSNRRVLEELERLVRENTRRNEEVLRRVRELAERLKDELDKI

SEQ ID NO: 17490 - protein, 59 aa, Artificial Sequence
  Synthetic
EELLRRAKELLKRIKERLEESDRRLKRLLDEARKRSEDIIRALEKLLRDVKRELEEKLR

SEQ ID NO: 17491 - protein, 60 aa, Artificial Sequence
  Synthetic
KDAERLFEDLRRLVDENREKNEKVLREIEERVERLERENEKVLRDLEDLIRRVREEIDRT

SEQ ID NO: 17492 - protein, 59 aa, Artificial Sequence
  Synthetic
EEMLRELKKLLDRAREESRRIIEELERTLEKVKERLDRTDKEIEELLKRAEEELREKER

SEQ ID NO: 17493 - protein, 60 aa, Artificial Sequence
  Synthetic
DDLERLLKEVKERIDEVKRRNEEVLKRLRELVKRNKEKNDRVLREAEKLMKKLRDIVRKI

SEQ ID NO: 17494 - protein, 59 aa, Artificial Sequence
  Synthetic
EEVLRRLRELLRTAERELEESNRRAEELLKDARRKSEEIIRRLERLLEEVDRDIKRALK

SEQ ID NO: 17495 - protein, 60 aa, Artificial Sequence
  Synthetic
DDVRELLRTLRKISEDTLRRVEEINRKLERLSRETLKRVEDINRKVKELMEEVLKELDRI

SEQ ID NO: 17496 - protein, 59 aa, Artificial Sequence
  Synthetic
EDALRELKRLVDDNETKLRRLRDTHRELLERNRTELEKLKRTHKKLVDEAEEELRKKDK

SEQ ID NO: 17497 - protein, 60 aa, Artificial Sequence
  Synthetic
SDVERLLEKLRDLSRRTVRELERINEEVREIIKTLKKELDRTNKELRDIIEEIKKELDKI

SEQ ID NO: 17498 - protein, 59 aa, Artificial Sequence
  Synthetic
EKLLDELRRLLEENEKTLEDVRRTHEELVKRAKRELEKNIEEHERLVRDVKEKLERKIR

SEQ ID NO: 17499 - protein, 60 aa, Artificial Sequence
  Synthetic
SDAEELLKEAREVSKRTKDTLDEINKDVKRISEETKKRLKKTNEEIKEIADRLRKELERI

SEQ ID NO: 17500 - protein, 59 aa, Artificial Sequence
  Synthetic
EDILRELKKLVDDNRKTLKEVLETHEELLRDNSRKLERNVERHAKLVRDIKEELKETTR

SEQ ID NO: 17501 - protein, 60 aa, Artificial Sequence
  Synthetic
SDAERLLKEVEEIARRLEKKMRETNKEVDRIVKEIEDDARRLNKELREIAERIKDELDKI

SEQ ID NO: 17502 - protein, 59 aa, Artificial Sequence
  Synthetic
EKVLKELKRRLEEIKKKLDDNLRRHKKKVDDVARELEKIVKTHRDLVEEIRRRLRKKEE

SEQ ID NO: 17503 - protein, 59 aa, Artificial Sequence
  Synthetic
SDAERLLEELKRISEETKRRLAETNKKVKKIMKELTETLTETNKKLKKIIDDLRDRIDK

SEQ ID NO: 17504 - protein, 59 aa, Artificial Sequence
  Synthetic
ERVLKELRRLLERNREELRRNKEKHKELVERIKRRLEENKERHKRLVDEARKELKEKEK

SEQ ID NO: 17505 - protein, 60 aa, Artificial Sequence
  Synthetic
KDAEELLKTLERLSRETKRRLERTNRELKEISKETEKDLERTNRKLKEIIDRLREELDKI

SEQ ID NO: 17506 - protein, 59 aa, Artificial Sequence
  Synthetic
EEMLRELRRLVEENKKRLRENIRRHERLLEENRRKLEKNIRDHERRLEKADKDLEDKRR

SEQ ID NO: 17507 - protein, 60 aa, Artificial Sequence
  Synthetic
KDAERLLEEARRIVKEADDILRELDEEVRRIVEKIKRDAERTNEEIREIAKRIRDEIERI

SEQ ID NO: 17508 - protein, 59 aa, Artificial Sequence
  Synthetic
EDVLRELRKLVEDVKRRLKEVADHHRELVRRAEEELKKNRDEHERLVREIEKELRKARE

SEQ ID NO: 17509 - protein, 60 aa, Artificial Sequence
  Synthetic
DEAERLLERVKELMERLTEEARRTNETLREIVERAERRLRELDERVRKIAEEIRRRLEKI

SEQ ID NO: 17510 - protein, 59 aa, Artificial Sequence
  Synthetic
EKVLTKLRKLLEDIRRRLEKNLKDHEELVRRVEEKLKRVREHHEELVRRIKEELDKAEK

SEQ ID NO: 17511 - protein, 63 aa, Artificial Sequence
  Synthetic
RDAEELLRTMEEITRRVKKELEDLLRTDEELSERVKEEARKLDEKLKELARDVTEKARDIKKG

SEQ ID NO: 17512 - protein, 59 aa, Artificial Sequence
  Synthetic
DEVKKELKRLIEEVRDRLKKVKDTLEKLIKENEDELRKVEEHHEKLLREIEETLERMRK

SEQ ID NO: 17513 - protein, 63 aa, Artificial Sequence
  Synthetic
EEAERLLKKAEDLSRDTARKAKELLEEDEKLVRDAEKKARELDRELEKLAEEAARAATRAKKD

SEQ ID NO: 17514 - protein, 59 aa, Artificial Sequence
  Synthetic
EEARKRAEDLIRESEKRARDAKRRAKELIDRSRKSAKEAKEHHEKLIKEARDELEKAKK

SEQ ID NO: 17515 - protein, 60 aa, Artificial Sequence
  Synthetic
DEAEKLLRELEKLSRETEKRVREIIKKDRDLSEEVRRRAERLDDELRKLVEDAERELRRI

SEQ ID NO: 17516 - protein, 59 aa, Artificial Sequence
  Synthetic
DKVRKRLEELIRESDERLKELTKELRKLIEDNRRELEKIIRHHKRRVDEVRKRMTELRR

SEQ ID NO: 17517 - protein, 61 aa, Artificial Sequence
  Synthetic
SEVEDLLRRLEEIVKRNDDELRADEERTRKIIKENKETLDRLLEDLKRILRELEKIVRDKG

SEQ ID NO: 17518 - protein, 59 aa, Artificial Sequence
  Synthetic
EEAKRRAEEKLKRLEERSREIERRLKKLNEELKRISDEVEKTAREILERIKRRIEEEER

SEQ ID NO: 17519 - protein, 61 aa, Artificial Sequence
  Synthetic
SRVEKLLDDVRKILEDNERRLRDDMRRTEEIIRKNKRDLERLKERHEEIVKRLDEIIKKEG

SEQ ID NO: 17520 - protein, 59 aa, Artificial Sequence
  Synthetic
EDARREAERLLKEVEDTSREAEKRLRELNEELERRSRKVEEELKKSDEELKRRIEEAER

SEQ ID NO: 17521 - protein, 60 aa, Artificial Sequence
  Synthetic
SIEDRLRKIVRDLEKVLRDLKREHDDVVRELEKRLRDIEERHRELVEELKKRIEEIERER

SEQ ID NO: 17522 - protein, 59 aa, Artificial Sequence
  Synthetic
EKDLEELLKELEDIIREVRKRAKENLDRTRKLIKDIEDYLKKNLDRVRKLIEDITRALK

SEQ ID NO: 17523 - protein, 60 aa, Artificial Sequence
  Synthetic
SIEERLREVERRLREDLKRLEKAHRDIVRDIERTLRKVEEDHRRVKEKLKRTIEDVERRR

SEQ ID NO: 17524 - protein, 59 aa, Artificial Sequence
  Synthetic
EKELEKLLRDLKRIIDEVRKYATRNLEELKRVLKRVKEEAEKNLERTERLIEEIRRRAE

SEQ ID NO: 17525 - protein, 60 aa, Artificial Sequence
  Synthetic
SIEETLREIVKDLERVLEEIERRHREIKKELEDILRELKKRHEDVVREAEKELRDAKRRR

SEQ ID NO: 17526 - protein, 59 aa, Artificial Sequence
  Synthetic
REELKRLLDELKKLIDRVREEAKKNLDRSKKMIEDVERYARENLRRTKELIDDVKEKLR

SEQ ID NO: 17527 - protein, 60 aa, Artificial Sequence
  Synthetic
KIEEEVDKVRRTLEKELKEIDERHKRIVEKLREELKEAEKRHEELVKRAKEELDDVKRRE

SEQ ID NO: 17528 - protein, 59 aa, Artificial Sequence
  Synthetic
EDLLRKLLEELDRIRKEVRERLKRNLDRLKKLIDEVREYLERNLRRTKKLIDRVREDAR

SEQ ID NO: 17529 - protein, 60 aa, Artificial Sequence
  Synthetic
DVEEELRELIERLKEVLDRLREESKRVIKELRDTLRELEERSRDIIRKLEETLRDVARKS

SEQ ID NO: 17530 - protein, 59 aa, Artificial Sequence
  Synthetic
DEFLRRVLERAKKIVRKLEEDARRVLEETEDLIRRLREKAERVHEKTKKIIKEITEELK

SEQ ID NO: 17531 - protein, 60 aa, Artificial Sequence
  Synthetic
SVEDALRKLIEELKRVLKKLEDDSRRIIEELRKVLKDLEDRSRKVIEEIKDDLRKIAEKS

SEQ ID NO: 17532 - protein, 59 aa, Artificial Sequence
  Synthetic
EEVAKRLLDKARDIVRTLKEEAERVHERSRRIIEELRREAEEVLEETRDILRRLREEAK

SEQ ID NO: 17533 - protein, 60 aa, Artificial Sequence
  Synthetic
SELEKVLEKLKDLLRKVREKNERVLREVEERTRRVKRDLERVLKEAKDILRKAKKLADDG

SEQ ID NO: 17534 - protein, 59 aa, Artificial Sequence
  Synthetic
EEIARRIKKVLDDWKRVSEESKRRIEELLKRDKEELEKIKRAAKKVIDELKRLLEEAER

SEQ ID NO: 17535 - protein, 60 aa, Artificial Sequence
  Synthetic
SRAEEILKRLEELIKRLKEENDRVLEENKRLIEELEKKNRDALRRIEELLKELKDIARRI

SEQ ID NO: 17536 - protein, 59 aa, Artificial Sequence
  Synthetic
EDLEEKLRRLLDELRKISEEVEERSERSNKELEDVSEDSKRKLRKILEDLRDLLRRTEK

SEQ ID NO: 17537 - protein, 60 aa, Artificial Sequence
  Synthetic
SRAERILEEMERLIEEVRKENERVLRENRRLIKELKEENERILRELKRLIKEAKEIVERI

SEQ ID NO: 17538 - protein, 59 aa, Artificial Sequence
  Synthetic
EEVDERLERLLKTAEDDSRRSDKRSEDSNRELRKVSEDSRKRLEELLKDAERKLREDEK

SEQ ID NO: 17539 - protein, 60 aa, Artificial Sequence
  Synthetic
DDVDRILEELKRLVEENRKRNEDIERELEKLIKEVEDSNRTMLERMEDLIRELRDIVRRI

SEQ ID NO: 17540 - protein, 59 aa, Artificial Sequence
  Synthetic
EDAERRLKELLEDAKRVSDEVLRRLTELLKKAKDVSDESRERLRRLLEDLERDLKRERT

SEQ ID NO: 17541 - protein, 60 aa, Artificial Sequence
  Synthetic
SDAERLLRELERLVEENRRRNKKVLDDNERLVEKLEKSNRRALEELKELVDRLEDIARRI

SEQ ID NO: 17542 - protein, 59 aa, Artificial Sequence
  Synthetic
ERVREELERLLEEAKRDSDEVRERSKKSNKKLEDVSRKSKKDLRDLLKKARDILKETER

SEQ ID NO: 17543 - protein, 60 aa, Artificial Sequence
  Synthetic
SDAEEVLKELERLIREVEERNKDILRKAKELVRDNERKNREVMERLKKLIEDLKKIAKEI

SEQ ID NO: 17544 - protein, 59 aa, Artificial Sequence
  Synthetic
EEVEKRLKDLLREAEEVSRRSEERLRELLKELEDVSREVKRRLERILEELKRILDEVEK

SEQ ID NO: 17545 - protein, 59 aa, Artificial Sequence
  Synthetic
DEVEELTERLKRVLEDNRRTAEEVKERTRRVIDKVRRDYEELEKRLKKILKEIEDLSRE

SEQ ID NO: 17546 - protein, 56 aa, Artificial Sequence
  Synthetic
EDTVRRLIKEAKDDNDRMEEENRRLIRELEEVSKRAHKRLRELIRRIEELLRREET

SEQ ID NO: 17547 - protein, 59 aa, Artificial Sequence
  Synthetic
SAEEEVRKIKREIEKVLRESEREIERVEKEIRDVLRKSEREIERVKREVDKVLEEVRRA

SEQ ID NO: 17548 - protein, 56 aa, Artificial Sequence
  Synthetic
LEDLLREVKKAIEKNEKDNRDVLREVEEKIRRDEKRNKEVLEDAKRKIEELKKRAD

SEQ ID NO: 17549 - protein, 59 aa, Artificial Sequence
  Synthetic
SAEDAIREVERKAREVLKRSKEEIDKVVKKAEEILKRSKDEVKKVADEIRRILEEVRRA

SEQ ID NO: 17550 - protein, 56 aa, Artificial Sequence
  Synthetic
LEDVLRRIEKIIRDNAEENKRVLEEAEEVLKKDEKDNRDVLEELKKILEELKRKAD

SEQ ID NO: 17551 - protein, 59 aa, Artificial Sequence
  Synthetic
SVEEAVKRLADEIRKVLERSKEELERVAKEAEDVLRRSREELKKVADEVRKVLDDVRRA

SEQ ID NO: 17552 - protein, 56 aa, Artificial Sequence
  Synthetic
LEDALRRLKEIIDENKRENEEVLKRAREIIEENKKRNKEVLDEAKEIIDRVREKAR

SEQ ID NO: 17553 - protein, 59 aa, Artificial Sequence
  Synthetic
SAEDAIRKIAEDAKKLLEDSRRELRRVVEKVKRLLEKSKEDLDRVAEEVKKVLEEADRA

SEQ ID NO: 17554 - protein, 56 aa, Artificial Sequence
  Synthetic
LEDAVREVREVLKKNKEDNDRVLREAEEVLKRNEEENRKVLEEAKRIIDELKKRID

SEQ ID NO: 17555 - protein, 60 aa, Artificial Sequence
  Synthetic
SVREELTRVKKRARDVLERSREEAERVAKRAEEVNRESEREIERVLEEVERILEDIREKV

SEQ ID NO: 17556 - protein, 59 aa, Artificial Sequence
  Synthetic
EEAVRDVLRKVREIIRRNRKENEEVLRDVERLIRELEERNRRVLKKAKEILKRIRDKAE

SEQ ID NO: 17557 - protein, 60 aa, Artificial Sequence
  Synthetic
SVEEELEKVKRKAEKLLEDSDREIKRVTKKAEKVLEDSRKAVEEVEKEVKEVLDEIRANV

SEQ ID NO: 17558 - protein, 59 aa, Artificial Sequence
  Synthetic
EKKAREVLKKVEDRIEENRRRNEEVLEKAEKIIEDNRRKNKTELDKVKEIIRRIREEAR

SEQ ID NO: 17559 - protein, 59 aa, Artificial Sequence
  Synthetic
SAEDALRKLKEDSKRVNDESRREAERLKREIEKINEDSDREVEKVKKKIEELLEKVERD

SEQ ID NO: 17560 - protein, 59 aa, Artificial Sequence
  Synthetic
ERELKRVLEEVERLIEKVKTDNKRVLDEIRKILEEIERKNRKVLKEVEDLLKTMEDEAR

SEQ ID NO: 17561 - protein, 59 aa, Artificial Sequence
  Synthetic
SLEEAVREVERKAKKVNDDSREEVKKVKKESKDVNKKSEDDARRVVEEIKKILKRIAEK

SEQ ID NO: 17562 - protein, 59 aa, Artificial Sequence
  Synthetic
ERLAKKVLDEVEKIIEDIKRRNEEVLRRVREDIKRVEEENKKVLKRVKERVEEMRRRAD

SEQ ID NO: 17563 - protein, 59 aa, Artificial Sequence
  Synthetic
EMEDEARKVIKKIKEVNRRSREESEKLSRKSERVNRESKRASEELREEIRRVLEEIRRK

SEQ ID NO: 17564 - protein, 59 aa, Artificial Sequence
  Synthetic
RRKMKTVLDEVEKEIRRIEEENKKVLKESEDLIREVEKENREVLERTKRIIDEARKRAD

SEQ ID NO: 17565 - protein, 59 aa, Artificial Sequence
  Synthetic
SVDEAVKEVEDRLRKVNEESTRESKKVVDKARDVNRKSEEASRELEDRIEKVLTDIRRK

SEQ ID NO: 17566 - protein, 59 aa, Artificial Sequence
  Synthetic
ERLAKRVLDEAKRILDEVKEKNRRVLEDSERIIKEVEDRNRRVLEETRRIIEELRKEAD

SEQ ID NO: 17567 - protein, 59 aa, Artificial Sequence
  Synthetic
SVEEMVKELIRKLREVNKRSADELDRVRKRMKKLNDDSRKAVKEVREKIERLLDAARRR

SEQ ID NO: 17568 - protein, 59 aa, Artificial Sequence
  Synthetic
ERLAEEVLRRVEKKIEDIRRRNEKVLRELEKILREVSEENERVLRDLERKLRKLAEDDR

SEQ ID NO: 17569 - protein, 59 aa, Artificial Sequence
  Synthetic
SVEDEIRKVKDELRRVNEKSTRDSKRVRDRMETVNRESEKRARDVKKRIKEVLDKIRER

SEQ ID NO: 17570 - protein, 59 aa, Artificial Sequence
  Synthetic
KRLADDVLRKVRDEIRKIEEDNREVLRRSEDILRKIKERNKKVLDDVRRKIDKARRDAE

SEQ ID NO: 17571 - protein, 59 aa, Artificial Sequence
  Synthetic
KAEEAAERIKKKLEDILKRAKEESEKILDKLREVLERSKRKHEELIRRAEEVLKDIARK

SEQ ID NO: 17572 - protein, 55 aa, Artificial Sequence
  Synthetic
RDVLTELEKIIKELEKRAKEVLDTSRKSIEDLERRNEESLKRLTDDLKRAKEEAD

SEQ ID NO: 17573 - protein, 60 aa, Artificial Sequence
  Synthetic
SEVEEVLKRLEELLRDSERKVEEMERRLKEIIDRLREEAKRVLDESKESSKRLDELAKKG

SEQ ID NO: 17574 - protein, 59 aa, Artificial Sequence
  Synthetic
EEADRALRDLERKHEKRVREVDDRLKKIEDELKRVVEEIRKRLEDLKEENRRIVDRTAT

SEQ ID NO: 17575 - protein, 60 aa, Artificial Sequence
  Synthetic
SDVDEVLKRSEDSTRRLRERAERMLEELERLIRESKRTADEVLKRSRESSKRLDEEVRAG

SEQ ID NO: 17576 - protein, 59 aa, Artificial Sequence
  Synthetic
EEVRKELERLRRENEKVVREAKKRLEDIIRKHEKIVKEIKEALDKLLEDNKRIVDRTSK

SEQ ID NO: 17577 - protein, 60 aa, Artificial Sequence
  Synthetic
DELEDVLRKAKELIKRDRDEVRRVLEELKRSTEDLRRKVRDVERRLKELIDELDDIARKI

SEQ ID NO: 17578 - protein, 55 aa, Artificial Sequence
  Synthetic
KELEKIKKELEDVIRETRERLKKVLDETREDIKDVDRRLRKLEEEIRRKVEEDER

SEQ ID NO: 17579 - protein, 60 aa, Artificial Sequence
  Synthetic
SELEEIIERIKRLIEEDRETVKEVLERLRRLSDEDRKEVKRVLREIKELIKELEDLRRRI

SEQ ID NO: 17580 - protein, 55 aa, Artificial Sequence
  Synthetic
EELERLKEEAKRVIKRTRDELEKILRENRELIDRSRKELRDLEKELRDVVRESER

SEQ ID NO: 17581 - protein, 60 aa, Artificial Sequence
  Synthetic
SVREELEKLVRELRRLLEKSKRDTDRLSEEMEELNRRAEELIRTIERRLRELLRKIRENV

SEQ ID NO: 17582 - protein, 59 aa, Artificial Sequence
  Synthetic
EKLVEELKRRAKKVIRELEELSRRATEEVKRVLKENEDLVREVEKDLEEILKRIKDRAD

SEQ ID NO: 17583 - protein, 60 aa, Artificial Sequence
  Synthetic
SLEEELKKLEEEVRRLLEKSKEDTDRLKKEIEDLNKKAEDDVREIRKELEKLLRDIARNV

SEQ ID NO: 17584 - protein, 59 aa, Artificial Sequence
  Synthetic
EELAKRLSDKFRRILEKLEEDSKRALDKAREILKRNEELLRELLEELRRILEEIERRAR

SEQ ID NO: 17585 - protein, 60 aa, Artificial Sequence
  Synthetic
KAKEELDRLRKEARDLLEDSKTKTKRLVEEMDKVNEDSKRESKKLLDELEKLLRDIEKRV

SEQ ID NO: 17586 - protein, 59 aa, Artificial Sequence
  Synthetic
DKLVEKLREEVERILERVKELSKKAIDEVKEVIKRNRDLSKRVIERAKEILRRIEEKAR

SEQ ID NO: 17587 - protein, 60 aa, Artificial Sequence
  Synthetic
SVEDELRRIEEEMKRLNEKVERDSRRVLKEVEDLNREIKKRSDDLEREIRRLLEEVKRRK

SEQ ID NO: 17588 - protein, 56 aa, Artificial Sequence
  Synthetic
IRELLKELRKILDDNRETARKVLEDSKRIIERNKREAEKLERRSRKILKDIEDEAR

SEQ ID NO: 17589 - protein, 60 aa, Artificial Sequence
  Synthetic
SVEEELRRLEKRIEELVREIERRLRELKKEVEELNERIKRASDEILDRIRRLLEEVRRRK

SEQ ID NO: 17590 - protein, 56 aa, Artificial Sequence
  Synthetic
VRDVLREVERIIRELEERARDLLRRIREIIRRNEEKLERLLRRSKEILKEIEERAK

SEQ ID NO: 17591 - protein, 59 aa, Artificial Sequence
  Synthetic
STERKLEELEKEAEKDLKEVEDRLKELNDHHDKRVKEVEDRLRRANKHHRDRLEDIRRR

SEQ ID NO: 17592 - protein, 56 aa, Artificial Sequence
  Synthetic
TDEVLKRLKDLIKELRDEVRKVLTEHREIDKRVEEEVKRVLDEHREIDKRLDEETK

SEQ ID NO: 17593 - protein, 59 aa, Artificial Sequence
  Synthetic
SSKEKIERLREKLEDLVRRVRKRLRELNEHHKELVKRIEDTLRELLRHHDELLKEAERR

SEQ ID NO: 17594 - protein, 56 aa, Artificial Sequence
  Synthetic
TEDVLRRIEELIERLKREVDRVEREHERIDEEVRKRAEDIERRARDIDREVKETTR

SEQ ID NO: 17595 - protein, 59 aa, Artificial Sequence
  Synthetic
SVRETLERMLRHHAELVERVRRELRKLNKHHRDEVKRVEERLDELRKHHEELLRRAEKD

SEQ ID NO: 17596 - protein, 56 aa, Artificial Sequence
  Synthetic
AKKVVEDLRRINERVKDEVRRALREHERIDKEVREIVEEIERRAEKIDEELKRTID

SEQ ID NO: 17597 - protein, 59 aa, Artificial Sequence
  Synthetic
SVEEALTEIKKRLDKKVEDIERELKKLLDHHKELVDDVRRKLEELNRHHDRLLDEIRKD

SEQ ID NO: 17598 - protein, 56 aa, Artificial Sequence
  Synthetic
KDEVLKRLEDLIRELDRRVKEIEKRAEEIDRELEDRVRKVLDEHRKIDERAARETD

SEQ ID NO: 17599 - protein, 59 aa, Artificial Sequence
  Synthetic
ETKERLDEILKHHEEEVKKVRKRLDELLRHHEELVKEVDKRLKEMNDHHRRLLDEADKD

SEQ ID NO: 17600 - protein, 56 aa, Artificial Sequence
  Synthetic
KDDVLRRLEDINRRLEERVRKAERRLEEIDEKAERITEKVKREHEDIDRRVEDIKR

SEQ ID NO: 17601 - protein, 59 aa, Artificial Sequence
  Synthetic
SVKERLDEVRRHHEDEVRRVDEKLKEILRHHEEEVRRVDKELKELLDHHKELLDDAERR

SEQ ID NO: 17602 - protein, 56 aa, Artificial Sequence
  Synthetic
AEEVKKRLDDINKRVEEIVREIEERLRRIDEKLKEIVRKAAEDIRRIDKEVEDEIR

SEQ ID NO: 17603 - protein, 60 aa, Artificial Sequence
  Synthetic
SLEELLKKIEERLRDLSRKVAEELKRILDELRELSERAKDLNRRVNETLRKLVEDITRRD

SEQ ID NO: 17604 - protein, 59 aa, Artificial Sequence
  Synthetic
EEDVKKVLDELEKLLKDNEELNRRVRKELKDLLETLRKLNERSKEELDKLIKELEDRAR

SEQ ID NO: 17605 - protein, 60 aa, Artificial Sequence
  Synthetic
REVEEILRKLKEITDRTRDLSRRNEEELRRIIRELEEMSKRNKREVEEIIKEAKELAKRT

SEQ ID NO: 17606 - protein, 59 aa, Artificial Sequence
  Synthetic
EKAREDLDRLRRENEELIERSERINKKIKEELERVIKRSEDLNKKLEEDLEKLIRDETR

SEQ ID NO: 17607 - protein, 60 aa, Artificial Sequence
  Synthetic
EEVERILTKAERVTRETERLSRENEKELKKITDETRRLSEKNIEDIERIIEEMERLARTT

SEQ ID NO: 17608 - protein, 59 aa, Artificial Sequence
  Synthetic
EDARRELKRLEEENRRLLEESEERNRRIEERNEELIEESERRNRELEKRLRDLIKETRD

SEQ ID NO: 17609 - protein, 60 aa, Artificial Sequence
  Synthetic
SAEDSIRRAEEEARRLIKRAEEEAEKSARRHKELNERARKRAKESAEEAEKLIREAARSG

SEQ ID NO: 17610 - protein, 56 aa, Artificial Sequence
  Synthetic
ARDLEEKAKKALEKAERIARKNAEDNERNLEKSKRIAERNAKKNEEALREIAKKAN

SEQ ID NO: 17611 - protein, 59 aa, Artificial Sequence
  Synthetic
SAREDIERLVKELKELVERAREAIKRSAEEHKKLNKELKDRIKEVVERLKKLIDDARRD

SEQ ID NO: 17612 - protein, 56 aa, Artificial Sequence
  Synthetic
AEELLKKAKRVIEKAEKILRENKEENERNLATSEKIARDIEDKLRKVLKRIADEIR

SEQ ID NO: 17613 - protein, 59 aa, Artificial Sequence
  Synthetic
SAEDKLREVEKHHEKLVRDIRRKLEKNLRDHAEKVDRVRKKLEEAERRLKELVDRVRKD

SEQ ID NO: 17614 - protein, 55 aa, Artificial Sequence
  Synthetic
ERVDRDLERLDREVEEIARRLTRLMEESNKRLEDIVRTIEERIKEILERLKRTAK

SEQ ID NO: 17615 - protein, 60 aa, Artificial Sequence
  Synthetic
SDVEKIIKDLEKVIDDNRRTNEKAIRDAEDIIRRSEEHSRKVIEKLKKIIKEVKEEAERL

SEQ ID NO: 17616 - protein, 56 aa, Artificial Sequence
  Synthetic
EEEVRRVEEEIKKLLEDSRRLLRRIEEESRRLDEEDERLMKEIDDEIRELLERIRR

SEQ ID NO: 17617 - protein, 60 aa, Artificial Sequence
  Synthetic
KEVEDIVDEARKRIDTVRKESKRVVEEVERRIEENKRRNEEVIKRVREDIDRVRKEADKL

SEQ ID NO: 17618 - protein, 56 aa, Artificial Sequence
  Synthetic
REELERLRREVEKLEEDDRRLLEELEKRARELLERSKKLLDEIRREMEELLKRIRT

SEQ ID NO: 17619 - protein, 61 aa, Artificial Sequence
  Synthetic
KEVEDIIREVEKRIRDSERHSKEVLDRAEEVIDDNRRKNEEVIKEAEEIIDRIRREADRLK

SEQ ID NO: 17620 - protein, 56 aa, Artificial Sequence
  Synthetic
KDLLKEVEERSRRVIEKDRELLKRLEDKVRKLVEDSRRMVKRIEEEIRKLLEDIRR

SEQ ID NO: 17621 - protein, 60 aa, Artificial Sequence
  Synthetic
SELEKIIEDIKRLIDELRKLVEDVERRNRKLSEDDKRLVEEVLKRLDELIRRLREIAKKI

SEQ ID NO: 17622 - protein, 55 aa, Artificial Sequence
  Synthetic
ERLDELRERLKRLEDEVRRRLEELERENRKIIEETEEALRRIEEKARKELEEVDR

SEQ ID NO: 17623 - protein, 60 aa, Artificial Sequence
  Synthetic
SELDDIIRKIEELIRDDERKVRKAVRENEDLSRRDEERVRKVIDEARKLLKRLEEIAREI

SEQ ID NO: 17624 - protein, 55 aa, Artificial Sequence
  Synthetic
EKLDELRKRLEDLIRETEKELRRLERENDEIEKRTEDLLRRLREELRRIVEEVER

SEQ ID NO: 17625 - protein, 60 aa, Artificial Sequence
  Synthetic
DDLERIIEEIERLIRTLEELVRDALRKSKRLLEENKKLNEEVLRRIKDLIRRLEEIARRI

SEQ ID NO: 17626 - protein, 55 aa, Artificial Sequence
  Synthetic
EELDKLREELKRLVDRVEEMLRKSEEDTERIIRKSEEDLERLERDLKRLVEEVRR

SEQ ID NO: 17627 - protein, 60 aa, Artificial Sequence
  Synthetic
KELEDIIREAEKLIEENSRKNKEMLDRSKELIERNERKNRDVIRRLEELIEDLRRIAEEI

SEQ ID NO: 17628 - protein, 55 aa, Artificial Sequence
  Synthetic
EELDRLRKKLEDNIRESEKELRRSEEETKKLIDDSERELERIERRARELLERVRR

SEQ ID NO: 17629 - protein, 60 aa, Artificial Sequence
  Synthetic
SDVEDLLRKIKKILREIAEESKRTVRENEELTDRVKKKIREIVERIRRIIKELEERLRRI

SEQ ID NO: 17630 - protein, 59 aa, Artificial Sequence
  Synthetic
KDVEDKLRELERELKKIEDDSRRLLKRLEEENRTLVKEVRERLKRLEDDVRKLKEDVTT

SEQ ID NO: 17631 - protein, 60 aa, Artificial Sequence
  Synthetic
DEVDKLVEEIKKIIEDVRRESDKTVRDNEELTKKLAEDSKRSLDEIKKLIEELRKEIERI

SEQ ID NO: 17632 - protein, 59 aa, Artificial Sequence
  Synthetic
EEVERKLKKLKEELERLVEESRRKLEELKKRNEELVRRSREELDKLRREVKETLERVKR

SEQ ID NO: 17633 - protein, 60 aa, Artificial Sequence
  Synthetic
SDAEEILKEIERLIREVEKTSRRTVEEDERVTEEVRKKSEKSVRDIEELLKEIKRELEEI

SEQ ID NO: 17634 - protein, 59 aa, Artificial Sequence
  Synthetic
ERVERKLEELKRRLEELEKESERELDRLRKENEDLVRRSEEELRRLRRELEEIVREARE

SEQ ID NO: 17635 - protein, 56 aa, Artificial Sequence
  Synthetic
SEAEKVLKEVEDIIREVEEENRRLIREIEEEIRRVKEEVERLLRKSEKDIKEVEES

SEQ ID NO: 17636 - protein, 56 aa, Artificial Sequence
  Synthetic
EKLLREIERRMRELEKTSRKLLKEIKKKAKELKEKAEEVLRRSRKRTEELVDRLRK

SEQ ID NO: 17637 - protein, 60 aa, Artificial Sequence
  Synthetic
DVEDLIRELRKRLDELRKESEELLRRSKRKHEKLLTDSRKLLRDIEREARKLLEDVKRKG

SEQ ID NO: 17638 - protein, 59 aa, Artificial Sequence
  Synthetic
REMIETLIRKAKEIIDRLREENRRAVRRSDETLRRLKEENDKVITDVKRKIKELRDEVK

SEQ ID NO: 17639 - protein, 60 aa, Artificial Sequence
  Synthetic
SIDEEITRLEEESRRDEEESKRLLEKSRDDHRRLLERSEKLLRELEKRARDLLEDVKRKG

SEQ ID NO: 17640 - protein, 59 aa, Artificial Sequence
  Synthetic
EEMVRRVIEKYERAVERSTEENRDAFRRSEETIRELAKENEDAIREVKEIIDKLREDVR

SEQ ID NO: 17641 - protein, 60 aa, Artificial Sequence
  Synthetic
DVEELIKELERRLRKLLEDSRRLLEESRREHKKLIDDSRRLLDELRRRLERLLEKVRRRG

SEQ ID NO: 17642 - protein, 59 aa, Artificial Sequence
  Synthetic
REVIEAVIRKAEDIIRRLRRKNEKAVEESRENIKEIKRENKRVIDEAREIIKRLEEELE

SEQ ID NO: 17643 - protein, 60 aa, Artificial Sequence
  Synthetic
SVEDLLRRLEEESRKDLDDSRRLLDESRKRHEDLLRKSEELLRELEERLRRLLEKVKKKG

SEQ ID NO: 17644 - protein, 59 aa, Artificial Sequence
  Synthetic
EDVIRKLIEDYERLVKESTDRNRRAVEKSRENLKRLDKENRDVIEKARRIIEELEKEVK

SEQ ID NO: 17645 - protein, 59 aa, Artificial Sequence
  Synthetic
SVDELIEELRRRLEKLLREAEELLKESRKRHEELKKRSKELLDELEREVERVLEELRRK

SEQ ID NO: 17646 - protein, 59 aa, Artificial Sequence
  Synthetic
EEVIERVIRKADEIIKRLKKELREVVERSKENIKKLEEENRRVIKKAREELRKIEEEIR

SEQ ID NO: 17647 - protein, 60 aa, Artificial Sequence
  Synthetic
SEVDEVLKTLKELIERLRERVKEVLKRLEKLLKELEDLSRETVRELRETNDDLRRKAEKT

SEQ ID NO: 17648 - protein, 56 aa, Artificial Sequence
  Synthetic
REAAEKVRRDVDRLRKEVEEMLERVKRKLDELRKDSDRLAREVEDSTRKIERDVEK

SEQ ID NO: 17649 - protein, 61 aa, Artificial Sequence
  Synthetic
SELEEMVKKVKEIIDRARERIRELIERHKELDRESRKRIEDIIREARELNKDVKRVIKEIK

SEQ ID NO: 17650 - protein, 56 aa, Artificial Sequence
  Synthetic
DEALEELKRRVKRLEEKLREDIKRLRENNERIREDVERLAEELDRHTRKLMEEVKK

SEQ ID NO: 17651 - protein, 60 aa, Artificial Sequence
  Synthetic
SELEDIVEKAKKIIEDVRRRIEKLIRDDKRLNDESKKTIEELIRKARKLNEEAERIIRKI

SEQ ID NO: 17652 - protein, 56 aa, Artificial Sequence
  Synthetic
RELLEKLRRDVEELEREVRELLERLKENSKRIEDEVRELMKELKRHTEELEREAER

SEQ ID NO: 17653 - protein, 60 aa, Artificial Sequence
  Synthetic
RELEEIVERAKEIIRRVAEKIKKLIEEAERLDRDSKRKIDELIEKVKKLNEDVRRTIEEI

SEQ ID NO: 17654 - protein, 56 aa, Artificial Sequence
  Synthetic
EEMLRRLTELLKELADEVKKLLDRLKENNEKIREDVERLLRELEEHTKKLEEDVTR

SEQ ID NO: 17655 - protein, 60 aa, Artificial Sequence
  Synthetic
SEEERVLKELEDVLREHKRKADESSRKLEEVHRRHRKRMEESKRELEEVHKEAKDRITKN

SEQ ID NO: 17656 - protein, 55 aa, Artificial Sequence
  Synthetic
EELEDVERKARELEERNKKLLKDSEEATEELRRENEEMLEESKRRTEKLEREVRT

SEQ ID NO: 17657 - protein, 57 aa, Artificial Sequence
  Synthetic
DKVREVLRESEKLLEDWDRELKEVLKDFKRTLDELEERLRDVLRKNKKSLEDLKRRG

SEQ ID NO: 17658 - protein, 55 aa, Artificial Sequence
  Synthetic
DRIMRELRELNRRLDESVKEIRDRLRRILDKLRKMIEKLKKELEDTDRELEERVR

SEQ ID NO: 17659 - protein, 57 aa, Artificial Sequence
  Synthetic
SKAEEVLKTSEKLLEEWRRRVKEVEDRNEETIKRLKEELDRALKENEESLRELEKRG

SEQ ID NO: 17660 - protein, 55 aa, Artificial Sequence
  Synthetic
DRISEELKKLNEELERELRKLSEELKEVDREAKEEIRRLVEELREIDKRLEEETK

SEQ ID NO: 17661 - protein, 57 aa, Artificial Sequence
  Synthetic
SEAEKVLTDFRDALEKDRERNERVLRENEETIRRDKEENERVLRENDKSLKELRKRG

SEQ ID NO: 17662 - protein, 55 aa, Artificial Sequence
  Synthetic
DRIKKTLERLLRESKKASEKLKDDLRKLDKRSKEESRRLTERLREIDEELRRRVD

SEQ ID NO: 17663 - protein, 57 aa, Artificial Sequence
  Synthetic
SEAEDVLRRFEEELRRDDEKNERVLRRNEETNRRDDETNRDVLRRNKESLDKLRKRG

SEQ ID NO: 17664 - protein, 55 aa, Artificial Sequence
  Synthetic
KRIKDELRKLLKRSEERSEELRRRLEDLDRRSKETSDKLREELERLDRDVERKVN

SEQ ID NO: 17665 - protein, 57 aa, Artificial Sequence
  Synthetic
SEAEKVEDDVRRVLETDEKKNRDVLDTNRRTIEEDRKRNEEVLRKARKMLEDLKRRG

SEQ ID NO: 17666 - protein, 55 aa, Artificial Sequence
  Synthetic
ERLRETLEELLRRSDERSRRIMEDLKRLDTDSKRVSEELKRRLEELLKDLERKVR

SEQ ID NO: 17667 - protein, 59 aa, Artificial Sequence
  Synthetic
SEVDEITKELEESLKDLDRVVRELREKIKKIDKELAETVDKLTEEAKEILKTLRDIIRR

SEQ ID NO: 17668 - protein, 62 aa, Artificial Sequence
  Synthetic
KKLKEKVDRVHKRHKDRLDEIKRKLKKVLEDNRETLERIKRKLRKVLEDLKRMLDELERELR

SEQ ID NO: 17669 - protein, 60 aa, Artificial Sequence
  Synthetic
KETEDLVRRLRKVLKELEERVRTLMRDNERVNKEIADKIRRLREKLREEDERVDEVVKRR

SEQ ID NO: 17670 - protein, 55 aa, Artificial Sequence
  Synthetic
REVLREMDERVKELEERLERVLRKSKTDADRWRRELKRVLEEHDKTVKEIREKTR

SEQ ID NO: 17671 - protein, 61 aa, Artificial Sequence
  Synthetic
KEKDEVVKRYEDRIKEIRERLKEVVTEHEDRLRKWRKDLEEVVERNRRSIKKIDEEVKRRG

SEQ ID NO: 17672 - protein, 55 aa, Artificial Sequence
  Synthetic
EDVVRKLDEDLKRNEDHLEEVRKELERLNEEIEKLIRDLLEILRRIDKELRDKLE

SEQ ID NO: 17673 - protein, 61 aa, Artificial Sequence
  Synthetic
DEEKDVTRRVREVIKRLEEELEEVVRRHRESLKRLKERLEEVVRRNRKSIREIEKEVKDAG

SEQ ID NO: 17674 - protein, 55 aa, Artificial Sequence
  Synthetic
EDVDRELARMLEELRDLLRRLAEELKRIDEELEKELRDVARELEKIDRDMREELR

SEQ ID NO: 17675 - protein, 61 aa, Artificial Sequence
  Synthetic
DERKEVEERYRREIERIKTKLKEVVKRHEDSLKKIEDDLEEVRRDNERSIKEIREEVRKKG

SEQ ID NO: 17676 - protein, 55 aa, Artificial Sequence
  Synthetic
EDVDRELKEDLERNERHLEEVTRRLRKIDKDLKEKLKRLEEELKKIDREARERLR

SEQ ID NO: 17677 - protein, 60 aa, Artificial Sequence
  Synthetic
KEIEDVKRRLEELDRRIKELVDRVRRKLEEVDTRAEKELRDVRRRLEELLERLEELIRRG

SEQ ID NO: 17678 - protein, 58 aa, Artificial Sequence
  Synthetic
KELRDVIKENEDTLRRLKEEVEKVTKENEETLRRIERELDKVERDVERRIRELEEERR

SEQ ID NO: 17679 - protein, 57 aa, Artificial Sequence
  Synthetic
SEVEKVLEDNKRSIDRLEEELRKVTRTSRELLKEWAKRLEDVLRDVKRAVDELETRG

SEQ ID NO: 17680 - protein, 59 aa, Artificial Sequence
  Synthetic
SDEIRKLKEELKRLDEEAARILETIMRRNKDLNDRLREIIETLKKRLKDLLKEVEDRAR

SEQ ID NO: 17681 - protein, 60 aa, Artificial Sequence
  Synthetic
DAEKLREDVERTLRRLRKELKDSIKRNREELERLERKLRKSIKETEDEVRKLEEKLERRL

SEQ ID NO: 17682 - protein, 55 aa, Artificial Sequence
  Synthetic
DDVRRLVEKIEREVRKLIEDHKKKSEDIVRTVEKLIEDHKRRVDRISEEVEEELR

SEQ ID NO: 17683 - protein, 61 aa, Artificial Sequence
  Synthetic
SKEDLKRKVKKILEDVERELRRSIEDTERLLREVEKRLEDSVRENRRKLREVEEKLRRRLK

SEQ ID NO: 17684 - protein, 55 aa, Artificial Sequence
  Synthetic
RRVDELVKEIEERARKLIKEHRDRVRELLRELEELIERHKELSERILKELEELLK

SEQ ID NO: 17685 - protein, 58 aa, Artificial Sequence
  Synthetic
SEKEEIARRLEKVHREHREELKRLEDRLREVLKRNRETIEDIRRKLEEVLRRLRERLV

SEQ ID NO: 17686 - protein, 56 aa, Artificial Sequence
  Synthetic
EEKLRRDVERIVKEAEDTLRELERVVRELEKEVRETDKRLDERVKELEEKVRRAAK

SEQ ID NO: 17687 - protein, 59 aa, Artificial Sequence
  Synthetic
SEEEDARRLLEEVERALREIKKRLKELLERHRRAVEELKKRAEDLLDEHRRAIERIADE

SEQ ID NO: 17688 - protein, 55 aa, Artificial Sequence
  Synthetic
EEIKRRLKELAKDLRRAIKEVKERLKESHDELKRAIEDVKRKLEELDEKLKRDED

SEQ ID NO: 17689 - protein, 57 aa, Artificial Sequence
  Synthetic
SERERVERSVEELIRRYREVLEESERRNRKLLKRYEDALKKSREDNKRLLDELRRAN

SEQ ID NO: 17690 - protein, 56 aa, Artificial Sequence
  Synthetic
REDAERLLERIERHLRRSEKTSEELNRRLEDHARRSIEESKKLNEELERKLRELER

SEQ ID NO: 17691 - protein, 57 aa, Artificial Sequence
  Synthetic
SSEETLRDINRKISKAIEEIEREAREIDRELRKAVEDLKREAEEIDERVREVIERIG

SEQ ID NO: 17692 - protein, 62 aa, Artificial Sequence
  Synthetic
TEVKKVLDKNEELLKRWEDRLREVLERNRKTLREIERELEEVLRKNRESIKKLKRELEEASR

SEQ ID NO: 17693 - protein, 57 aa, Artificial Sequence
  Synthetic
SSEEDLKRIDDELDKMVKDIERKIRRIDTELERVVKELKEDIERSLERLREVVERIG

SEQ ID NO: 17694 - protein, 62 aa, Artificial Sequence
  Synthetic
RDVRRVLDENRKTLEDLKRKLKEVLDRNRETLKRIEKELREVHEKHNRALDELRKELEDRRR

SEQ ID NO: 17695 - protein, 57 aa, Artificial Sequence
  Synthetic
SVEEEAEDILRRLDKTVRDLEREAEKIDEDLERVVRKLEEELRRSLEELRKVVEEIG

SEQ ID NO: 17696 - protein, 62 aa, Artificial Sequence
  Synthetic
RDVTRVLRKAERVLKEIEEKLRDVLRRNRETLKRIEDELERVHRDHNRKLKRLKEELDERRR

SEQ ID NO: 17697 - protein, 56 aa, Artificial Sequence
  Synthetic
DEDRDVEEKIKKIIKAAEDVNKESEERITELKKRLREIHERSERLIRRIEEEAKKK

SEQ ID NO: 17698 - protein, 56 aa, Artificial Sequence
  Synthetic
KKKLDEIIERLRKLLEDLEERNRRVIKELEDLIKENEELNRKVIRDLEKLVEDAER

SEQ ID NO: 17699 - protein, 55 aa, Artificial Sequence
  Synthetic
DEEDEVRKRVEESERESRKLLTDVKREADRLKEHDKRLLDEVKKLLDKIREDLKK

SEQ ID NO: 17700 - protein, 60 aa, Artificial Sequence
  Synthetic
REELKRELDRIIEELKELNKRLEERLRELIRDWERVSRELAERLKRIIDKARRLLEEVAR

SEQ ID NO: 17701 - protein, 57 aa, Artificial Sequence
  Synthetic
DEVEELLKELKDLSRESVRELRRLDEELKDLSRRSLKRLTDLDEELRREVEERRKEN

SEQ ID NO: 17702 - protein, 55 aa, Artificial Sequence
  Synthetic
ERLKKLADDSRKRLRDVERHHEKLVEDSERRLKTIKDHHKKAVEDIRRDLRETKR

SEQ ID NO: 17703 - protein, 56 aa, Artificial Sequence
  Synthetic
SEIDEVLKEIKRIIDELRERNRKHNEEVKDRIRRLEEELRKDLKDLKEIVERLAKS

SEQ ID NO: 17704 - protein, 58 aa, Artificial Sequence
  Synthetic
EAADRARELEKELKDISDTSRKSNEELRKRLEEIKDRVRKEIEKLLRELEEIVKEKRR

SEQ ID NO: 17705 - protein, 60 aa, Artificial Sequence
  Synthetic
DEEKETIKRHRESVREAERRLRDTLRRNRELVERLKRTLEDILRKHEKLVEELEEMAKRG

SEQ ID NO: 17706 - protein, 55 aa, Artificial Sequence
  Synthetic
EELKESHKDLKKIHEDAERRVRESHTDLRRIIEKVKEDLERSHRKLKRIADETRK

SEQ ID NO: 17707 - protein, 57 aa, Artificial Sequence
  Synthetic
SEMEEVLERDERKVRELEREIEKNLRDHKDEVRRLREDLERVLREDEKLVRELRKKN

SEQ ID NO: 17708 - protein, 59 aa, Artificial Sequence
  Synthetic
EELEDRMRRSSKRLEEVLRESEERLKRSDEDLRRVIDEIRRRLEESTRRLEETIKELKD

SEQ ID NO: 17709 - protein, 60 aa, Artificial Sequence
  Synthetic
SEREEVLKDIRRLLDEVRRRIEDLLEKLRRLNEEVKEKVKESEKRLRDLMRKAKELMKRG

SEQ ID NO: 17710 - protein, 55 aa, Artificial Sequence
  Synthetic
EDIKRLIEELEKLLKEAKEKAEDLTREHDDTLKKIRERHKEIIKDIEDKLDTDRQ

SEQ ID NO: 17711 - protein, 60 aa, Artificial Sequence
  Synthetic
DEEEELKKKLKAILEDLKREMREHEEKLRRSLERVARTAERHKETIKRIIDRLRKEAEDV

SEQ ID NO: 17712 - protein, 55 aa, Artificial Sequence
  Synthetic
EEVKRIAEDIKRVLEEIRKRSREILEEVKRLHKKIKDDSRKLLKDLEKLVREIRK

SEQ ID NO: 17713 - protein, 56 aa, Artificial Sequence
  Synthetic
SVEDEARRLEEKLRELTKRAREALEESNRRHRKSVEEVRRSLKKNHEKLEELARRV

SEQ ID NO: 17714 - protein, 55 aa, Artificial Sequence
  Synthetic
ERLLKELEDLIEEVERELRRVLTESKRLNEELRKRVKEIEERSEELIERLDREVR

SEQ ID NO: 17715 - protein, 56 aa, Artificial Sequence
  Synthetic
SMDESMETLTRELEDLLRKVEKKLRDSNEHHRELLEEVKRRVEENHKELDELLRRA

SEQ ID NO: 17716 - protein, 55 aa, Artificial Sequence
  Synthetic
EELLTKIRKLIRDVEETVREAERESRALDERLERTVRDVEEKSKRLIEELRRRAD

SEQ ID NO: 17717 - protein, 56 aa, Artificial Sequence
  Synthetic
DAEEEIRRIDKHHEENVRKAEEDIRRLIEHHKENVERVDRELRKIIREVEEVIRRV

SEQ ID NO: 17718 - protein, 59 aa, Artificial Sequence
  Synthetic
ERLVRELIRRLERTDEEHHKKVRRILEELKRIDEEHHRLVRRILKALKDIIKRLREEVK

SEQ ID NO: 17719 - protein, 56 aa, Artificial Sequence
  Synthetic
SLEEEIEKIERHHRKLVEEARRELKRLEDKLEKLNRDSRKRLKELAERLKKLIDEI

SEQ ID NO: 17720 - protein, 59 aa, Artificial Sequence
  Synthetic
ERVARRVLDELRRLNEKLRRMVEELVKEIERLIKKVKDDSEDVMRKLKELLKRLEDRAR

SEQ ID NO: 17721 - protein, 59 aa, Artificial Sequence
  Synthetic
REKEELLERLKKVLERTERVIRDLERRLREVLERSRKLAEDLVERLERSLKTLEKLARE

SEQ ID NO: 17722 - protein, 55 aa, Artificial Sequence
  Synthetic
EELREIYKRHEDLLRTAEERLRKVYDDHRDLLRKIDEDLKRLKERHEELLREIRR

SEQ ID NO: 17723 - protein, 60 aa, Artificial Sequence
  Synthetic
EEKDRLKKRLEELNREHEELVRRISERVRRLLEKAEREIRTLKKRLDELNKELEEIIRRD

SEQ ID NO: 17724 - protein, 59 aa, Artificial Sequence
  Synthetic
EKVKKELEDVERHSRDSSRRVKEELERLKEELDRRLRKVKEDLERVKRHSKKLVDDAKR

SEQ ID NO: 17725 - protein, 61 aa, Artificial Sequence
  Synthetic
SEREDLRRELEELLREHEEVVKEVKRRLEELLREHEEIVRELTERLKTINEDLKRVIKRDK

SEQ ID NO: 17726 - protein, 59 aa, Artificial Sequence
  Synthetic
EEAEKELRDVAKRLRESSREVRETVRDVADKLRESSKKLEEELRRVKKHSKKLLDEAKK

SEQ ID NO: 17727 - protein, 59 aa, Artificial Sequence
  Synthetic
SLEDLLRKVEEDAKRSIEKLEKDLKRVEDKHRELVERVKRRLDDVRRKLEEIIRDAERK

SEQ ID NO: 17728 - protein, 59 aa, Artificial Sequence
  Synthetic
ERVVREVLDELRKLLDDHNKKVKTVLDELKRSLDKLREEVKKVEDKLEEILKTLKETVR

SEQ ID NO: 17729 - protein, 55 aa, Artificial Sequence
  Synthetic
SLEELIREIEKELDDLLREHEDLLRKIKEEIERLIREARELIKRLEEENEELRRN

SEQ ID NO: 17730 - protein, 59 aa, Artificial Sequence
  Synthetic
EEEVKREIDRVRRVIEELRESVERLREEVRETLRRLKEHVKKDVEDHKETVKEVERRTR

SEQ ID NO: 17731 - protein, 56 aa, Artificial Sequence
  Synthetic
DTEDLIREIRRRLEESVRENKELLDRLRERLEESIKRNEDLLKRHRENSKRIADRV

SEQ ID NO: 17732 - protein, 58 aa, Artificial Sequence
  Synthetic
ELVKEMIDRLRDLLRRHKEESKRLVEEVKKLLDRHREESERLVRELDKMNKDLEDRAR

SEQ ID NO: 17733 - protein, 55 aa, Artificial Sequence
  Synthetic
DTKELLDELRKRLEDSARRVEELEKRVKDELERLKKRSEELLDEIRKRMKDVRDR

SEQ ID NO: 17734 - protein, 56 aa, Artificial Sequence
  Synthetic
KDELVRRLDETLKDHDRKLKELVDEAKELLRRYEEESKRLKRELDEILRRVREEAK

SEQ ID NO: 17735 - protein, 60 aa, Artificial Sequence
  Synthetic
REIEEVRKKVEKILRDYDKVVKDIVEKVRRILEEYRRKSEKLTREIEEILRRLREVIKRD

SEQ ID NO: 17736 - protein, 56 aa, Artificial Sequence
  Synthetic
EDSLREIRKEARRLHEKSKKLLDEIRKRAEDLERETKKLLDDIKRELEDVVRELEK

SEQ ID NO: 17737 - protein, 56 aa, Artificial Sequence
  Synthetic
RELEELLKRAEEVIKELKKSIDTMKEENDRLITELAKRVEDLKKRNDDVLERLKKD

SEQ ID NO: 17738 - protein, 56 aa, Artificial Sequence
  Synthetic
EEVLKEIDKRLKELEKEHEKVNRESEKRLEELLRRVEKVNRDSERELERLREERET

SEQ ID NO: 17739 - protein, 57 aa, Artificial Sequence
  Synthetic
SEIEEVLERAERLLRRVAEALRRTTKELEDLNREVADLLRRTTEKAERLIRRVKSKI

SEQ ID NO: 17740 - protein, 56 aa, Artificial Sequence
  Synthetic
VEELKRVADEVVKKADDLVDEDRKLAKDSVDELRRLVEKDEKLAKDVVEEVEKLAE

SEQ ID NO: 17741 - protein, 60 aa, Artificial Sequence
  Synthetic
SLEDAVRKARELIKRAEDILRRAVEEAKKLHKRSKEILEKAVEDAKRLYEEAKDAARKAG

SEQ ID NO: 17742 - protein, 56 aa, Artificial Sequence
  Synthetic
AKTILDKAREVAERVARLARKLLEDSRKVARESAELAKRLLEYAKKSAEDAKRKAK

SEQ ID NO: 17743 - protein, 60 aa, Artificial Sequence
  Synthetic
SIDEVLKELEDVARKSKEKNKRVHDDDERVVREVHKENRRVLRELEEMAERVRRELEKRG

SEQ ID NO: 17744 - protein, 60 aa, Artificial Sequence
  Synthetic
EEKVVRRVKDIARHNLELADRSVEESRKSVKENKDLVDRSVKKVEDLVRELKRLVDEIKR

SEQ ID NO: 17745 - protein, 60 aa, Artificial Sequence
  Synthetic
SIDEALTRLERAVEESHKRNEDVHRRDEEAVREVHKRNREVVKKLEDEVRKVIERLRRRG

SEQ ID NO: 17746 - protein, 60 aa, Artificial Sequence
  Synthetic
EEEVVRRIDELVEHNKDLVRRSVDESDKSVETNKDLVEKSVRRVDKLVKDLRRLVDEIER

SEQ ID NO: 17747 - protein, 60 aa, Artificial Sequence
  Synthetic
KIDEALKRLREVVKRSHEENEEVHKEDEKVVRELDKENKDVLKELDEAVKRVEKKLRDRG

SEQ ID NO: 17748 - protein, 60 aa, Artificial Sequence
  Synthetic
EDEVVKRIDELVTHNKRLVEESVERSKESVDRNRRLAEKSVEDVRRLVEELKKLVDDITR

SEQ ID NO: 17749 - protein, 59 aa, Artificial Sequence
  Synthetic
SLEEVLRRLEKVVRDSDKRLEEVLTRLAKVVRESNKRDEDVHKELRDVVRRVEELLERS

SEQ ID NO: 17750 - protein, 56 aa, Artificial Sequence
  Synthetic
EETVDKLVEDNERLVREIVKEVDELVKRNEDRARESVDESRKLVRRIEERVREETR

SEQ ID NO: 17751 - protein, 56 aa, Artificial Sequence
  Synthetic
SVEDVLREAKRVLDEVRERLREVNTETNKVIKDVKKESDDVNRETNELIERVAREV

SEQ ID NO: 17752 - protein, 55 aa, Artificial Sequence
  Synthetic
EEVERLVDEVRKLVKRLVEHVKKLAKEIKELLERNVRHVEEVAERIKRLIKETKD

SEQ ID NO: 17753 - protein, 60 aa, Artificial Sequence
  Synthetic
ELREDVERVVDEIRRLVEENVRRIDEVAKDIKRLADDNVRRVKELVRKIEEDIRRLKEEG

SEQ ID NO: 17754 - protein, 56 aa, Artificial Sequence
  Synthetic
ERVLKKLKEVIEDVERKSRDALRRLEEAIRRVRRESERVNRELDEVIKRVTEELKK

SEQ ID NO: 17755 - protein, 58 aa, Artificial Sequence
  Synthetic
SAREKVEKVVKEVEELVKRDVEEVERIVEEVKKLVTEDLKISEEIVERVDRLIRELKK

SEQ ID NO: 17756 - protein, 56 aa, Artificial Sequence
  Synthetic
ERVLKKLEDVVRRVEKESEDALRRLKEVIKKVKRESEEANRKLEEVIRRVVERVRR

SEQ ID NO: 17757 - protein, 59 aa, Artificial Sequence
  Synthetic
SRSEKLVDEARKMVERSKEIVDKSEREVEDVVRRARRNVEKVLKDAKKVVDEVDELTKR

SEQ ID NO: 17758 - protein, 55 aa, Artificial Sequence
  Synthetic
EDVLREVEELVRRVEEENDRVLKRAKELVEDVKRKHDRVLETVRKLVEDVTRRLK

SEQ ID NO: 17759 - protein, 57 aa, Artificial Sequence
  Synthetic
DEVDKVKEELERVIKEVDERNKRSSERLEEVNRKIRKEIKEVVERLKELIERVLRKV

SEQ ID NO: 17760 - protein, 56 aa, Artificial Sequence
  Synthetic
VDEIRRLVEEVLRRARKLVEEDKELIKKSLKDLKTIVDELRKLLEDVIREAERTAR

SEQ ID NO: 17761 - protein, 55 aa, Artificial Sequence
  Synthetic
EEVERILEDVRRMIEDHRRKVEEIVKRSEDMARRLIEEVKRIVEESKKLADELKK

SEQ ID NO: 17762 - protein, 55 aa, Artificial Sequence
  Synthetic
EDVRRELKRLVDEVKKRNDEVRERDKEVVDRVKEVLDRVRETDRRLVEEVRRRAN

SEQ ID NO: 17763 - protein, 55 aa, Artificial Sequence
  Synthetic
SRVEKILEDVKEEIKKHKEEVDRIVKRSREMAKRHIERVDEILERSRRMIEELKK

SEQ ID NO: 17764 - protein, 55 aa, Artificial Sequence
  Synthetic
EDVERELRRLVEEVEKRNEDVEREDRRLVEEVKKRNDEVRKEDRRLVEEVKERAR

SEQ ID NO: 17765 - protein, 61 aa, Artificial Sequence
  Synthetic
DELEKVEKDVRRLLEKVRKRIDEVRKEVERLSRESEEVTRRVLETVEKLLKDVERVIRETL

SEQ ID NO: 17766 - protein, 56 aa, Artificial Sequence
  Synthetic
VEEVLETVKRLIERIEEEIEKVVKDVERLVRESIKHSRDVLKEVDDLIKRIRERVK

SEQ ID NO: 17767 - protein, 56 aa, Artificial Sequence
  Synthetic
DDDKRIREILRRVHEKSEKVLRKVRKRLEEVRRESEEVVRRVKKDLDRVLEEVRRK

SEQ ID NO: 17768 - protein, 55 aa, Artificial Sequence
  Synthetic
EDVAREVEEIAKRTIDRVEAIVREVERIARESIDNVRRVVEEVKRAVTELIKRVE

SEQ ID NO: 17769 - protein, 56 aa, Artificial Sequence
  Synthetic
SEDETIRRIVRTVHEESRKSTEDVRREVERVLRESEEVVKKVKKKVDDVLKRVEET

SEQ ID NO: 17770 - protein, 55 aa, Artificial Sequence
  Synthetic
EEVAREVTKIARDTIRENEEIAKEVREIVERSIKNLEEVAEEVERVVRELIEARR

SEQ ID NO: 17771 - protein, 56 aa, Artificial Sequence
  Synthetic
SRDEKIRDILRRVLKEVRDSTKKVEEDLEDVHRRTEEELRKVKKRLDEVLKRVRDE

SEQ ID NO: 17772 - protein, 55 aa, Artificial Sequence
  Synthetic
EKVAEEVKRIADRLIDLNRRIAEEVDKIVRDSIKKVEEIVTEVEKIVEKLIRDVR

SEQ ID NO: 17773 - protein, 55 aa, Artificial Sequence
  Synthetic
DRLEKIVEEVRRLADELIRHVERNVREVEKAVRESIEHVRDVAEKVERAVRELEK

SEQ ID NO: 17774 - protein, 55 aa, Artificial Sequence
  Synthetic
EEVRKELKRVIREVEKVNKESNDVTRKVKEESEKVLKEVEKRLREVIRRVKEKIR

SEQ ID NO: 17775 - protein, 55 aa, Artificial Sequence
  Synthetic
SEVEDVVRKVEKLVRDLIKHVEENVRRVEEVVRKLIEEIKRIAEEITRIAEELAK

SEQ ID NO: 17776 - protein, 55 aa, Artificial Sequence
  Synthetic
EEVEKVLREVVKEVEKVNRESREVTRRVLEEAKEMLERVKKIVKEVIEKVRRVVK

SEQ ID NO: 17777 - protein, 60 aa, Artificial Sequence
  Synthetic
SADREVEERLREVIERVKEALKRSKDVTDEVTRRVEKLDKESNDTSREVIRRVEDMLSRV

SEQ ID NO: 17778 - protein, 59 aa, Artificial Sequence
  Synthetic
DELVKRIVEKVDKAVKDLEKLVRENVERVRRAVERSRKTVEDNVKRSRDVVRELRERVR

SEQ ID NO: 17779 - protein, 60 aa, Artificial Sequence
  Synthetic
SSIDEVREEIRRVIEEVRKLLEESKKDTDRVRREAEDMDRKANETVEEVERRVREVLRSV

SEQ ID NO: 17780 - protein, 59 aa, Artificial Sequence
  Synthetic
EEVVRRILKRIEEVLKKLRKAIKDNVDRVRDAVRRSRRTVEDIVRRVREVLERLEREIK

SEQ ID NO: 17781 - protein, 56 aa, Artificial Sequence
  Synthetic
SLAEEVERRLEESHKRARKLVKEVKEALEESHKESDRLVREVEKELKRVAEEVRKE

SEQ ID NO: 17782 - protein, 56 aa, Artificial Sequence
  Synthetic
VEKVRDLVRKTTEKVEEVVRRLRELVKENLDEAKRVVEDLKRKVKEIEEKVKEDSK

SEQ ID NO: 17783 - protein, 56 aa, Artificial Sequence
  Synthetic
SMAEKVDEVSKRSKEELKRVVKEVHEVSTRVEKVVKDVLREVEKVSKESTDVVDRV

SEQ ID NO: 17784 - protein, 59 aa, Artificial Sequence
  Synthetic
REVVDKVVRDLEKTVKDVKEVVDRAVTASKELVDRIRRLAEEVVRALERTVDKVRRDAK

SEQ ID NO: 17785 - protein, 56 aa, Artificial Sequence
  Synthetic
DAREEVDEVSRESKEELKRVLDEVDDVSEKSRKTVRDMLRKNKEVVDEVEKTLEDV

SEQ ID NO: 17786 - protein, 59 aa, Artificial Sequence
  Synthetic
KEVVKDVVRKLRETVKRVREVAEEVVRELEKTVDEVRKRADDSVKKHRDLVKEVKEAAD

SEQ ID NO: 17787 - protein, 56 aa, Artificial Sequence
  Synthetic
SAEEDVERVVREVEREVREALRRVREVSERSREDVRRVVDENRKVAEEVEKRVRDV

SEQ ID NO: 17788 - protein, 59 aa, Artificial Sequence
  Synthetic
EEVVREVVKKLREIVKDIRRLAEEVVRRLEDTVRKVREIAKRSVDAHRELVRRVEERAR

SEQ ID NO: 17789 - protein, 56 aa, Artificial Sequence
  Synthetic
SSAEEVERVLRRVEEEDRRLVAEVRRVLKESRRTLEELVRRVKEVLEEVRKEVERI

SEQ ID NO: 17790 - protein, 56 aa, Artificial Sequence
  Synthetic
AKELIKRVEEIVEESRKLIDEAIREVEENVDRSRKKIKELIDRVREILKRARDRAR

SEQ ID NO: 17791 - protein, 56 aa, Artificial Sequence
  Synthetic
DSEEEVKKVLDEVRRRDEKLVEEVRKVNEDSLDTLRKLAEEVKRKLDEVRERVERL

SEQ ID NO: 17792 - protein, 56 aa, Artificial Sequence
  Synthetic
AEELIREVERIVKKSEDMIREHIRKVEENVEESKKEIEELIRRVDDILREAKEAAD

SEQ ID NO: 17793 - protein, 56 aa, Artificial Sequence
  Synthetic
SGEEDLERVLDEVRRRDKKLVEEVRKRNEDSLRRLERLAEEVERVNEDVLKKVEEL

SEQ ID NO: 17794 - protein, 56 aa, Artificial Sequence
  Synthetic
ASEVRKLVEEIVTDSRRRITEHIRRVEENAKDSERVIREHKERVKEILEKVRRAAE

SEQ ID NO: 17795 - protein, 59 aa, Artificial Sequence
  Synthetic
SEVEKLVEDVKKAVKEVLEEAKENVRKVEDVVRRVLERAEDNVEEVKKVVATLVDLVRR

SEQ ID NO: 17796 - protein, 59 aa, Artificial Sequence
  Synthetic
EELMREVRRVIKEVRDRVRDVLDEVRRVNEEVNRRVRKVLEDVRRVNERTKEDLDRESK

SEQ ID NO: 17797 - protein, 59 aa, Artificial Sequence
  Synthetic
SEVDKLVREVDELVKKSKDNIDKLVKRVREMVEESKRKADRNVEEVERVVREIKDLARR

SEQ ID NO: 17798 - protein, 59 aa, Artificial Sequence
  Synthetic
DELVKKVRDRLEEVERRTRKALEDVKRVLEDVKRLTDTALREVERVNRKTEEEVDREIR

SEQ ID NO: 17799 - protein, 59 aa, Artificial Sequence
  Synthetic
DKVDRVVKEIEEAVKENLDRVREIVKEVRDLVRENLEEVRKSVEDVKRLVKEILELVRA

SEQ ID NO: 17800 - protein, 59 aa, Artificial Sequence
  Synthetic
EDAVRKVEEVLREVEKRSTEALKELRDVLREVRRESEEALDENRRVTEEVKKKVEDERK

SEQ ID NO: 17801 - protein, 59 aa, Artificial Sequence
  Synthetic
SEVEEIVREIRDLVRKNEERVKKIVEDVRRAVEEILELAERSVEKVKRLVDDLRRLAEN

SEQ ID NO: 17802 - protein, 59 aa, Artificial Sequence
  Synthetic
EEAVRKVDRVLEEVEKRSRDALKELEEVLKEVERLAREVLEKNERVTEAVEDLVTKAAK

SEQ ID NO: 17803 - protein, 59 aa, Artificial Sequence
  Synthetic
DEEERVREELERVNEEVKELKKEVETVNKRVHETLEKVIREVKKVNDDVHRTVEDLRRR

SEQ ID NO: 17804 - protein, 56 aa, Artificial Sequence
  Synthetic
VEEIVKKIKEVVDRTRKLAKELVKESRDLAEDVKRLIKRLVEDSRRLVEEIKERAR

SEQ ID NO: 17805 - protein, 60 aa, Artificial Sequence
  Synthetic
SEEERVEKRLREVNKDVKRLVKKVRDVNRKVHEDTKRLVEEVRRVNRDVHRRVKELREAG

SEQ ID NO: 17806 - protein, 56 aa, Artificial Sequence
  Synthetic
VDKIVEEIDKVVTETRELAERLVKESEDNVERSRDLARKLVEKSERLVKEIDDRAR

SEQ ID NO: 17807 - protein, 59 aa, Artificial Sequence
  Synthetic
SAAEKVREELERVNRRVEELLKKVKKVNEEVRDIVRKVVREVERVNKEVEEEVKRLVDQ

SEQ ID NO: 17808 - protein, 56 aa, Artificial Sequence
  Synthetic
VEEIVKKIKDVVKRTDELAERLVETSERLARTIKKVAEDLVRDSKRIVDEVRTRIT

SEQ ID NO: 17809 - protein, 59 aa, Artificial Sequence
  Synthetic
SDEDRVRRRLEEVNREVEELLRDVERVNEEVKRRVKKVIREVEEVNKRVEEEVKRLRDE

SEQ ID NO: 17810 - protein, 56 aa, Artificial Sequence
  Synthetic
VEDIVRKIDDVVRETRELAKELVKHVRDVVEDVRRLVKELVDLSEKLVKEIRDKVE

SEQ ID NO: 17811 - protein, 59 aa, Artificial Sequence
  Synthetic
SEVEKVVKEMEDLARENERLAREIVKDVERLVREIEDTVRRSVETTRRLVEEIRELAER

SEQ ID NO: 17812 - protein, 59 aa, Artificial Sequence
  Synthetic
ERVLELLERVLRELEKVVEDSKRRIKEVLDELRKAVDKVKKEDKKVHDELRKVVEEVRT

SEQ ID NO: 17813 - protein, 60 aa, Artificial Sequence
  Synthetic
RVEELLRKVITELDRVLEEVRRRNEASIEELDRVLKEVERLNKEVDEELKKVLEKVRKDV

SEQ ID NO: 17814 - protein, 59 aa, Artificial Sequence
  Synthetic
EEVVRRIVEEIKKVIDELREESRRTVREVEKLVKEILDRSRKTVEEVKRLAEEIERKAK

SEQ ID NO: 17815 - protein, 60 aa, Artificial Sequence
  Synthetic
RVKELVDEVKRKVEESMRESTERNRTATEKVEKSLRDSEKLNRDATRKLKKVVDDVRREG

SEQ ID NO: 17816 - protein, 55 aa, Artificial Sequence
  Synthetic
EEVVKKVEDVVERNKDLVRKSVEHIDKVVKENRELVKRSVEHIDRVVKEARERAR

SEQ ID NO: 17817 - protein, 60 aa, Artificial Sequence
  Synthetic
SAEELVKRVLDDVRRSAEESERLNREATEEVKRSLEKSRKDAERVLRDLERVVRKVKTEG

SEQ ID NO: 17818 - protein, 55 aa, Artificial Sequence
  Synthetic
ERVVRKVEAVVERNRKLVEDSVRHIREVVKRNEDLVRRLVEEVKRVVKKAEDKAR

SEQ ID NO: 17819 - protein, 60 aa, Artificial Sequence
  Synthetic
DVEELVKKVEDMVRKVIEEVKKRNTDVTRRVEESLRKSTELVREAEERLRRTLEELRRRG

SEQ ID NO: 17820 - protein, 55 aa, Artificial Sequence
  Synthetic
EEVVRKAEEVVKRAKELVARSVKHVDEVVRRNEELVTRLVRELDELVKEVRETAR

SEQ ID NO: 17821 - protein, 60 aa, Artificial Sequence
  Synthetic
RAERLVREVARRLEEVLKEVEKLNKDATDKVKKSLEDSRKKNEDVTREVRRVIEELRTRG

SEQ ID NO: 17822 - protein, 55 aa, Artificial Sequence
  Synthetic
EDVVRRAEELVERLRKIAEDSVRHLEEVVRKNERLVKESVDHVRTAVEELKETAR

SEQ ID NO: 17823 - protein, 59 aa, Artificial Sequence
  Synthetic
DAEEKVKEVEREVEKVIEEVKRDNTRVTEENKRVLDTVRERNKRVTDELRKVLEDVRRE

SEQ ID NO: 17824 - protein, 55 aa, Artificial Sequence
  Synthetic
EEVVKRIADVVKTVKRRVDESVKDIKRSVKETEDRVDRSVRHVEEVLKELRKASE

SEQ ID NO: 17825 - protein, 60 aa, Artificial Sequence
  Synthetic
SAEDKVRKVKKEVEKVIKDVKEENRRVTRENEEVLDRVKKDNERATRKLRKVVEDVRREG

SEQ ID NO: 17826 - protein, 55 aa, Artificial Sequence
  Synthetic
ERVVERIKRVVERVDELVRRSVKDVKDSVRETRKLVDDSVKDIDRVVKEARDRAK

SEQ ID NO: 17827 - protein, 59 aa, Artificial Sequence
  Synthetic
DAKDKVRKVLEEVKKVIEEVERRNRTVTRENERVLKEVKDRNTEVTKELKKVVEDVKRR

SEQ ID NO: 17828 - protein, 55 aa, Artificial Sequence
  Synthetic
EEVVDRVRRVVEEVTELVRRSVEEIKESVKTTRDLVRKSVKNIRDLVEEAKRRAD

SEQ ID NO: 17829 - protein, 59 aa, Artificial Sequence
  Synthetic
DEVETVVRDVKRLVRENERKVREIVKTVDKLVKENEDLVKRSVEELKKLAKEIKDLADE

SEQ ID NO: 17830 - protein, 55 aa, Artificial Sequence
  Synthetic
EDLRRVKKEAEDVVRDSERLIEEVKRRVKKVVDDSRRKDEEALRDVERVIEEVRR

SEQ ID NO: 17831 - protein, 60 aa, Artificial Sequence
  Synthetic
SEVDDVVRRVKKLVKEDRDLVRDSVRKLDELVRDDKRLVDEVVERLERIVKEIEDLMREG

SEQ ID NO: 17832 - protein, 55 aa, Artificial Sequence
  Synthetic
EKLEEVLKMLEKVSDEVKKENDRALKKVEDVSREVKELNKEVLKRARDVVERVRT

SEQ ID NO: 17833 - protein, 59 aa, Artificial Sequence
  Synthetic
SSKEKVKKVLDKVKEVLDRVRELVKRVDRESEKVVEDVRRKNKRASEKVKTVIRDVEEK

SEQ ID NO: 17834 - protein, 56 aa, Artificial Sequence
  Synthetic
VDDVLRKVEEIVRKVKDMVRKILEKAERNVEETERVVTESKENADRIVKEVEDRAR

SEQ ID NO: 17835 - protein, 60 aa, Artificial Sequence
  Synthetic
SAREAVTEVLRKVREVLKRVEDENRKVSKELRDLLEEVERRNRDLTEKVKRLIDELKERG

SEQ ID NO: 17836 - protein, 56 aa, Artificial Sequence
  Synthetic
VERILEEAERIVKELEEVLEESLRNVKEILKKLEDALRKSEEDVRRILERVEEEAR

SEQ ID NO: 17837 - protein, 59 aa, Artificial Sequence
  Synthetic
REVEEVLRRIKEMVKRIEELVRRSEDRAKKLVDTNRDLVRRSEERFRELVKEIEDVARE

SEQ ID NO: 17838 - protein, 55 aa, Artificial Sequence
  Synthetic
EELERVLREVEKVVRDVRRRNEKATRDVRRSVEESRRLDKRALDEVRKRIEEVRT

SEQ ID NO: 17839 - protein, 61 aa, Artificial Sequence
  Synthetic
RVEEVLKRVLDKLRESNKDSERLVREALKEHEEVNKEVEDRIREVLRRVEEVLKKVEKDKG

SEQ ID NO: 17840 - protein, 56 aa, Artificial Sequence
  Synthetic
AEDIKRLVDEIVDTDRKLVEEVKREAKESVKESEELVERVKRKADRIVEEVEKTVK

SEQ ID NO: 17841 - protein, 60 aa, Artificial Sequence
  Synthetic
DEVEEVRKTIERLVDRIEDVVRRVLELSRDTVRKNEDLVRRIEEELTKLVEDIKDVSRKR

SEQ ID NO: 17842 - protein, 55 aa, Artificial Sequence
  Synthetic
ELLEEVERLLEEVLRKAEKVIEDARKLDEDVNRKSNKVIEDVARRLEKVLKEVKD

SEQ ID NO: 17843 - protein, 60 aa, Artificial Sequence
  Synthetic
SVEDVIRRVKEKSEEVLKRLKEVIDEVKKRSEDVLKEVEDAIDEVRRRSEEALDRVRRAG

SEQ ID NO: 17844 - protein, 56 aa, Artificial Sequence
  Synthetic
SEEARDLADRDVEDVERVVTDIRRLVEKNVRDVRRVVREIEDAVRRNVKEIDRRVK

SEQ ID NO: 17845 - protein, 60 aa, Artificial Sequence
  Synthetic
SVEELIERVKRRSEKVLRDAEKTIRDLKKDSKRVNDELEKVIRDVMEKSKTALDEVRRRG

SEQ ID NO: 17846 - protein, 56 aa, Artificial Sequence
  Synthetic
SEEARRLVERDVEDVKRLVEEIKKLVTDNVRTVEDLVRRIKREAEENVKEIKEEVR

SEQ ID NO: 17847 - protein, 57 aa, Artificial Sequence
  Synthetic
SDVDRAVETNDKVVTEIVERVKEVVERNREIVERISTTVDEMVRRNRDIVRRVAERV

SEQ ID NO: 17848 - protein, 57 aa, Artificial Sequence
  Synthetic
VRDLVREVLERSDELVKRVEEEVKRLLERNKKLLDDVTEAAARLLKRNKEVVEELDK

SEQ ID NO: 17849 - protein, 57 aa, Artificial Sequence
  Synthetic
SEVDRVVEENDRVVRKVEEVVREAVERNETVAERVKDTVDRMVRENEKIVDKVRKDV

SEQ ID NO: 17850 - protein, 57 aa, Artificial Sequence
  Synthetic
VEKLVRDVLRESEKLVDDVRRAVKKLLEDSEELVREVKEAAEESLRRNKKIVEDLTR

SEQ ID NO: 17851 - protein, 57 aa, Artificial Sequence
  Synthetic
DELETVLREVERVVTEVKKLNERTVRDDKEVVERVLREIDKLLKEIREKVKEVKKKL

SEQ ID NO: 17852 - protein, 55 aa, Artificial Sequence
  Synthetic
EDVERTVRKLLEEIKDSVRKSKEDVRRSVEEIERLVRKVKEDVKRLLRDIRERAK

SEQ ID NO: 17853 - protein, 61 aa, Artificial Sequence
  Synthetic
SKVEKALKKIEDVLEDIKRLVEEVVERDERLLERLEEENKRADEKSKELVKRLTDLVRENK

SEQ ID NO: 17854 - protein, 59 aa, Artificial Sequence
  Synthetic
REALERIREILEEVRKAVEDLLRKIKETLKRIRERVKRLIENLEKSLEDARKEVDRLRK

SEQ ID NO: 17855 - protein, 61 aa, Artificial Sequence
  Synthetic
DVDERIEELLRRIERLVEESERDVRRLKREIDDLVTKSLKTVEESLKRIKELVDRVSEEAK

SEQ ID NO: 17856 - protein, 56 aa, Artificial Sequence
  Synthetic
KDDVERVVRRVLKEIDDSTKEIRRIVKRVLEEIERTTRDDKRVIDEVRELIKETSR

SEQ ID NO: 17857 - protein, 59 aa, Artificial Sequence
  Synthetic
DADELVTEVRKRVRETLEEIRTILDEVRKRVKKTVEDIRTEAERVKREVDKLVKEVRDN

SEQ ID NO: 17858 - protein, 56 aa, Artificial Sequence
  Synthetic
DREIEKLLDDNRRLIEEVLRRIDELVREDEELVKRVLDRIRTVLDRIREEVDEVRR

SEQ ID NO: 17859 - protein, 59 aa, Artificial Sequence
  Synthetic
DVRELLKKVEDEVRRTLKEIERILKEVKTESDKTLKEVAELLERLDRDVKRLVKEVRDN

SEQ ID NO: 17860 - protein, 56 aa, Artificial Sequence
  Synthetic
KEEIRKLVERNKELVRDVLRRIKELLKRDKEMLEEIRERIKEIEKRLKELLERAKR

SEQ ID NO: 17861 - protein, 61 aa, Artificial Sequence
  Synthetic
SEIEEVLKRVEEMIRRSKKLTDKVLREVEKMIRELDKKTDEVLERSERLARELKELVRRDV

SEQ ID NO: 17862 - protein, 59 aa, Artificial Sequence
  Synthetic
RERIEEILRRVTEAIKRSKEDSERIRETVTRLIRESEENSKRNLERVKKVIDELREEIR

SEQ ID NO: 17863 - protein, 61 aa, Artificial Sequence
  Synthetic
DKLEEVLKRVEEMLRELDKETDDVLKTVEDLLRRLDELTDEVLKESRRAAEELKRKVDRDI

SEQ ID NO: 17864 - protein, 59 aa, Artificial Sequence
  Synthetic
EEKIREIEKKARKLIKDSRKNIRDILETVKRLIEESDKNIKENEKRVRKVIDELDKEIK

SEQ ID NO: 17865 - protein, 61 aa, Artificial Sequence
  Synthetic
REKEEIIKKVKDVVKRVKEELKKIVEESERLVREVEEELKRSNEKSRDLVRRAEEELEKKS

SEQ ID NO: 17866 - protein, 56 aa, Artificial Sequence
  Synthetic
EEELDRLIKRVEDRARKVLEDSKRTIEEIEKVARDVLRRSEETVKEVEEKARRALK

SEQ ID NO: 17867 - protein, 61 aa, Artificial Sequence
  Synthetic
SAVEEIVKEVERIVREAEKALKKSVDDNRRIVEDAVRTLKRLVEEAARLVDEARKELTKKS

SEQ ID NO: 17868 - protein, 59 aa, Artificial Sequence
  Synthetic
EDVLRELKRLLKELERVVEEVLRRDRKWLEDTRREVKRVVEELKRLLDELREVVERARR

SEQ ID NO: 17869 - protein, 61 aa, Artificial Sequence
  Synthetic
KELEDLVREIEDTVDRIEREIRKLVEDDHRSVRKAEEDNRRLVKESEDLVRRIEEEIRKKE

SEQ ID NO: 17870 - protein, 56 aa, Artificial Sequence
  Synthetic
EEVMRRLKEDIERLMEEIRREVEKLNETTKEVVKESLETHKRIIERIREVAEETRR

SEQ ID NO: 17871 - protein, 57 aa, Artificial Sequence
  Synthetic
SSLEELLKEIRKRVERIKEELDRALKEDHDIVRKALRELDEMLKKNEETVRRAMERI

SEQ ID NO: 17872 - protein, 56 aa, Artificial Sequence
  Synthetic
EDVVRKVLEELEEEARRVLRELRESLKRTEELVRRALETLKRSDEETKKLVEDIER

SEQ ID NO: 17873 - protein, 57 aa, Artificial Sequence
  Synthetic
SSLEELIKEDHRVVREAEKRLEELLKEDHDRLREAKEELERVLKRDHETLKEVVERI

SEQ ID NO: 17874 - protein, 56 aa, Artificial Sequence
  Synthetic
EEVLKKIIERTRDLVRRALRTMEESIKRTEELVKKLLDELEASIRKTEEDADRIRK

SEQ ID NO: 17875 - protein, 58 aa, Artificial Sequence
  Synthetic
SSLERLIEEDHETVRRVKKTLDDMLKRDHEVVDEARRRLDELLKRDTDIVRDAVKRIR

SEQ ID NO: 17876 - protein, 56 aa, Artificial Sequence
  Synthetic
EEVLKKIIKETKELAKEAVERLEESIKETEDLVRRVLKEMEESLRRTEELVREIER

SEQ ID NO: 17877 - protein, 56 aa, Artificial Sequence
  Synthetic
SIEEVIERIREEAERLLKELEEVNRESTRLAEDLREELRRVLENSRALVKELKERI

SEQ ID NO: 17878 - protein, 59 aa, Artificial Sequence
  Synthetic
DKSLKELLRDVERKIREVRKRLKESLERVEREIRRVREEIKRLNDESRERIERVKRRVD

SEQ ID NO: 17879 - protein, 59 aa, Artificial Sequence
  Synthetic
DAEELLRRLDKSSKETLKRNEESLRRSEETSKRSLDTNRRSLEKIEKIATDLRRKLSER

SEQ ID NO: 17880 - protein, 55 aa, Artificial Sequence
  Synthetic
ERVVREAEKLDEDNTRHSRRNLEESKRLDEENIKRSEDLLRDVRRLIEEVLEEAR

SEQ ID NO: 17881 - protein, 60 aa, Artificial Sequence
  Synthetic
SKLDEILERAKKLIDDLRKESDDVLRRDRELIERIRRKSEEVLERVKRLIEELEDRVRKV

SEQ ID NO: 17882 - protein, 60 aa, Artificial Sequence
  Synthetic
EDEVRRVLRELERLVKELKDKNKESLDELKKTNDRLEEENRESLRRAREEARRILEEIRR

SEQ ID NO: 17883 - protein, 60 aa, Artificial Sequence
  Synthetic
DELEEILKRVEKLIRDSIEKIRRILEEDRELIKELIKESREVLERVRELIKTLEKKVKDV

SEQ ID NO: 17884 - protein, 60 aa, Artificial Sequence
  Synthetic
RRTVEEVLKRIEELVKRSLEESDRVAKEVRKTNEEVKKTNEDSLRKIKELVKRILEKIRK

SEQ ID NO: 17885 - protein, 60 aa, Artificial Sequence
  Synthetic
DELEDVLREVRKLIKELEKKSREVLKRDKELIDRIRKESEEVLKRVEDVLRKLEDEVRKV

SEQ ID NO: 17886 - protein, 60 aa, Artificial Sequence
  Synthetic
KRRVDEVLEEIERRVTELNKKNEESLRRAEKTNKELDEENKESLERIRKLIEDILRKIEK

SEQ ID NO: 17887 - protein, 59 aa, Artificial Sequence
  Synthetic
DELERILEEVKRRIERLIERLREVLERDKKLIEDIRRESEDVLRRVEEVIKKIREELER

SEQ ID NO: 17888 - protein, 60 aa, Artificial Sequence
  Synthetic
RETVKDVLRKLRKIADEVRRDIERVLDEARKTNKRLDEENKDSLKKLRDRAKELLDEVRR

SEQ ID NO: 17889 - protein, 61 aa, Artificial Sequence
  Synthetic
RELEEVLKEAEKLIREITEEVKEALRRDEKTVRDNIRDLRRVLEEVRKLIEEILDRVRRRG

SEQ ID NO: 17890 - protein, 56 aa, Artificial Sequence
  Synthetic
SKFLERLEELITRLKERIDKALRDLEKTNDELRKRSEEVLRRLERLLERLREEIRR

SEQ ID NO: 17891 - protein, 56 aa, Artificial Sequence
  Synthetic
SEVERVLEDSRRTNEEIIKRLRDALRESEKTNRDIEKRLREMLKKSKETNERIKRS

SEQ ID NO: 17892 - protein, 56 aa, Artificial Sequence
  Synthetic
KKVLDKARELVRRTEEIVKDVIRKSRELVKESKERVDRVITESRRVVKKTLDDIRK

SEQ ID NO: 17893 - protein, 56 aa, Artificial Sequence
  Synthetic
SEIEEALKRSKETNERIIRKLEEVLRRSRKTNEEIIRRVERVLEDSERTNREIEKS

SEQ ID NO: 17894 - protein, 56 aa, Artificial Sequence
  Synthetic
EEFLRTVKKLVDDTRKAVEEVITRSRRLVEESERRVREVIDRMRKLVEETKRKLDK

SEQ ID NO: 17895 - protein, 56 aa, Artificial Sequence
  Synthetic
SEIEKALKESEDTNRKIKDDLRKVAERVRKLIEDVIRTLERVLRDSERTNREITRS

SEQ ID NO: 17896 - protein, 56 aa, Artificial Sequence
  Synthetic
EDVLRKAKRLVDETLKEVERVIRELEKLVEDLEETVKEVIKRSRELVDETEKRIRD

SEQ ID NO: 17897 - protein, 56 aa, Artificial Sequence
  Synthetic
EEIERALKKSEETNRDIIRKLREVNERDKRAVERDEEELKKALDESRKTNEDIRKS

SEQ ID NO: 17898 - protein, 56 aa, Artificial Sequence
  Synthetic
KDVLETVRKLVEDTLREVERVITHSLKRVEDTLRKAKEIADRMRTLVRKTLEDIER

SEQ ID NO: 17899 - protein, 56 aa, Artificial Sequence
  Synthetic
DEVERVLEKSKRTNEDIIRRLEEVNKTDRKLVEDDIRRLEKALRDARKTNEEIRTS

SEQ ID NO: 17900 - protein, 56 aa, Artificial Sequence
  Synthetic
EDVLRKVRELVERTKERVERVIDHSRKVVETTLREVERVIREIEELSKDSERKIRK

SEQ ID NO: 17901 - protein, 56 aa, Artificial Sequence
  Synthetic
SDAERALKESEDTNREIIEKLERVNKRDKDIVDKIREDLKRVLERVRDTNRRIRES

SEQ ID NO: 17902 - protein, 56 aa, Artificial Sequence
  Synthetic
ERVLREVKRLIDETKRIVDEVIKHSKEEIDKLREEVERVIKELRELSDKSLDDIRK

SEQ ID NO: 17903 - protein, 56 aa, Artificial Sequence
  Synthetic
KEIEDVLKKSEDTNRRIIERLRKANDTDRRLIEDTIRKLREVLKEAEKTNKDIKDS

SEQ ID NO: 17904 - protein, 56 aa, Artificial Sequence
  Synthetic
EDVLRTVEELIERTEREVERVIAHSEDLIRRSNEDVKRVIKTIRELSEDSKRAADK

SEQ ID NO: 17905 - protein, 56 aa, Artificial Sequence
  Synthetic
DEERVLKELEDLLREILKDIERTVRESRKLVKTILDEIEEVARHNRKLIEEIRREV

SEQ ID NO: 17906 - protein, 56 aa, Artificial Sequence
  Synthetic
LKELLETVRRVIEEVKKVLKRSLEESKKVIDDVRRHLEKNNRDIKTVIDRVREKAK

SEQ ID NO: 17907 - protein, 55 aa, Artificial Sequence
  Synthetic
SVEEVVEEVKRLIEEVEKTNKKTVEDSKRLIDDIRRRIEEVMRHNRELIKKIERE

SEQ ID NO: 17908 - protein, 56 aa, Artificial Sequence
  Synthetic
LRELLERVRRLVEESKRNAEESLRRSEKVIKEATDHLRRNNETIKRVIDRVREEAK

SEQ ID NO: 17909 - protein, 55 aa, Artificial Sequence
  Synthetic
DTERVLKTLRDLIDTILKRNEEILRHNEKLSRDSKRRIEEVARHNRDLARRVEEE

SEQ ID NO: 17910 - protein, 56 aa, Artificial Sequence
  Synthetic
LRKLLEDVKEIIKTSKENVDRNNDRIRRVVERSEKHLEDNNRDVKRVVDEVREEAR

SEQ ID NO: 17911 - protein, 59 aa, Artificial Sequence
  Synthetic
KEEEDIKREIEKRITEIKKKNEEVLRRVEELIKRIHELNKRIEDTIDEEIRRIEDLVRR

SEQ ID NO: 17912 - protein, 56 aa, Artificial Sequence
  Synthetic
DDVLRKLKRLLDEIIKHSEDVLRKIKELLDEIKRDSDRVFKKLKELLDRIAREIEK

SEQ ID NO: 17913 - protein, 60 aa, Artificial Sequence
  Synthetic
RELEEIDRKIKKLIEDIHRENRDILRRIRELIERIKKKNEDILREVRKLIKEIEDLVREG

SEQ ID NO: 17914 - protein, 56 aa, Artificial Sequence
  Synthetic
DKVLKKLEDLLREIKKDSDRVLEEARKLLEEIKRHSDEVLEEIKKLLDDIKKRVET

SEQ ID NO: 17915 - protein, 59 aa, Artificial Sequence
  Synthetic
SELEKIDDEIRKLIEDIHRLNREIARRNEKTIREIRKKNEDVLRRNKRSADEIDRLVKE

SEQ ID NO: 17916 - protein, 56 aa, Artificial Sequence
  Synthetic
SEALRKLKRLLEEIERDSRRVLDELHKTDEDIERHSREVEDRAHKTDKTIKDRVET

SEQ ID NO: 17917 - protein, 60 aa, Artificial Sequence
  Synthetic
SEDEKILEEVRREIERIHEENRKVRERIERLIREIHKLNREVLERNKESIEEIRRLVEEG

SEQ ID NO: 17918 - protein, 56 aa, Artificial Sequence
  Synthetic
SKFLEDIERLLREIDKDSKRVLEELKRLLDEIRKDSDRVLKTAHDTDDKILKDIDK

SEQ ID NO: 17919 - protein, 59 aa, Artificial Sequence
  Synthetic
KEEDEVREEIKRRIEEIARLNKEIEDEIRELIKRIHELNREILKKVRKLIEEIEDLVRK

SEQ ID NO: 17920 - protein, 56 aa, Artificial Sequence
  Synthetic
SEVLRELDELLRRIKKNSEDVARKLKDLLRRIREDSERVAKEIRRLVEEIKKKVDK

SEQ ID NO: 17921 - protein, 61 aa, Artificial Sequence
  Synthetic
DEVKRIVDEVRRLVEKVHRVNEEVVKESEDLVREVHRKNKRVLDESERLVEEVERVLKRDV

SEQ ID NO: 17922 - protein, 55 aa, Artificial Sequence
  Synthetic
ERVLRTAEEVIRRLEKHSKDLLDTSRRLAEEILRKSDDLLRRSKEKIDDLKRKIK

SEQ ID NO: 17923 - protein, 61 aa, Artificial Sequence
  Synthetic
SEVDRIKEEVRKLLEEHHKRNEDIVREVTRLLEEHHKKNEEVVRESEKLVKKIREILRDRV

SEQ ID NO: 17924 - protein, 55 aa, Artificial Sequence
  Synthetic
ERVLEEARKVVRELNRRSEELLKRARELVERLDRKSEELLRKSERIIKKIEEDIR

SEQ ID NO: 17925 - protein, 61 aa, Artificial Sequence
  Synthetic
KEVEEIVRDVRRLVEEHHRENRKIVETVEDLVRKVHRENKRVVEESERLVDELTKILRDTL

SEQ ID NO: 17926 - protein, 55 aa, Artificial Sequence
  Synthetic
EEVLKRVREAIRRLNEDSKRLLKEARDVVERIKRNSDKALEESKRKLKEIEERIK

SEQ ID NO: 17927 - protein, 61 aa, Artificial Sequence
  Synthetic
SKMEEVRRRIKEEADRDEEDNRRVLEDIRRLIEENKRRNEEVLKRIEKKARDLLERIKKDG

SEQ ID NO: 17928 - protein, 55 aa, Artificial Sequence
  Synthetic
EEIIKEVSTLNEKLKRDTDEILKEVTRLNERLKEETDRILEEVKKLIDKVRKAVE

SEQ ID NO: 17929 - protein, 61 aa, Artificial Sequence
  Synthetic
KEADDVKRRLDDLIRRNEEKIRDVRRRVKELVDRNRKKIKEVLDKVKEIIDRLKDEIDKTG

SEQ ID NO: 17930 - protein, 55 aa, Artificial Sequence
  Synthetic
ERIIEEVTRENDRLRKESDRVLDEVSKLNDEARKETDDVLKTVDELVREVAEKAK

SEQ ID NO: 17931 - protein, 61 aa, Artificial Sequence
  Synthetic
SDAERLLETVRRIAKRLKELNEEVLREAKRIIDRVREENERSRETIREIMKKLKEDIDRIG

SEQ ID NO: 17932 - protein, 56 aa, Artificial Sequence
  Synthetic
VDEILRDVERLLEEVRRSVKESTRRIKRLLDEVRKSVKESTKEIKKLLKDVEDAAR

SEQ ID NO: 17933 - protein, 61 aa, Artificial Sequence
  Synthetic
KDIEDLRRRIEEIIEEAKRLDKTSLELIRRIIKRIKDENKKMLDEAEKIIRDALKTIDDVG

SEQ ID NO: 17934 - protein, 56 aa, Artificial Sequence
  Synthetic
VEDVTRRIEELLEEVRKSSEDSIRDIRRLLKEVRDSFKRSSDELKRLLDEVRKRAE

SEQ ID NO: 17935 - protein, 63 aa, Artificial Sequence
  Synthetic
RELEEVVKELRRLLEEVRKRVEDSIKRLDELLDEVRRSNKKSSEDTRKLLKELEDEARKVMER

SEQ ID NO: 17936 - protein, 56 aa, Artificial Sequence
  Synthetic
VREVREEIERIVTKARKVVKEDDDLVKRIVAEARRLSKESEEKVREIVKRAEEKVR

SEQ ID NO: 17937 - protein, 55 aa, Artificial Sequence
  Synthetic
DEVEELREELERLLKESEDRLREVKKRSDDSLKESRELIKKVRDTLERLLREVED

SEQ ID NO: 17938 - protein, 56 aa, Artificial Sequence
  Synthetic
VETVAREVRERVERSKRHIEKVLKEDEEMVRESKKNIEDLLRRVKEDIDRLKEEVD

SEQ ID NO: 17939 - protein, 55 aa, Artificial Sequence
  Synthetic
SKADRLREELDRLLKEVKELNERSKRESDRSLEEIKRLIEKVERESEKTLREVRA

SEQ ID NO: 17940 - protein, 56 aa, Artificial Sequence
  Synthetic
IDTVVEEVKKLIKEILDHIRELVEDDKRKIKEILEEIKKLAEDDRRKVEEVKRKVD

SEQ ID NO: 17941 - protein, 57 aa, Artificial Sequence
  Synthetic
SDVEDLKKKLDELLEEVERTSREVRKTSERSLEEVEKLLRRVKEESKRLLEEVERDI

SEQ ID NO: 17942 - protein, 56 aa, Artificial Sequence
  Synthetic
VKKVLDDVKKLVDDVKRKDKKLLDDDRRRVEEALEHIKRNLDRSRDLIRRIKEKAK

SEQ ID NO: 17943 - protein, 57 aa, Artificial Sequence
  Synthetic
DEVKKLKDDLDRLLDEIRRKIEKVRKDSEDSLKRVEELIRRVEEESRRLLEDVKREI

SEQ ID NO: 17944 - protein, 56 aa, Artificial Sequence
  Synthetic
IKKVLDDVRREIRRIDEEIKRVEEEDRRMVTELLKHIERNLERSKRLADEVKEKAR

SEQ ID NO: 17945 - protein, 55 aa, Artificial Sequence
  Synthetic
KEVDELRKALKELLDEVRETSKRVLDETRRLLEEVRRELERVKRESDETLKRIKD

SEQ ID NO: 17946 - protein, 56 aa, Artificial Sequence
  Synthetic
VDTVLEDVKRKIDELKEHDKRNLDESRRLITELLERIKKLAEDDRRVIEEIERRIQ

SEQ ID NO: 17947 - protein, 60 aa, Artificial Sequence
  Synthetic
KTMDEIKKEVTDLVRRIRELNERVERTVEDLVRKSRRLNERVLREVERLVKEVRDALRDK

SEQ ID NO: 17948 - protein, 59 aa, Artificial Sequence
  Synthetic
DETLEKVVDDVRKRIKRSKEHSDEVLEDAKKKIDENLEHSRRVLEEAKKLIDDLKDEIR

SEQ ID NO: 17949 - protein, 60 aa, Artificial Sequence
  Synthetic
EKAERIIEEVTDLVRRVRETTKTVKEEVRKLVERSKRRNEEIRREVKELVDEVEKKLREK

SEQ ID NO: 17950 - protein, 59 aa, Artificial Sequence
  Synthetic
KDALEKVRRDVERLIRELEKTDRDVLEEVKKLIEESERNSDRILEEVRRIIEELKKKIK

SEQ ID NO: 17951 - protein, 60 aa, Artificial Sequence
  Synthetic
SVVDEIRERVERLLREVEKTTEELRDTVRKLVEESEELTKRIEDEVRKLVEKVRRELRRK

SEQ ID NO: 17952 - protein, 59 aa, Artificial Sequence
  Synthetic
EDKLREVLEEVKERIDRLKELDKKILEDVKRLVKESKEELKDILRRARKLIRDLEEKIK

SEQ ID NO: 17953 - protein, 60 aa, Artificial Sequence
  Synthetic
SEVEKMLKELKELVERALERDKDALRKLRDLVRESLERDKRMVDKLDELVKEIEDRIRKR

SEQ ID NO: 17954 - protein, 59 aa, Artificial Sequence
  Synthetic
REKVDKIRRDVKRLLDESRESLERSEKDVEKLLEDSRDSLRKSKKRVEELVKRVEEALK

SEQ ID NO: 17955 - protein, 60 aa, Artificial Sequence
  Synthetic
REVEEALKESTDTIKKILDDDRKAMDELKKLVDKSLEDDKRAVDRLRELVKEIKKIIKKR

SEQ ID NO: 17956 - protein, 59 aa, Artificial Sequence
  Synthetic
KEDVDRIEEESRRLNEESRDSLRKSEDTVRKLLEESKESLDRSRREVEKLLKEVEDALR

SEQ ID NO: 17957 - protein, 61 aa, Artificial Sequence
  Synthetic
SELEELDREVEELVERSKRTNERVVEESKRLVDESRRDIDRLLEEVRKLVKDILERIKEEG

SEQ ID NO: 17958 - protein, 59 aa, Artificial Sequence
  Synthetic
SEDVRRLLEKIERLIEESNRSLERSREESERLSKESEDRLRELEKTVKELLKRVEEALR

SEQ ID NO: 17959 - protein, 61 aa, Artificial Sequence
  Synthetic
DEIRELLKKAEELVERSLRDNEKVVDELKKLVDESLRRIREMLKRAEDEVRKILEDIERKG

SEQ ID NO: 17960 - protein, 59 aa, Artificial Sequence
  Synthetic
SDEVDTLRRTVDKLVKDSNRSLEESKRTLEDLIRRSKEELDKLEKDVRRLLDEVRKALK

SEQ ID NO: 17961 - protein, 60 aa, Artificial Sequence
  Synthetic
DELEDAMRRVEEMAERSERNIRRSIRKVEELVTRSKKNIEDSLREVEKVAREAEELLRRN

SEQ ID NO: 17962 - protein, 55 aa, Artificial Sequence
  Synthetic
EEVKRRLDELLKRVTDLDRDSEKKLRELLEEVTKLDKESKDRLDELLEKVRRDRE

SEQ ID NO: 17963 - protein, 61 aa, Artificial Sequence
  Synthetic
SEVDKLLDRLTKLAKRSIDEARRLVERDREVLEKSIRDAEKLVERDEKVLEDIKRLIEREG

SEQ ID NO: 17964 - protein, 55 aa, Artificial Sequence
  Synthetic
ETVRRLVTELNKASKKVVDDVRRESEKSNRDSEDVVRKVKKASDKSLEDVERDIR

SEQ ID NO: 17965 - protein, 61 aa, Artificial Sequence
  Synthetic
EEVERIVERLKRLAEEDSREIKEVMDRNRESVRRILKRIKDIVEELRRLVEEIKKKIEKDG

SEQ ID NO: 17966 - protein, 59 aa, Artificial Sequence
  Synthetic
KEKVERLEKDIRRLEKESEDALRRLEDTSKRTDDEIERAIEELERTITDLVREIRERVR

SEQ ID NO: 17967 - protein, 60 aa, Artificial Sequence
  Synthetic
REVDEIRKELDDRVREIKKRIEEAVEDSRRTVEEIKRRVEEVDKTDRKLVEDIKREIDRR

SEQ ID NO: 17968 - protein, 59 aa, Artificial Sequence
  Synthetic
RKKAEELRDRVRKLVEEIERLLEELRRTLEKTRREIERVVEENRRSVEELIREIKERVD

SEQ ID NO: 17969 - protein, 60 aa, Artificial Sequence
  Synthetic
DDERRVKEEIKRILTEAKKVIDENKRRSEEVLDRVRKLVKENKDENDEVLKTVDELVRRG

SEQ ID NO: 17970 - protein, 55 aa, Artificial Sequence
  Synthetic
EEVRKELKRVLDEVRRLVKETEETDRTSNRTVAELAKDLEKKTDDIEREVRKKVT

SEQ ID NO: 17971 - protein, 61 aa, Artificial Sequence
  Synthetic
DRVERILKKIEDALRKVEELIRRNKKKIDDVLDEVRRLVEESKKRIDEILDEVRDRITKLK

SEQ ID NO: 17972 - protein, 58 aa, Artificial Sequence
  Synthetic
KEAKRLKDLLDTVRETVKRLNDELRKRSEEVLRRVDKLNKESKKRLDEVLRTVREELR

SEQ ID NO: 17973 - protein, 60 aa, Artificial Sequence
  Synthetic
REIEEVKKENDKSLKEIEKIIREVKEENKRSLDKIKRIIERALEEIKRMLEKAKKLADEG

SEQ ID NO: 17974 - protein, 59 aa, Artificial Sequence
  Synthetic
DKFLTEVKRSFEKSVEDIKRLLKEVSESVKRSTDEIRRLLDEVRRAVEEVLRRIRELLR

SEQ ID NO: 17975 - protein, 57 aa, Artificial Sequence
  Synthetic
SLVEELRRVVEEVRKTLEELVKRLEDSVRRSAEEIRKLIEDAERSVRESERAVKETG

SEQ ID NO: 17976 - protein, 58 aa, Artificial Sequence
  Synthetic
KEIKELLEEIKEMLRRLKKKAEDIDRTNRELEKEVRELVERLLRDNRRLLKEVVERAK

SEQ ID NO: 17977 - protein, 57 aa, Artificial Sequence
  Synthetic
DKIEEAKKNVDESKRRVEELIRELRESVERSKRDVERLVRELEESVERSLETVKRDG

SEQ ID NO: 17978 - protein, 58 aa, Artificial Sequence
  Synthetic
KEVKELLKRNSDLLRRVEELVKKLDKENRDLLRKVREDAKKLLKENEDLLEKVKRDAR

SEQ ID NO: 17979 - protein, 57 aa, Artificial Sequence
  Synthetic
DEIEKAEKNVRDSRREVERVVKKLKESVDKSREEVERLVRELERSVEESRRLVEERG

SEQ ID NO: 17980 - protein, 58 aa, Artificial Sequence
  Synthetic
KEVDRLLERNSRLLEEVEERAKELDERNKKLLEEVRRRAEEVDKRNKDLLRTVDRRAR

SEQ ID NO: 17981 - protein, 57 aa, Artificial Sequence
  Synthetic
SLIEEARENVKDSKKKVKELVDRLRKSVEESRERVREVVRRLRESVDTSADAVRKAG

SEQ ID NO: 17982 - protein, 58 aa, Artificial Sequence
  Synthetic
EAVKRLLEENSKLLADVADEARKLNEENERLLREVEKKAKKLDDENRKLLEEVIETVR

SEQ ID NO: 17983 - protein, 57 aa, Artificial Sequence
  Synthetic
DEIEELKKNVEDSRREIDRLIKELKESVEKSRKDVEKVVKELRESVKDSLDKLEKTG

SEQ ID NO: 17984 - protein, 58 aa, Artificial Sequence
  Synthetic
KEIKELLKENSDLLERVREEAETLDRKNKELLERVKRKADRLNEENRRLLKEVIEKAR

SEQ ID NO: 17985 - protein, 60 aa, Artificial Sequence
  Synthetic
SEVEKLLRDLERLLEEIVKEAEDLDRENKERLKEIARKARELNEENKDLLRRVKELVDRN

SEQ ID NO: 17986 - protein, 59 aa, Artificial Sequence
  Synthetic
ERLVREVERVIREVRKRVEEVVRKVEESIKESEERVKELVKRVTDSLERSKKEVEDAIR

SEQ ID NO: 17987 - protein, 58 aa, Artificial Sequence
  Synthetic
SEVEELLKRLEDILRENERRARELNRKNKEVLKDNRRRAEEVNRRNKRMLDEAERLAE

SEQ ID NO: 17988 - protein, 59 aa, Artificial Sequence
  Synthetic
EKLVREVETKIEEVRRRSEELVKEVEKSLKESEDDSRRLVREIEESIRESEERIKRRVE

SEQ ID NO: 17989 - protein, 56 aa, Artificial Sequence
  Synthetic
DEVEEILEKSRRTLEENKRRAKEAVRRSRETLRESEERVKRVVEELRDRLRRIEEE

SEQ ID NO: 17990 - protein, 59 aa, Artificial Sequence
  Synthetic
EDALRKIKKVLDETETESRRTLEELRKVLEETHRRNEKLIRDLREVLKEIEEAVRRREK

SEQ ID NO: 17991 - protein, 56 aa, Artificial Sequence
  Synthetic
DEVEEALRRLEDLLRRNVEEAKEVVKDSERTLREDAERVKRVVEKSKRTLEAIEKR

SEQ ID NO: 17992 - protein, 59 aa, Artificial Sequence
  Synthetic
EEAVRRIEEVLKKIREDSKRTIDELRRVLERTEEETRRLIKELEDVLRRTEEEVKRRLK

SEQ ID NO: 17993 - protein, 61 aa, Artificial Sequence
  Synthetic
SEVEKVLEEIKRLLDRIKERVDETDRRNKELLKKIKDEVRRAVEEIRRLLEEIKKSADEKG

SEQ ID NO: 17994 - protein, 59 aa, Artificial Sequence
  Synthetic
EKLVREVEEVVTRVRKTIEDLVKKDNDSVRKSEERIKEVVKRIEEEVKRVLEDVDRLAK

SEQ ID NO: 17995 - protein, 57 aa, Artificial Sequence
  Synthetic
DEVRELLERNRRLLEEIKKTVKDLIRRNEELLKRIEDDAKRLIDRNEELLDELEKRL

SEQ ID NO: 17996 - protein, 59 aa, Artificial Sequence
  Synthetic
GEELEELRRVVEESDETIKRLLEEAKESVDRSLDRIRKLLEDVRRSVERSKKRIDEKRK

SEQ ID NO: 17997 - protein, 57 aa, Artificial Sequence
  Synthetic
DEVRKILKDIEDILREIEERVKRVIERNKRILEKIREDVKRVDDRNKKLLEELERKL

SEQ ID NO: 17998 - protein, 58 aa, Artificial Sequence
  Synthetic
DDLRRVEEVAKRIKDRIRELLDEIRRSVERSKRDVKRLLDELRRSVEESKRRIDEREK

SEQ ID NO: 17999 - protein, 57 aa, Artificial Sequence
  Synthetic
SEVDKLLRENEKLLEDIERTVKRMLERIKKLNDDVHREIRRIDEENRRLLDEIEKKV

SEQ ID NO: 18000 - protein, 59 aa, Artificial Sequence
  Synthetic
GRDLDRLRRVVEKSKKRIEELEREARKVAKDVKKNLEELLEEVKESVRESEKRIKETEK

SEQ ID NO: 18001 - protein, 60 aa, Artificial Sequence
  Synthetic
SLKERIEEELKKVKDTSDRLNEEVRRSVEDTRKRSEDLNEEVRRSVEESRRRVESLLKRI

SEQ ID NO: 18002 - protein, 59 aa, Artificial Sequence
  Synthetic
EEEVKKIIERIEEILERSERRNREIIKRDEEALKRSEERNREIIERDKEMLERLEREVR

SEQ ID NO: 18003 - protein, 60 aa, Artificial Sequence
  Synthetic
SLIETIKEVVKRVAETSKRLNDRVREELRKVEREVEELNREVERVLREVETAVDDLVKKI

SEQ ID NO: 18004 - protein, 59 aa, Artificial Sequence
  Synthetic
REEAEDIIRKIEEVLKKSKELNDRIIERIKKMLEDLRRHNEEIIEKIRRALKRLEDEAR

SEQ ID NO: 18005 - protein, 60 aa, Artificial Sequence
  Synthetic
SLKETIRELLKRVEEESRKLNEDVARSVRETKRRSDRLNEEVERSVRRSEEEVRRLLKRI

SEQ ID NO: 18006 - protein, 59 aa, Artificial Sequence
  Synthetic
KEKAEEIIRRIKEMLRRDEEENRRIIERDERALDKSRRLNEKIIEEDKKAMRDLEEEVK

SEQ ID NO: 18007 - protein, 60 aa, Artificial Sequence
  Synthetic
SEVEEIIKENRRTLERDRREVEKVIEENKRSLEEIERKVREIIKDNDRSAKEITELAKAG

SEQ ID NO: 18008 - protein, 59 aa, Artificial Sequence
  Synthetic
EELVDRLRKSLRDVREESKKLIDELRRSLEESDRRVKELIDRLRKSLDDSRKLVDDLRR

SEQ ID NO: 18009 - protein, 60 aa, Artificial Sequence
  Synthetic
SEVEEIIKDNERTLEEIRKRVEDVIREIRRLLERIERRVREAIKRNEESLRRIKELVERG

SEQ ID NO: 18010 - protein, 59 aa, Artificial Sequence
  Synthetic
DELVRTLRESLRRVAEEVKRLLKEVEDVAREVEDRVKKLIEDLRRSLEKSREDVERDSK

SEQ ID NO: 18011 - protein, 61 aa, Artificial Sequence
  Synthetic
DRVREIIKRLRDLLREIRTVVRKIIEDNRKSLEEIEEHNRRVIRELRELLKEIKETVEREG

SEQ ID NO: 18012 - protein, 59 aa, Artificial Sequence
  Synthetic
EEMIRTVKKVITEIAEEVKRLADEVRDSVRRSEEAVRRLTKETKEVVDDIVRRVRELIE

SEQ ID NO: 18013 - protein, 61 aa, Artificial Sequence
  Synthetic
KKVEEIIEELKKLLREIEEHNKRVIEENERSLEEIKRHNEEVIEELRELLERIEEVVKRKG

SEQ ID NO: 18014 - protein, 59 aa, Artificial Sequence
  Synthetic
EDMIRTVEDVVRRIERRVRELSRESEESIRRSTETVKKLTKDTRDVVRRILKTVRDRIK

SEQ ID NO: 18015 - protein, 64 aa, Artificial Sequence
  Synthetic
SLEERLREVLKDIERRVRELNETNKRVLDKSKTTVDELLKRLREVLEEIREEVRKLIEELARRG

SEQ ID NO: 18016 - protein, 59 aa, Artificial Sequence
  Synthetic
REMIEKVLRDLEELAKRIEDKNRETIKESEKTLEEIRRRVDRLLEELRRLLKEIAKEVK

SEQ ID NO: 18017 - protein, 64 aa, Artificial Sequence
  Synthetic
SLEETLEKVLRDITERSERLIRENEKNLRDVKREVEKLNERNRDVLKKIREKVRELIEELRRKG

SEQ ID NO: 18018 - protein, 59 aa, Artificial Sequence
  Synthetic
EEAIRKVLEELKKLLEEDERRAKRVSEESKELLDRLAEDNERTIRKLERLLEELERRTK

SEQ ID NO: 18019 - protein, 60 aa, Artificial Sequence
  Synthetic
SEVDKVLEELKKLLDDDRREVERLLRELRRLLDRDRREVEKSIRTLEKLLKEIEDIVRER

SEQ ID NO: 18020 - protein, 59 aa, Artificial Sequence
  Synthetic
KRALERVREVLERAEDESRKLSERIKKVLEDIERESKRLSEEDREVLKRIKEEVERLEK

SEQ ID NO: 18021 - protein, 60 aa, Artificial Sequence
  Synthetic
SEVDKVLEELKELLKRLEEDVKRSSKESEDLLRKDEEDVRRSIRELERLLEEIEERVRRR

SEQ ID NO: 18022 - protein, 59 aa, Artificial Sequence
  Synthetic
ERALREVRKVLEDIKKSVDELLKEDKDNLRETARESERLSREDKKVLERIEERVKELED

SEQ ID NO: 18023 - protein, 60 aa, Artificial Sequence
  Synthetic
SEVEKVIEELKKLADDDRRRVEKSLRELRKLLEELEKRVRDSLEKLKKLLKEIEDRVRRR

SEQ ID NO: 18024 - protein, 59 aa, Artificial Sequence
  Synthetic
EKLLREVRKVLREARETSRELSRADEKVLRDIRREVKRALDADKKVLDDIRERVKELEK

SEQ ID NO: 18025 - protein, 60 aa, Artificial Sequence
  Synthetic
DEVEKILKEIDDAVKDLKRKSDKSLTDDRRMVEELKKKSEESLREVEEMVRRLEDEASRT

SEQ ID NO: 18026 - protein, 59 aa, Artificial Sequence
  Synthetic
EKVVRRVRDILDKLRKTVERLVEENEDSARRTEETIRKLVKDNEDILRELRRLIEERRT

SEQ ID NO: 18027 - protein, 60 aa, Artificial Sequence
  Synthetic
SEVEEMLERLKELLRRIEKVVRDSLRRLKELMRRDEEEVRRSLRRLEELLKEIERVARER

SEQ ID NO: 18028 - protein, 59 aa, Artificial Sequence
  Synthetic
KKVLDEVKELLERIEETVRRLIEENERVLEEAEELSRKLSEDNEKVLEDARREAERLTK

SEQ ID NO: 18029 - protein, 60 aa, Artificial Sequence
  Synthetic
DEVEEVLKELEKLAREDEDRVRKSEKKLRELADKDREDVERSLRRLERLLEELKRVVEER

SEQ ID NO: 18030 - protein, 59 aa, Artificial Sequence
  Synthetic
KDMLERVERLLREAEKLSEKLSRDNEDLLRRARDLSRELSKENERLLEDIRRRVEEAIK

SEQ ID NO: 18031 - protein, 60 aa, Artificial Sequence
  Synthetic
REVEEVLERLKRLLDTLEREVRKSLEELKRLLDELRKESKKSLDELRKLAEELERVVRRL

SEQ ID NO: 18032 - protein, 59 aa, Artificial Sequence
  Synthetic
EKMLREVKRVLEEAERRVRELIEENKRLLKEIKEEVKKLIEENEKVLEEARRLAEELKK

SEQ ID NO: 18033 - protein, 60 aa, Artificial Sequence
  Synthetic
DEVREVLKKLEKLADELREEVRKSLEDLKRLLREDEERSKESLKDLERLAREIEEVVKKK

SEQ ID NO: 18034 - protein, 59 aa, Artificial Sequence
  Synthetic
EKALRDVEELLRRIEERVRRLIKENEDLLREIEKTSEKLSRDNKELLKEIEERVRRLRQ

SEQ ID NO: 18035 - protein, 60 aa, Artificial Sequence
  Synthetic
DEVEEALKTLEELMRRDKEEVDKSLEKLRRLLKEDEDRSRESLERLKRLAEELEEVVKKE

SEQ ID NO: 18036 - protein, 59 aa, Artificial Sequence
  Synthetic
RRVLERVKKLLEDARRLSERLSEENERVLEEAKRRSEELSKRNEDLLREIEKKMKEDTR

SEQ ID NO: 18037 - protein, 60 aa, Artificial Sequence
  Synthetic
SEVEKVLEELKKLADDLRRTSKRSEEELEKLARELEKRVRESEKRLRDLLRELEDVVRKK

SEQ ID NO: 18038 - protein, 59 aa, Artificial Sequence
  Synthetic
KDALKRVKELLDRIREEVEKLIRRNEKLLRDIEEKVRTLLERNERVLEEIKKKVDDDIK

SEQ ID NO: 18039 - protein, 60 aa, Artificial Sequence
  Synthetic
DEVREVLEELRRLMKELRDVSEKSLRDLRKLAEEDKDRVRKSLEKLRELLRTLEDVVRKR

SEQ ID NO: 18040 - protein, 59 aa, Artificial Sequence
  Synthetic
EKMLREVEDLLRRAEKEVRRLIEENKKLLKEAEETSRKLSKENEDVLRDIRRAVEELKR

SEQ ID NO: 18041 - protein, 60 aa, Artificial Sequence
  Synthetic
SEVEKALEDLERLAKELEKVSRESLRRLEKLLEDDRRRSKRSLEELEELLDRLRDTVRRR

SEQ ID NO: 18042 - protein, 59 aa, Artificial Sequence
  Synthetic
EKALREVRDLLRRIEERVKKLIEDNRKLLEDARRESERLSEENKRVLEKIEREVKKLED

SEQ ID NO: 18043 - protein, 60 aa, Artificial Sequence
  Synthetic
SRVEEVLKKLEDLLRRLEEVSERSLRELRELVKRLEDVVRRSEKKLKELADRIEEVVRRR

SEQ ID NO: 18044 - protein, 59 aa, Artificial Sequence
  Synthetic
KKALDDVRRLLEEIEKRVTELIERNRRLLEEAEDRVRKLLRDNEELLKRIEKLVRDLER

SEQ ID NO: 18045 - protein, 60 aa, Artificial Sequence
  Synthetic
SRVEEVARKLEDLLRELKRVSDESLKTLEKLMTDDERRVRESLDKLRELAREIDEVVRRR

SEQ ID NO: 18046 - protein, 59 aa, Artificial Sequence
  Synthetic
EDALREVRRLLERAEELVRELIKRNEDVLREAKRTSDELSERNRRLLERIKETVDRKRK

SEQ ID NO: 18047 - protein, 57 aa, Artificial Sequence
  Synthetic
REVEEILKRIEELLRRIKKLSEETLREIAKLLEDIKRLSEETLKSNKDLLKRVRDEL

SEQ ID NO: 18048 - protein, 59 aa, Artificial Sequence
  Synthetic
SRMLREIERIIKELKELVDKLLEDNERLIERLDREVKRLLEENEKSVREASREIDERRR

SEQ ID NO: 18049 - protein, 57 aa, Artificial Sequence
  Synthetic
DEVEELLRRIERLVEEARRLVEELLETNKKLLKDIEKLSRDTLKSNEELLREVKDRV

SEQ ID NO: 18050 - protein, 59 aa, Artificial Sequence
  Synthetic
SEMLRRLETIIREAERDLRRLLKEARDSVKKVSDEIKRLLEENKRSVDRVSREIKRVEK

SEQ ID NO: 18051 - protein, 59 aa, Artificial Sequence
  Synthetic
DEVEELLKEIRELIEEARRRIEELLKEDRDIVRRVTELSRRTLEKIKDLIRKIKDIADR

SEQ ID NO: 18052 - protein, 59 aa, Artificial Sequence
  Synthetic
SEMLRRLEELIKEIEDLVRKLLEELKRSVRETEERVRKLKEDNDELIKRIDELVKEREK

SEQ ID NO: 18053 - protein, 60 aa, Artificial Sequence
  Synthetic
SSLDDLRRLAEELLRTNKKLMEDLRRTNEKLIKEIEDVLRRIRESSKRIKEEVDKLTRDV

SEQ ID NO: 18054 - protein, 59 aa, Artificial Sequence
  Synthetic
RKVLERVKEAVDEVRRSVEESLRDAKRMDEETRKTVEDVRREVTKSVEDVKRRIDESRK

SEQ ID NO: 18055 - protein, 60 aa, Artificial Sequence
  Synthetic
DEVDEVVREVERLLEELRKENDKSVEEDKRLVDKLREEVKRILEEVRKLLEDLARKAKED

SEQ ID NO: 18056 - protein, 59 aa, Artificial Sequence
  Synthetic
KDVLRKLREVIKEVERIAEEVVRKNKDSADKSRKIIEDVVRALKKVVDDVRKIAEDLSR

SEQ ID NO: 18057 - protein, 61 aa, Artificial Sequence
  Synthetic
DEVEKAVRESEETVKDIRRRNDETVRRLRELAKRLKERNEESVRRLRDLLRRLDEEVARRG

SEQ ID NO: 18058 - protein, 59 aa, Artificial Sequence
  Synthetic
ERVLRDIRRVMEDSERIVKEVLDRNRKVAEDVRRIVEEVLRVNEDVLRKIEKRVRELKK

SEQ ID NO: 18059 - protein, 59 aa, Artificial Sequence
  Synthetic
SELEEIKKRVDRALEENNKLLKEIEERVRKSNRDNERLLKEIEDRVREVTERIKKVEEE

SEQ ID NO: 18060 - protein, 59 aa, Artificial Sequence
  Synthetic
EDVLKKIRDLAREVEENVRESERKIKKLAEDDNRSVAESLREIKRLADEVKRRVDEARK

SEQ ID NO: 18061 - protein, 60 aa, Artificial Sequence
  Synthetic
SELEEVRKRVKDVNRKNKELLDEIERTVRELLEDDRRLVDEAKKELDTLLRDIERLRREG

SEQ ID NO: 18062 - protein, 59 aa, Artificial Sequence
  Synthetic
EDALREIRRLLEEVRKSIEDSKRLIEELLRRLKKVTDESRKKVEDLLREVEREVREAKK

SEQ ID NO: 18063 - protein, 60 aa, Artificial Sequence
  Synthetic
RELEEIEKELKRMLDENRRLLERIEEEVRRLNEDNRRLLEEIEKTVEDLLEKIRKLSKEG

SEQ ID NO: 18064 - protein, 59 aa, Artificial Sequence
  Synthetic
REALKRIEELLREIEEVVKRSKTEIERLLRELEESVRRSDERIERLLKRVKDVVDEEER

SEQ ID NO: 18065 - protein, 60 aa, Artificial Sequence
  Synthetic
EKEKEITKTLEDLIRKNRKLLEEIERRVKEVLKRDRELLEEIERRVADMLRRIRDVLRKG

SEQ ID NO: 18066 - protein, 59 aa, Artificial Sequence
  Synthetic
REVLERIKRLLEKVEKVSTESAKRIEELLEEVKRVTDDSKRRVTELLREVERVVDEVRR

SEQ ID NO: 18067 - protein, 60 aa, Artificial Sequence
  Synthetic
DTLRELAKKAKELDDRNRKLLETVEELVRRVNEKNKDLLRRVRELARELLDRLRKLAREG

SEQ ID NO: 18068 - protein, 59 aa, Artificial Sequence
  Synthetic
EEVRRELERLVRKLEESVRKSRKDVEDLITELKKSVKESLKEIEDLVRRLREVVKEIER

SEQ ID NO: 18069 - protein, 61 aa, Artificial Sequence
  Synthetic
EEVDRILKESEDTIREIRDRVRKMLETSKKTVEEIKRRVDRALERDKKLVEDLRERVERTG

SEQ ID NO: 18070 - protein, 59 aa, Artificial Sequence
  Synthetic
KEAVEKMRRIVRESREVVARIREDIKRVLDESDKVVKDLKRAADRSVEEVKKVVDDIKK

SEQ ID NO: 18071 - protein, 60 aa, Artificial Sequence
  Synthetic
SELERLKETSKDTIKKIKDLLRELKKTVDDVIERDKTLLDDLREKVERVIRRIEELLKRT

SEQ ID NO: 18072 - protein, 59 aa, Artificial Sequence
  Synthetic
EKVRDEIRKLIETNKRVADRVEEEVRKLIEDSERSLRKSEKDVKELIKKVEEVMEEVRR

SEQ ID NO: 18073 - protein, 60 aa, Artificial Sequence
  Synthetic
SIEETVKRLIEEIERVLRDARRESKRLSEEDKKVLDEIREEVRKLEEKIKTVLDKARKDI

SEQ ID NO: 18074 - protein, 59 aa, Artificial Sequence
  Synthetic
EKLLDEVRRRVEEVIKELEELLRRDKERVDRSIRELEKLLEEIKERVDRMIKELEDRLR

SEQ ID NO: 18075 - protein, 60 aa, Artificial Sequence
  Synthetic
REVEEADKTVKELIKRNKELLDRIKKEVDELIRRDKELLDKAERDVDRLIKELRDVAREG

SEQ ID NO: 18076 - protein, 59 aa, Artificial Sequence
  Synthetic
KEVVDEIRRLLRELEKVSEDTKREIRELLKRAEESVRRVTERIERLLKELRDVIREIEK

SEQ ID NO: 18077 - protein, 60 aa, Artificial Sequence
  Synthetic
DELEKIKKDVKKMIRDNEDLLRRVEERVRELNRRNEELLKEIEKRVEELIKRLEDVARRG

SEQ ID NO: 18078 - protein, 59 aa, Artificial Sequence
  Synthetic
REVLEAIRRLEKEARDVSRRSTRKIEELLETSETSSEKSKRRIEELLRRLERVVEEARK

SEQ ID NO: 18079 - protein, 60 aa, Artificial Sequence
  Synthetic
EELERAAERIEELLRSNRDLADKITKLSRETLEKIKDLLRKIEKEVRELLERIKDLERRL

SEQ ID NO: 18080 - protein, 59 aa, Artificial Sequence
  Synthetic
EEVLRELERLLRELKKSVDELSRLIEELLRENKRLIDEVKKRIDELLEELKKLIEKVKK

SEQ ID NO: 18081 - protein, 60 aa, Artificial Sequence
  Synthetic
EIEKVVEEVIRRVRKVLEEVERSVRDTIERIKDVLRRVEEVVRRTDKTIRDVLDRIRKEI

SEQ ID NO: 18082 - protein, 56 aa, Artificial Sequence
  Synthetic
DEDIRRVLEDIRRELKRIVDENRKLAEEIIRTLERMVEKNKELMKEVVKKLEEDSR

SEQ ID NO: 18083 - protein, 60 aa, Artificial Sequence
  Synthetic
RIKETVDKVIEEVRRVLEEVRTTVKRTDERIKEVLEEVEETVRRTLEEIRRVLEELERAI

SEQ ID NO: 18084 - protein, 56 aa, Artificial Sequence
  Synthetic
DEDIRDLVRKIKEELRRIVEKNRELMEKVERELRRIVEENERLARRIKEELDRDMK

SEQ ID NO: 18085 - protein, 60 aa, Artificial Sequence
  Synthetic
RIEEIVERLIREVEKVLRDVERTVDKTDRKIREVLEEVRRISDESIKEVREVLEDLERKI

SEQ ID NO: 18086 - protein, 56 aa, Artificial Sequence
  Synthetic
DEDIRRLAEEIKKKLKRMVERNKELMERIEREIREIVERDKELVERIKRKLRELAR

SEQ ID NO: 18087 - protein, 60 aa, Artificial Sequence
  Synthetic
SIEDVVREVIKRVEDVLRRVEEVSRETIERVRRVLREVEERVERTDERIRRILDKLAKSI

SEQ ID NO: 18088 - protein, 56 aa, Artificial Sequence
  Synthetic
DEDIRRLVKKIEEDLTRIVERDKELLEDIERELRRMVEENERLLEEIERRARDEER

SEQ ID NO: 18089 - protein, 59 aa, Artificial Sequence
  Synthetic
EELERLARDVDKRVEDLKDDIRKIREEVKRLLDDNRRRAEEILEESRKSLETLTDLMRR

SEQ ID NO: 18090 - protein, 56 aa, Artificial Sequence
  Synthetic
SEIVKRVLEKLDEVLKDLKRTIDELKKRLEDVLRESRDIARRALEENERVLDELRK

SEQ ID NO: 18091 - protein, 59 aa, Artificial Sequence
  Synthetic
SEEDRIAEESRESLEKLKDDIRKIEDRVRKLLEDNKRRAEEILREVEEDLKRIEELFKQ

SEQ ID NO: 18092 - protein, 56 aa, Artificial Sequence
  Synthetic
SEIVRRLLEENKRVLDELEKRIEELLRRLDKVLKESERIAREAERKIEEVLRKLEK

SEQ ID NO: 18093 - protein, 60 aa, Artificial Sequence
  Synthetic
SAEEIIDRVTKEAKKSIDRTRDRITKLRRELEESIRRSRDIITKLLEELRRVVEEVKRDK

SEQ ID NO: 18094 - protein, 59 aa, Artificial Sequence
  Synthetic
EKVVEDLERKVEEIVREDEDLVRRLAEEVKRVVEDDERTAKKLEDDVRRIIEAVKRELK

SEQ ID NO: 18095 - protein, 56 aa, Artificial Sequence
  Synthetic
SLEELLEEARKTVERLIRESERVLRESEERVRRLIEELERVVRETRKRVKEVIERV

SEQ ID NO: 18096 - protein, 56 aa, Artificial Sequence
  Synthetic
EEELEKLLREIEERVKEMLKRDEDTLREIERKVKEAVRDSERTLEEIEKRVTEEKT

SEQ ID NO: 18097 - protein, 59 aa, Artificial Sequence
  Synthetic
SITEEIKDIERKVEKLIRELDEENKRILETLEREAKDVLRRIEDINEKLHRRARDLKRK

SEQ ID NO: 18098 - protein, 59 aa, Artificial Sequence
  Synthetic
EELKRVLDRVLKKVEDLLRKLEKSVRDSERRLEELLRELREVVKRVRDNIEKVLEELER

SEQ ID NO: 18099 - protein, 60 aa, Artificial Sequence
  Synthetic
SIREEAREELKRLEEEAERLDRENREILKELTREFKELLKESRDINREIHERIRKLKKDG

SEQ ID NO: 18100 - protein, 59 aa, Artificial Sequence
  Synthetic
RKLDKVLKEIEERLRELLKRLEDSVRESEKRLRDLLRELAKVDEEAKRNVEKVLKELED

SEQ ID NO: 18101 - protein, 59 aa, Artificial Sequence
  Synthetic
SIKDEIRKLLEKVKREVEEIDDRNRRLLEKVKREAEELLEKNRRLLEEVRKRAEELKDS

SEQ ID NO: 18102 - protein, 57 aa, Artificial Sequence
  Synthetic
LERVVRDVERRIEELIRKLERSVDRSEEEVRRLIEELRKSVEDSKREVDRVVEELRR

SEQ ID NO: 18103 - protein, 59 aa, Artificial Sequence
  Synthetic
SILEDVRRLLDEVKKLVEELLRENRRLLEEVKKEVEKLDRKNRELLREVRELVKELKDS

SEQ ID NO: 18104 - protein, 59 aa, Artificial Sequence
  Synthetic
RKLEEAVREVEERVRDLIRKARESVDESRKRIEDLIRELKKSVEESLRDIERLIKELRD

SEQ ID NO: 18105 - protein, 59 aa, Artificial Sequence
  Synthetic
STREDARRLVERVRKEVKRLLKKNSDLLREVTERVKTLNERNRRLLEEVEREAKRLKDS

SEQ ID NO: 18106 - protein, 57 aa, Artificial Sequence
  Synthetic
LERVVREIEKEIRDLIRELEENVKTSEKLIEDLIRELEKSVDESRKRVEELVKELRT

SEQ ID NO: 18107 - protein, 60 aa, Artificial Sequence
  Synthetic
SAEDVVREIEKTVRELMRRVEESVRKVEEDVKRLIKEVKDSADESEKKVERLLEEVKREK

SEQ ID NO: 18108 - protein, 56 aa, Artificial Sequence
  Synthetic
EEELRRLLEEIKKEVDKVIRENEETLKRIKEVVERVIEDNKRTLREIEEEVRRIRK

SEQ ID NO: 18109 - protein, 60 aa, Artificial Sequence
  Synthetic
SVEEVVKRILETIKDLMRRIKKNSEDVLETIKRLADEIRESVKRSNERIRELIKDIRETR

SEQ ID NO: 18110 - protein, 56 aa, Artificial Sequence
  Synthetic
TDELEKLLREVEEIVKDVSRKSDTSLKKAEERVRDVKRKDEKTLRDAEEVVRREKK

SEQ ID NO: 18111 - protein, 59 aa, Artificial Sequence
  Synthetic
SVEDLVRDVRDKAKRTSDEIRKLIERSKEIFERSSREIRRLIEESRDTARRVVEKLKKN

SEQ ID NO: 18112 - protein, 59 aa, Artificial Sequence
  Synthetic
EEEIARLVEEVKRLVKESLELIEELHRRSEKLVRDSLREIKTLNDESRKIVTDVLREVT

SEQ ID NO: 18113 - protein, 59 aa, Artificial Sequence
  Synthetic
KVEELVREVTEIARKVREDLERLVRESERRMRESSEKIKRLIEESRRRMKEVVEELKRE

SEQ ID NO: 18114 - protein, 59 aa, Artificial Sequence
  Synthetic
EEEIKRLREKVKRLVDKVKREIERLNRKSRELVKKSEEDIEKINRESRELLRKVLEDAK

SEQ ID NO: 18115 - protein, 59 aa, Artificial Sequence
  Synthetic
DVEELIKEVKDKAKRTSDEIKKLIDESKRVLDEVVRRLEELVKRIKESADRVLEEIARE

SEQ ID NO: 18116 - protein, 59 aa, Artificial Sequence
  Synthetic
RKIAKKLVDDVERRLRKSLRLIEELNKESRDIVRELLRLIEELLKEVEELVERLLREVK

SEQ ID NO: 18117 - protein, 59 aa, Artificial Sequence
  Synthetic
SELEKVLDEVRKRAKESLRRSEELAKRVEEMDERNLRNSKELRERVEEVIKRLLEVARQ

SEQ ID NO: 18118 - protein, 56 aa, Artificial Sequence
  Synthetic
SRVLEEVERIVKRVLDEDKKVLDRLRRSVERSSRESEKVLDELKKRVDRVLDEVRR

SEQ ID NO: 18119 - protein, 59 aa, Artificial Sequence
  Synthetic
SELEKVFEDVKRRLDESLEKSKELLKRVRDTDRENLKNSKRLLERNKRLVDDLLRVVEA

SEQ ID NO: 18120 - protein, 56 aa, Artificial Sequence
  Synthetic
SRLLEELEKRAKKVLDDDKRVLDEARRSSKRVTDEDRKVLKTAEDINREVSKRIRD

SEQ ID NO: 18121 - protein, 59 aa, Artificial Sequence
  Synthetic
SELEKVVDDVRRRLDRLLETSEKLLEDATKRLKDSERKSDEIVKTNEELLERLKTVLER

SEQ ID NO: 18122 - protein, 56 aa, Artificial Sequence
  Synthetic
SELLKRVEERIKRVLDESKKILKEIADEVRRVLERDKELLKRLEDKNREVSERIRK

SEQ ID NO: 18123 - protein, 59 aa, Artificial Sequence
  Synthetic
SELEKVVKEVADLLRRNLEKSKRVLEEVRRRLEENLRESEKVHDDNRKTARRILELVRE

SEQ ID NO: 18124 - protein, 56 aa, Artificial Sequence
  Synthetic
SRLLEELEERVRESIERSRRFIEELEKIVEETLTESEKLARASSEITKTVLDEIRK

SEQ ID NO: 18125 - protein, 59 aa, Artificial Sequence
  Synthetic
RELEEVFKEVEKELRDNLRKVEEVLREVRERLKENLDRSKEVLKDVRRRIKELLDLARG

SEQ ID NO: 18126 - protein, 56 aa, Artificial Sequence
  Synthetic
SKLLERLERKVEETLRRSREVIEDAKRIVEETLRRSEDIIREAKEIIDDVLEKIRR

SEQ ID NO: 18127 - protein, 60 aa, Artificial Sequence
  Synthetic
STDDALRKIERRHKELTKEVRDMLRKVDEEVKRLIEENEDVLRKLREEVDRVIKDIRRAD

SEQ ID NO: 18128 - protein, 56 aa, Artificial Sequence
  Synthetic
LEDLRRDSERIIEEVKRRLDELRREVEKVIDDVRRLSEKNEKDARRIIEEVKRRLD

SEQ ID NO: 18129 - protein, 60 aa, Artificial Sequence
  Synthetic
STEEVLDEIRKLHKTLTEDIKRVLREIEELHRRTIEENKEVLDKIREDYKRVIDDVRTKD

SEQ ID NO: 18130 - protein, 56 aa, Artificial Sequence
  Synthetic
AEELLRESKEAIKEVKRVLEELRKESKRVVDETRKLSEENLEHSERVLRKVEEDLR

SEQ ID NO: 18131 - protein, 60 aa, Artificial Sequence
  Synthetic
DEDKVLRKVKKLVEDIRREIERILREAERLHKELTRRNEEVLERIRRLVDKVIKEIRKAD

SEQ ID NO: 18132 - protein, 56 aa, Artificial Sequence
  Synthetic
LRELLERVERVIREVRRDLKRLLDESRDVVRRVEERSRRNLEEVKRDIERVKRELD

SEQ ID NO: 18133 - protein, 60 aa, Artificial Sequence
  Synthetic
SKEEVLREIERLHKETIRRIEEVLREATELHKRLTETNKRVLEDLEREAREVIEDVRRAD

SEQ ID NO: 18134 - protein, 56 aa, Artificial Sequence
  Synthetic
ARELLEESRREVERSEKEVERLLRKSRKVVEEVRKLSEENDREVKKILEEVKRRLD

SEQ ID NO: 18135 - protein, 60 aa, Artificial Sequence
  Synthetic
SKEEVLDEMRRLHETTKRDIRRVLKEIEELHERTLRENKRVLEEIKELVRRVIEDIKRKK

SEQ ID NO: 18136 - protein, 56 aa, Artificial Sequence
  Synthetic
LKELLDESRRVVKESKEDLDRLLKESRDVVDDTRRKSEKNLRDAERVIREAEEAVR

SEQ ID NO: 18137 - protein, 60 aa, Artificial Sequence
  Synthetic
DRERVLREMERLVRELLRENREVLDEIRKLHERTVRRNRELAKRLEEEAKEVIDRIEKTK

SEQ ID NO: 18138 - protein, 56 aa, Artificial Sequence
  Synthetic
VKKLLEEARDVIRRAKEKSKRNLDESRRVVKETDDLSEKNREDVRKIIKEVEEELK

SEQ ID NO: 18139 - protein, 60 aa, Artificial Sequence
  Synthetic
DVEEVLREIEELHRRTIERIKKVAKKVREDVKRVLDENKKVLDELRRRVEEVIEKIKKAD

SEQ ID NO: 18140 - protein, 56 aa, Artificial Sequence
  Synthetic
MRELKKRSDDVVRESEKELRRLEDEIRKVIEDLKKLSEDNEREVEKVIRKVEEDLR

SEQ ID NO: 18141 - protein, 60 aa, Artificial Sequence
  Synthetic
DMERIVDTLRKLNTDSNRRSKEAIDRLRKTNKDSLDKVEEVLREAERLAEDVLRKVEEKV

SEQ ID NO: 18142 - protein, 59 aa, Artificial Sequence
  Synthetic
KEVLKKLLEEVKDSNRRSEEDVRRMEEEVKRSNDELLKELKEILDKVREAIKKLEEKVK

SEQ ID NO: 18143 - protein, 60 aa, Artificial Sequence
  Synthetic
SAEDIIRRLRDLNRRSNKKSRDVAEKLRRDNKRTLEKVERKARELKKLAEEVVKEVRDKV

SEQ ID NO: 18144 - protein, 59 aa, Artificial Sequence
  Synthetic
EEVLRRMLKEVEDSNRDSDRDVRRIEEEVRRLNEELDKKLEDLEREVRRMIEEIRRKVK

SEQ ID NO: 18145 - protein, 61 aa, Artificial Sequence
  Synthetic
SELEEVKERVERVLKRIRDLTRELEDRVDKILEKSKRTLDELEKRVREVIARIKELVKRLK

SEQ ID NO: 18146 - protein, 56 aa, Artificial Sequence
  Synthetic
SEVLKRLEELAREVIEEDKRALERLDRKIRRVLDESRDVLRKIRKLIEDVLREVEK

SEQ ID NO: 18147 - protein, 61 aa, Artificial Sequence
  Synthetic
SESETIEKEADEMLKRSKKTLEELRKTVKRILERIEKLTRDLEKTAEDIIRKIEDDLRRLK

SEQ ID NO: 18148 - protein, 56 aa, Artificial Sequence
  Synthetic
SEVAKRISEKIRRVLEDSRRVLEELEDLIRRVLERDKRALERIKEDIDRIIRRVRT

SEQ ID NO: 18149 - protein, 61 aa, Artificial Sequence
  Synthetic
SELEAVLDELRKLVKELEDRLRKVNEESRRLIKELLDRLREVDERSRKLIKDLAEKARRRG

SEQ ID NO: 18150 - protein, 56 aa, Artificial Sequence
  Synthetic
TDELRKRVRDLVRRVDELIKRSKRHAEELTREVEEKVRESEEHVRRLVKEVEDRIR

SEQ ID NO: 18151 - protein, 56 aa, Artificial Sequence
  Synthetic
DEVEEADKRVEDEVRRLKRLVEEHTKRVEDKVRTLKKLVKEHTDEVRRAVEELKRR

SEQ ID NO: 18152 - protein, 55 aa, Artificial Sequence
  Synthetic
EDVLRKVKELLEDVARLVEESHEEARKLLKEVEDRLRESVREVEELLRDVERRTR

SEQ ID NO: 18153 - protein, 59 aa, Artificial Sequence
  Synthetic
DEVEKVKEEIRRIVKELEDRVEEHKKEAKKIIDELRRLVKRHREEVEEIVKKLEELVRR

SEQ ID NO: 18154 - protein, 55 aa, Artificial Sequence
  Synthetic
EEVLKEAEKLLEDVERKLRKSHEDLERLLKEVEEAVRDSNEEVRERLDRVREKMR

SEQ ID NO: 18155 - protein, 59 aa, Artificial Sequence
  Synthetic
DEDRKVEEDIRRIVKRLREIVEKHNREAREIIKRLRDEVRKHRDKARKIVTRLDELIKR

SEQ ID NO: 18156 - protein, 55 aa, Artificial Sequence
  Synthetic
KDVLKEAEELLEKVKRDLDRSHEELEELLKRVREELEDSNRELEKLIEEVERKVR

SEQ ID NO: 18157 - protein, 59 aa, Artificial Sequence
  Synthetic
SEVEDVDDRIRKIIKKLEDLVRKHNEDARRIIDELRELVERHNRRAREIVRELEDLVRR

SEQ ID NO: 18158 - protein, 55 aa, Artificial Sequence
  Synthetic
EEVLKKVEKLLKEVLDLMKESNEELEKLLEEVKREMEESVKELKKLLDEVREKVK

SEQ ID NO: 18159 - protein, 61 aa, Artificial Sequence
  Synthetic
KEIEDVLEKVRKVVTDLKKKLEDVNRESEKLVREVVKELKRVDDESRKLVERVEKEADEKG

SEQ ID NO: 18160 - protein, 56 aa, Artificial Sequence
  Synthetic
EEELDRRIKELKDRADKLIKDSKDNVEELRKKAEELIRRSRKNVEDLVRKATEDVR

SEQ ID NO: 18161 - protein, 61 aa, Artificial Sequence
  Synthetic
RELEEVLKKVEDLHRDVMKKIDDVVREASELHKKVKEDIDEVVKRAEDVLRRVKRELDKRG

SEQ ID NO: 18162 - protein, 56 aa, Artificial Sequence
  Synthetic
KDELDEHIERSLRKVTELVKDLKEHIERSLEEAKELVRRLEELIEELLRRLAEEVR

SEQ ID NO: 18163 - protein, 60 aa, Artificial Sequence
  Synthetic
SEVEEVLREAEELLKEVRDRLRESVEKSKRLLDEVRRKIEESHRRHKELSDEIRRLAEER

SEQ ID NO: 18164 - protein, 56 aa, Artificial Sequence
  Synthetic
IEELRKEIKKKIDEMRRLVKEDTERLERVAEELRRRVEEDKERSKDVVRRLREDVK

SEQ ID NO: 18165 - protein, 60 aa, Artificial Sequence
  Synthetic
SEVEEVLKRAEELLDDVRRLLERSHRETERLLDEVRKRVEDSHREHRKLSDEVRRKAEER

SEQ ID NO: 18166 - protein, 56 aa, Artificial Sequence
  Synthetic
IEELRKDIERAVKELRERVEENTRRVEELVRRLRELVEEDRKRSKEVADEMDERVR

SEQ ID NO: 18167 - protein, 60 aa, Artificial Sequence
  Synthetic
KEVEEVLDTAKKLLDEVRRELERSHEEHKRLSDEIRERLERSHEETERLLKEVKEEVDDK

SEQ ID NO: 18168 - protein, 56 aa, Artificial Sequence
  Synthetic
IEELKRRIDDMVRRLRELVERDRRESKKVADDLRRLVKENTERAREKIEELRKDVE

SEQ ID NO: 18169 - protein, 60 aa, Artificial Sequence
  Synthetic
SEIEEVLKEAEKLLREVEKELRRSHEELKRLLKEVRDKVRRSMEESERLLEEIKKKADER

SEQ ID NO: 18170 - protein, 56 aa, Artificial Sequence
  Synthetic
IEELKRRIEDAARKLEKLVKDDRERIERKVRELERLVEEDKKRLRDRVRKMDEDVR

SEQ ID NO: 18171 - protein, 60 aa, Artificial Sequence
  Synthetic
REVEEIVKKVRKEVTRLLREVEEDMKRNRDTIRELLKYVKKDLEENKDIIRRLLELIRRD

SEQ ID NO: 18172 - protein, 55 aa, Artificial Sequence
  Synthetic
EEARKDIERLLEEVRTKLRENEEDLRRLVKEVDRELKRNRDELERLAKEVRDELK

SEQ ID NO: 18173 - protein, 61 aa, Artificial Sequence
  Synthetic
SEAEEIAKEVEKRIRELLDRVRRMVEESEKYARDSLRKIKRLLDEVRRRIEELLRKIRRDG

SEQ ID NO: 18174 - protein, 55 aa, Artificial Sequence
  Synthetic
SEVAKKVKELLDEVERILREWEKEDRRLLKESEDLLREVEKEVRKLLRRVEEELK

SEQ ID NO: 18175 - protein, 61 aa, Artificial Sequence
  Synthetic
SESEKILEEAKRRIRKLLEDVKEMVKRSRDYARESLKRIKDLVEESKREIDKLLEEIKRSG

SEQ ID NO: 18176 - protein, 55 aa, Artificial Sequence
  Synthetic
SEVEEDLKRLLEEVKRELKRWEEDDKRLLDDSERALKEWEDTDRRLLKRVEDELR

SEQ ID NO: 18177 - protein, 61 aa, Artificial Sequence
  Synthetic
SEVEEIVKDAERYIKESLDRIRKAVEESRRRITELLKEVERLLREVRKRIKELLDEIRRDG

SEQ ID NO: 18178 - protein, 54 aa, Artificial Sequence
  Synthetic
DAERKLEELLEESRELLKRWRDDDKRLVDDVRRKLKEVEEEVRKLLKEVEDELR

SEQ ID NO: 18179 - protein, 61 aa, Artificial Sequence
  Synthetic
SEVEEIVKEAKRRIDELLKKVDELLKESERYARKSLKDNKDMVRRSEERIRELLEKIKRDG

SEQ ID NO: 18180 - protein, 55 aa, Artificial Sequence
  Synthetic
SEAEKRLKDLLDRVKEKLDEVRRRDRELLEESKDLSRRWKERDDRLLEEVEKALK

SEQ ID NO: 18181 - protein, 57 aa, Artificial Sequence
  Synthetic
REIEKIREDLERLLEEVKRAAEEWRRRDEELVRKLEELIKRVLDEDRRLLRELRDKG

SEQ ID NO: 18182 - protein, 59 aa, Artificial Sequence
  Synthetic
REVIKKVLEEIRDKIRKILKTIEDLVRKSEDLIRRVLEEIERILDESRRDVEEVKRREE

SEQ ID NO: 18183 - protein, 56 aa, Artificial Sequence
  Synthetic
DEDRRVKTEIKKLLEELTRRSREVEEDDRRLLDELTRETERIEEDLRRLLEEVRRS

SEQ ID NO: 18184 - protein, 55 aa, Artificial Sequence
  Synthetic
DEIEREVRKVEEDYRRSLRRVLEESRKIAERYKKKLDEMREEVRRRAKKVKDEVR

SEQ ID NO: 18185 - protein, 56 aa, Artificial Sequence
  Synthetic
KSVEKIVEDIKRVADKILEDIKRSEDRVREIVDRHRREIDKVVKEIVKRVEDLKRN

SEQ ID NO: 18186 - protein, 59 aa, Artificial Sequence
  Synthetic
KDEMEDLKRRVDELKKEIERALKEHKDKVKKLLDDLRRLNEELRREVRRVLEEVRETTR

SEQ ID NO: 18187 - protein, 63 aa, Artificial Sequence
  Synthetic
DEIERVEEALKKVEKDLRRLIRELEKLNDKIERDIRRLHEETNKRLKEVREKVEDMIRRVSAR

SEQ ID NO: 18188 - protein, 59 aa, Artificial Sequence
  Synthetic
RRVVKKLLDEIEEILRRLKKLVDDHARESKRILRESERKVEALLEEIEEILKRLEEKVK

SEQ ID NO: 18189 - protein, 60 aa, Artificial Sequence
  Synthetic
DEIERVLREIDELRKKVEKVIEDSRRNAKRWLDRVKRTAEELNKLSDELLEEVTRLAEAG

SEQ ID NO: 18190 - protein, 59 aa, Artificial Sequence
  Synthetic
SRAMEEVRKTAEEVIKTVDKLLKELRKTYEDILRDIDRLLKEHHARNRRVLEEVERLTQ

SEQ ID NO: 18191 - protein, 56 aa, Artificial Sequence
  Synthetic
SEREEVKKRLDDVRREAKRLLDEVRKRLEESHRKHKKLLDEVRKRLKEVEEEAKRR

SEQ ID NO: 18192 - protein, 56 aa, Artificial Sequence
  Synthetic
KEKVTKIIEDLKRELEEMFRKLKRLVEEDDRRSKESLEEVRKLVEDARRKIEEDTR

SEQ ID NO: 18193 - protein, 60 aa, Artificial Sequence
  Synthetic
SSIEKLKKVVEDIKRRSEDLNRELEKVVRDVKKRSEELNEELRKVSEEIERRLRELLKRI

SEQ ID NO: 18194 - protein, 55 aa, Artificial Sequence
  Synthetic
ERFVEELRRALKKDEDDMRRVVEDIERLLEEDERRMKKAVEDHRRLLEELEERAK

SEQ ID NO: 18195 - protein, 56 aa, Artificial Sequence
  Synthetic
DESEELKKVLKEIEDEVRRLIREIERVLEEIERRDRELLKRDEETLKRIEEEVRKL

SEQ ID NO: 18196 - protein, 55 aa, Artificial Sequence
  Synthetic
EEIIEELRRILKEAEDVIRRIIEEVRDVLRESEKRVRESIDENRKILEELRRRAK

SEQ ID NO: 18197 - protein, 56 aa, Artificial Sequence
  Synthetic
DEEDRLRRELEKVRRDADRLLEEIRRVLEEVERRSKELLKRDEDSLREIVRTVTEE

SEQ ID NO: 18198 - protein, 55 aa, Artificial Sequence
  Synthetic
DEVLEEIRRILEELRKEAEDIIRRIRELLRELEKNVTDSIRRNEEMLKELRRKVK

SEQ ID NO: 18199 - protein, 59 aa, Artificial Sequence
  Synthetic
SEAEKILEDMKRYIEEHIERVKRSLEENKKKDRELIEKSRKSLEDARKKIRELLELVRQ

SEQ ID NO: 18200 - protein, 56 aa, Artificial Sequence
  Synthetic
EEILKRIRDLVKELEERDRRVIEEMKKSNKRTEDTDREVLERIRRLVERLADEARK

SEQ ID NO: 18201 - protein, 60 aa, Artificial Sequence
  Synthetic
SELERVIEEIKRLLERLKRENEEVKKRVKKLLDELRKINKDVEDTVRELLKRVKELVDRA

SEQ ID NO: 18202 - protein, 59 aa, Artificial Sequence
  Synthetic
KDEIEEALRRVEEHIKRHLKTVKELAEKAERHIREHLKEVKRMLEKAKRTIDELLKKIK

SEQ ID NO: 18203 - protein, 57 aa, Artificial Sequence
  Synthetic
SLREAAKEVLERVRREVEKLRKSNEEVLTRVREEVKKLLETNKDVLRRVAEILKTAN

SEQ ID NO: 18204 - protein, 55 aa, Artificial Sequence
  Synthetic
EEDIREIEDILRKIAETVETLNRRLEDILREIRKSSKKTIDELREKAKELEDRTR

SEQ ID NO: 18205 - protein, 61 aa, Artificial Sequence
  Synthetic
SEVDEDLKDIKRYLDEHRKRVEEVVKRLEDRSRETAREVEEDVKRIERKVEEAKKEADERG

SEQ ID NO: 18206 - protein, 59 aa, Artificial Sequence
  Synthetic
EDAKRRIEEVLERVRRELERSEEKLRRVLEKHREDNDRLEEELDRVLRELEKILDEVAT

SEQ ID NO: 18207 - protein, 60 aa, Artificial Sequence
  Synthetic
DEVRKILKELKELVKRIEDKLRKYLEDVRREVERIEEEVRRNLERIKRLAEEIERRVRRD

SEQ ID NO: 18208 - protein, 59 aa, Artificial Sequence
  Synthetic
EDVKRKIDKVLDEVRRLLEDIKRRVEKINTDTERLLKKLAEDSKRALEEVKETLERAER

SEQ ID NO: 18209 - protein, 60 aa, Artificial Sequence
  Synthetic
ELRERIKRALDEHRRVSEELERRVREANKRHNEVSKEVKDDLKRSHDELRESLERIKRRG

SEQ ID NO: 18210 - protein, 55 aa, Artificial Sequence
  Synthetic
EEDLKRIREETERLKEDVRRYLRELEKLSRDLRRKVEELLKDNKRKVKEIEDEAK

SEQ ID NO: 18211 - protein, 60 aa, Artificial Sequence
  Synthetic
DELETLEERIRRSVERVRRELKRYKEEMDKHSEDLKRLVDKNLEDVRRELEEIRKLATDG

SEQ ID NO: 18212 - protein, 59 aa, Artificial Sequence
  Synthetic
EDMEKKLRELLERHERENKKAREDVEEANRRNEEVLKDIERRSKKALDDVRRELERVRK

SEQ ID NO: 18213 - protein, 61 aa, Artificial Sequence
  Synthetic
SLKEVLDKIEEDHRRMSKRNEEVLEEVKRRAEKLLKDAEEVLRRVRERIEELIRRVEETKG

SEQ ID NO: 18214 - protein, 56 aa, Artificial Sequence
  Synthetic
VKELKKRADESRKTVERLSRELKKELRKVEEDVKREVEKIEEDLKRIARRVREESR

SEQ ID NO: 18215 - protein, 60 aa, Artificial Sequence
  Synthetic
SELERLLEEVERLLEKLERDNKRLLDDVRRLLERLRRDNERLLEKNKRLLDRLREEVSRV

SEQ ID NO: 18216 - protein, 56 aa, Artificial Sequence
  Synthetic
IEKLAREVKRHIERHKEELDRLRKEVEKNARKHEEDLRRLEERSKKHVEDIERETR

SEQ ID NO: 18217 - protein, 60 aa, Artificial Sequence
  Synthetic
SELEKLLEDVKRLLDELRERNEKVLEDARRLLEELRKRNEDLLRRNRELLERLEREVSKV

SEQ ID NO: 18218 - protein, 56 aa, Artificial Sequence
  Synthetic
IDRVRRRVERHIREHERDLREVKKRIEEDAKRHRDRLKKLEEDSREHVKRMEDRTR

SEQ ID NO: 18219 - protein, 60 aa, Artificial Sequence
  Synthetic
KLEELAKELRRLLEELRKRSKEVIDRLRRLNEELRKTSEEVIRRLRELNRRLTEKARRRL

SEQ ID NO: 18220 - protein, 55 aa, Artificial Sequence
  Synthetic
EEVLRKVREEVKEHERRLEDALRRSKKEIDDHKRELEELLKENAEEVRRVEERIR

SEQ ID NO: 18221 - protein, 60 aa, Artificial Sequence
  Synthetic
KAEELVRELKRLLDKLREESKKVIEELKRRLDEVAKKSEDVVEEMRRLLEELKEKIERRL

SEQ ID NO: 18222 - protein, 55 aa, Artificial Sequence
  Synthetic
EEVLRDVRRKVEDHRRKLDEIRKRVTDEARRHERELEKALEKIRRDIRRIEEELR

SEQ ID NO: 18223 - protein, 60 aa, Artificial Sequence
  Synthetic
KVEDLLREAKALLDELKRESERIIKELRKLNDDLTKKSEEVIRELEKLLRDLKKIVDERL

SEQ ID NO: 18224 - protein, 55 aa, Artificial Sequence
  Synthetic
EEALKKVRKEVEDHKRRLKEAVDRNRKKIKDHEEELERTLRDIRRKIDKERRELE

SEQ ID NO: 18225 - protein, 59 aa, Artificial Sequence
  Synthetic
EELERLLKRVRDESKKNRDKVREDLERSRRKSKRHEDELRRLLKEARDDIDRVRDLRRK

SEQ ID NO: 18226 - protein, 56 aa, Artificial Sequence
  Synthetic
EEVVKEAEKILDDNRKENERVSEEDKELLERNKKKAEDVLRELEELIRKLAEELKK

SEQ ID NO: 18227 - protein, 60 aa, Artificial Sequence
  Synthetic
SELEELLKRIRDKSKENEDEVRTDLKRVRDYARRHEERLRELLERVRDELRKAEELRRAG

SEQ ID NO: 18228 - protein, 56 aa, Artificial Sequence
  Synthetic
ERVLEEIERIMRENKRRNEEVIKEIKELIDRLRRKSERVIEEIKKRIDELRDKARR

SEQ ID NO: 18229 - protein, 61 aa, Artificial Sequence
  Synthetic
EEEREIEERLRKKIEEIRREDKRHHDEVRRKVKEIKEEDREHHERVKRKAEEVKKRIETTG

SEQ ID NO: 18230 - protein, 55 aa, Artificial Sequence
  Synthetic
KDVLRELKRLLDELRESARKNNEDLKRLLEELEESVKRNNDELKKLLDELKERAR

SEQ ID NO: 18231 - protein, 61 aa, Artificial Sequence
  Synthetic
RELEELAERVKRLLERDEELLRRLKDAVRRLSEKDRRLLERLAREVKRLLDELRDLVRKRL

SEQ ID NO: 18232 - protein, 59 aa, Artificial Sequence
  Synthetic
KELLERVITELERKARESEKKHEDSLRELERLARESEERHKRSLEEVERKIEEIKRDLD

SEQ ID NO: 18233 - protein, 60 aa, Artificial Sequence
  Synthetic
RELEKLEDEIRRELRRIEKELKDYERELEERADKDRRDIEDYRRRLEERVKEIEDRLRRD

SEQ ID NO: 18234 - protein, 55 aa, Artificial Sequence
  Synthetic
EELRKILEDALKRVREEVKRILDRNRELLRESEELVRRVLKRNRDLLREVDERVR

SEQ ID NO: 18235 - protein, 61 aa, Artificial Sequence
  Synthetic
DKVREALKRLKDKMETYERRSKKHIEDHKRKLKEYEERVRRNIKRLREELKKLEEDAKTRG

SEQ ID NO: 18236 - protein, 59 aa, Artificial Sequence
  Synthetic
EELLKRVDELARRIMKRIKELNRENERVVRESLKRVDELNKRSEKVHKEVLDRLEELRR

SEQ ID NO: 18237 - protein, 57 aa, Artificial Sequence
  Synthetic
SLKEELEKLVRDIIRDNRRLLEENEELVRRSEESNKRLLEENEETARRIKAELERAG

SEQ ID NO: 18238 - protein, 59 aa, Artificial Sequence
  Synthetic
EKLVEEVKRKLKRKLEEIRREHRRTKEEIKKTNEDIKRRHDETLRRLEKTLEDIKERTR

SEQ ID NO: 18239 - protein, 60 aa, Artificial Sequence
  Synthetic
SEVEKILEELKREVREHERRVEKLVRELEDYVRRHREKVKRIEERLRDKLREIEELVKEG

SEQ ID NO: 18240 - protein, 59 aa, Artificial Sequence
  Synthetic
EKAVREIETLADEIRERIERSLKRIRDLIREIKEDLRRSLERIREIIREIKKAIDDRRK

SEQ ID NO: 18241 - protein, 60 aa, Artificial Sequence
  Synthetic
SEVEKILKEIRDENERLKKEIEEILRELERKLREHRREVEEVLKRIREKIETLKDESRRE

SEQ ID NO: 18242 - protein, 59 aa, Artificial Sequence
  Synthetic
EEMLREMERISREDRETLKRLTDRIREMIRRLEEEIKRSEREAREIIKEAKKVLEDEAT

SEQ ID NO: 18243 - protein, 61 aa, Artificial Sequence
  Synthetic
SRVEELIKDLRRSTKELEDRVRKLLEELKDKTRRTEKRNREKLEKLKEELRKLEEDVKREG

SEQ ID NO: 18244 - protein, 55 aa, Artificial Sequence
  Synthetic
EKVRKVMEDDRRKLKKILDDVEDVLRKHKKVLEDLKRTNDDVLREARKLAEKIRR

SEQ ID NO: 18245 - protein, 60 aa, Artificial Sequence
  Synthetic
SAEERLKEALKRLDDVSKRSEEEIRRMIKRIERISRESLKRLKDLNRRIKELVERIERRL

SEQ ID NO: 18246 - protein, 55 aa, Artificial Sequence
  Synthetic
ERLLEEIKRYIDEHKRRLDELRKDIERYLEEHKERLRELEKRHEELLRTLDREAK

SEQ ID NO: 18247 - protein, 61 aa, Artificial Sequence
  Synthetic
SAEEDLDRMRKKVEDVIREDKERVRKLLERAKEVIRESEKKHEDLRRRIRKVIKEIRERTN

SEQ ID NO: 18248 - protein, 59 aa, Artificial Sequence
  Synthetic
DTDLERELRRIDKHLRDHKDEARKSEERVEDHLRRHRERVRRNEEDVEDKLKKLKDETK

SEQ ID NO: 18249 - protein, 59 aa, Artificial Sequence
  Synthetic
REEEELKRRNKDHNRRHREDTKRIAEDVDRKLREWKKKSDEAREEVKRLLERLKELADR

SEQ ID NO: 18250 - protein, 55 aa, Artificial Sequence
  Synthetic
EDLRRLMKENRETIRESAEILERLRERVEDLVRRDREILEKLLRDIEELAERIKR

SEQ ID NO: 18251 - protein, 60 aa, Artificial Sequence
  Synthetic
SVEDELRKLEERLKRIADELRRLVEKNIEDNKESLKEIEKLIRENIERNKEVLKRIAERG

SEQ ID NO: 18252 - protein, 59 aa, Artificial Sequence
  Synthetic
KDELKKALDDVDKKLEDLRREVEDRDRKNEEDNRRLRKELEERSRENKEFLDKLAREAD

SEQ ID NO: 18253 - protein, 61 aa, Artificial Sequence
  Synthetic
SEKDESARDIEEKLERHLRKSDESRRRNEKRIKEHRDRSDESRKKFETDLKRIEDEVRKRG

SEQ ID NO: 18254 - protein, 55 aa, Artificial Sequence
  Synthetic
EKLKDLERKVREVIDRDRDILRRLEEEHRKVITEDEEILKRLEEKAREAIERIRR

SEQ ID NO: 18255 - protein, 61 aa, Artificial Sequence
  Synthetic
SEKDERLEEIKRRLKEHKRRSEEAVKDNDRKLEKHKRDSDRSAEEVKKKLEEIEKRVRKDG

SEQ ID NO: 18256 - protein, 55 aa, Artificial Sequence
  Synthetic
KKLDDLEREIRKVIEESKRLLEELERRHRRVIEEDKRILDELRRLIEELIEDAKR

SEQ ID NO: 18257 - protein, 61 aa, Artificial Sequence
  Synthetic
SEKDEELKRIKEDLERHERESEDDVRRNEEKIRRHRRKTEEAVKEVEEELKRLEEDVRREG

SEQ ID NO: 18258 - protein, 55 aa, Artificial Sequence
  Synthetic
RDLERLRKEIREVIEKSKDLLRELRRRHEKVIEDSEDILRKLEKKIKDLVDKIRK

SEQ ID NO: 18259 - protein, 61 aa, Artificial Sequence
  Synthetic
SRKDEEVKRVKEKLKKHEERSRDMVRKVEDKSRRHREKIKEAEREVRRRIEELEEDVRRRG

SEQ ID NO: 18260 - protein, 55 aa, Artificial Sequence
  Synthetic
KKLEDLREEAERVIRRSEKLLEELREHVERNIDEVREILRELAELVKRVIDEIRR

SEQ ID NO: 18261 - protein, 60 aa, Artificial Sequence
  Synthetic
SVEDILRTLRRLLEELEEESERILKRLREIIETNVRRVKELLRRLKERLDELAERLKAKV

SEQ ID NO: 18262 - protein, 59 aa, Artificial Sequence
  Synthetic
SKELDDLLKKVEEHLRRHKRKLEKALKDVEDESREHEKELRRALKRIERLLRELERKAD

SEQ ID NO: 18263 - protein, 60 aa, Artificial Sequence
  Synthetic
DEEEVIREIEKRFRDLIRRAEDVLRRIAEKMKRLKDKTRRLLEELRESNRKLIKELRDRI

SEQ ID NO: 18264 - protein, 56 aa, Artificial Sequence
  Synthetic
SKEVRDRVEEELKRIEDRLRKLDTDVDRYLKEHEDRLRKLKEDNERDLKRVEERAR

SEQ ID NO: 18265 - protein, 56 aa, Artificial Sequence
  Synthetic
DIEELLKEVKKEVDRVEKKVKELIDRNKERVDRVREENERVADEVRKLIKELRDRI

SEQ ID NO: 18266 - protein, 59 aa, Artificial Sequence
  Synthetic
RELVEKVAREAREKLKKVEDLLRKISRRSEELLRRNREATKKILKELRELLRRVEEKRR

SEQ ID NO: 18267 - protein, 59 aa, Artificial Sequence
  Synthetic
SEAEEALKRHRKLNKEAEKRAKDATDDSKRLLDEIRKRAKEASEDSKRLLDEARRLREA

SEQ ID NO: 18268 - protein, 60 aa, Artificial Sequence
  Synthetic
KERVRRILEEAKKTARELRERIKKLLKENEDAAKKLRDEIDEAAKKNKKAADEAREEARR

SEQ ID NO: 18269 - protein, 59 aa, Artificial Sequence
  Synthetic
SELEKVLEEHRRLNDEIRKELEDVTRKSEETNKRIEEDLRRVTKEAKDLLERIKEKLEA

SEQ ID NO: 18270 - protein, 60 aa, Artificial Sequence
  Synthetic
RRRVEEILRDMKETVDKLKKEIEKLLEENKESAKELRERIKENLETNRDLVRKLEEDIKR

SEQ ID NO: 18271 - protein, 59 aa, Artificial Sequence
  Synthetic
DEAEKALEEVRDLIREIRERDRKVTEDVERLNREIREKLKEVTERVKRSNDDIRRLLEE

SEQ ID NO: 18272 - protein, 56 aa, Artificial Sequence
  Synthetic
KSILEELERLVRELRKESEKSLEDLERLNKKLEDEVRDILRKLNKLNEDLLRKVEE

SEQ ID NO: 18273 - protein, 59 aa, Artificial Sequence
  Synthetic
SEMDEARKEVKKLLDEVRKRDEDVTRKVEELNKRIEERAKRVAEEVEKLIREILKRLRD

SEQ ID NO: 18274 - protein, 56 aa, Artificial Sequence
  Synthetic
EKILEDLRRLVKKLKEESDRSLERLERLNERLERRIREILKRLEKLVRELRKEVER

SEQ ID NO: 18275 - protein, 59 aa, Artificial Sequence
  Synthetic
SEAEEALRKVEELIRRVKKRDDEAVKEVRELNKRIADILREVLETVRKLLEDVEKALRD

SEQ ID NO: 18276 - protein, 56 aa, Artificial Sequence
  Synthetic
EDILRTLRELVRDLERKSEESLKELNRLNEDLKREVKRVLDELEELVRRLKKKVDD

SEQ ID NO: 18277 - protein, 57 aa, Artificial Sequence
  Synthetic
QVEDVIRESKKLTEDSEKRVRDIIRRLKKTIKDSEDRVRRMVEELRERIKRLRERLE

SEQ ID NO: 18278 - protein, 60 aa, Artificial Sequence
  Synthetic
SDEVIETLLRKDRDLNRRVNEELRKLEEEVEELNRRVNETIKEILRRIAELIRRILEKTK

SEQ ID NO: 18279 - protein, 56 aa, Artificial Sequence
  Synthetic
KVEEILKELEELIKRSKETVDEVIKRSKDLVDESRRRIEDVIRELEKLIRELDKKL

SEQ ID NO: 18280 - protein, 60 aa, Artificial Sequence
  Synthetic
SEEVVRTLVKEIRDLNKRVNEEIKRLLDEDKKLNEEVNRLIKELKKEIEDLIREVLEDKR

SEQ ID NO: 18281 - protein, 57 aa, Artificial Sequence
  Synthetic
EVEDIIRESKKLIEDSKERVKEVIKESKRLIEELERTVREVIKELRERVDRLRKKLR

SEQ ID NO: 18282 - protein, 60 aa, Artificial Sequence
  Synthetic
SKEVLDTLLKEDRDLNEDVKRRITELLEEDRRLIEEVKKRIRELRERIKRVIEEVDRATT

SEQ ID NO: 18283 - protein, 57 aa, Artificial Sequence
  Synthetic
STAEEIVRRIRDVNRRINEAIERLLEEDEKVIRDVERRIEEVLERDRRVIEEVKRRV

SEQ ID NO: 18284 - protein, 56 aa, Artificial Sequence
  Synthetic
ERIIEEIKRILKESEDRLRRILETSRERLKELKKKLERVLEDSKKKLDELRRELRK

SEQ ID NO: 18285 - protein, 57 aa, Artificial Sequence
  Synthetic
REAEDLVRKVREVNKKANRDIKELLDRDEKVIREVARAAEAIVDEARRIVEEVERKI

SEQ ID NO: 18286 - protein, 56 aa, Artificial Sequence
  Synthetic
ERIIKEIKETLDESRKRAEEVLEKSRRLLEELRKRVEEIVKRIKELIDELERRVRK

SEQ ID NO: 18287 - protein, 59 aa, Artificial Sequence
  Synthetic
SAEEIIKTLEELVEKLKRDAEETLRKIEELVRRLEEEARKSSEKIRKLVEDLAKEARER

SEQ ID NO: 18288 - protein, 59 aa, Artificial Sequence
  Synthetic
DEVLTEVLKEITELVKRLKELSDRTLEEVRKLVERVKRESKRTLEEAEEVVRELKERLR

SEQ ID NO: 18289 - protein, 59 aa, Artificial Sequence
  Synthetic
DAERLLREVEELVRRLEEEMEKTDREIKELIKRLEERLRTTSREIKKLIEDLEREARER

SEQ ID NO: 18290 - protein, 59 aa, Artificial Sequence
  Synthetic
REVLKKVIDEIRKLVKRVKDESKRSLDEIRKLAEEVDRRSKKVLDEIRRLVDEVRERLR

SEQ ID NO: 18291 - protein, 59 aa, Artificial Sequence
  Synthetic
DAEDILREIKKLADDLKREADKSLKEIEELARRLEEEAERSLREIEELARRLKKRADEK

SEQ ID NO: 18292 - protein, 59 aa, Artificial Sequence
  Synthetic
REALKRAAERARELADRARKLSEDTLRKAKKLADDARKLSRETLEKARELAERAERRLT

SEQ ID NO: 18293 - protein, 59 aa, Artificial Sequence
  Synthetic
DEAEEVRERVKKLIEESKRLIEEVRRRVRTISERSAELIEEVERRVDKMARDVERLLKD

SEQ ID NO: 18294 - protein, 56 aa, Artificial Sequence
  Synthetic
DEVLRRLEKLVRDSNDEIRRVLKELKEVVKKNRDEIERVLKEARKKVEDLLREIER

SEQ ID NO: 18295 - protein, 59 aa, Artificial Sequence
  Synthetic
SEVERVRRENEETIRRIDEVIKKIEEDNKRTIDEIRDVIRRVKETVEKTNREIEKVRRD

SEQ ID NO: 18296 - protein, 56 aa, Artificial Sequence
  Synthetic
DEALRELRKSNEDLERRIRKVLEDLKRSNDELLEEIDRVLKRLHKSDEDVRKRVTD

SEQ ID NO: 18297 - protein, 59 aa, Artificial Sequence
  Synthetic
RELEEAEKTVEELIRRIKEIIDEVLKRDRDVSERSKELIDKVKREAEKIVEEIERLLKN

SEQ ID NO: 18298 - protein, 56 aa, Artificial Sequence
  Synthetic
SEVLRKLDKKVKDLKREIDDVVRESKELIKRNRRRVEEVAKELERLIKEVKDRIDT

SEQ ID NO: 18299 - protein, 59 aa, Artificial Sequence
  Synthetic
DELERVREEVRRLIKEIEEIIERVERRDEEVSRKSEDLIRRVLKRDEELAKEIEDLKRN

SEQ ID NO: 18300 - protein, 56 aa, Artificial Sequence
  Synthetic
SRVLEELKRLVEELEREIRRVFEKSKKLIDDNRKKADDVVKRSEDLLREVKKEIDR

SEQ ID NO: 18301 - protein, 60 aa, Artificial Sequence
  Synthetic
SESEEVERLVEDVSRRNTKAVRDIEEHSKDVSRRNKKLVREVEEHTREVIERAKELTKRR

SEQ ID NO: 18302 - protein, 56 aa, Artificial Sequence
  Synthetic
RDVVERIRRLLRENVEENKKVLKRSDDLLKKNERENREVVKKSEKDARDLVEEIKT

SEQ ID NO: 18303 - protein, 60 aa, Artificial Sequence
  Synthetic
SEEEDVRRKVEKVSRENKDMVRRILEHSRKVSEDNRRLVKEILDRARKAIEDVKELIERL

SEQ ID NO: 18304 - protein, 56 aa, Artificial Sequence
  Synthetic
RDVVREIKELLDRNREENRKVLEDSERLVDENEKDNKRVLDELRRLLKRAEEEARR

SEQ ID NO: 18305 - protein, 60 aa, Artificial Sequence
  Synthetic
SIDKALRDLKEILDRNRKHSEDLLREAEELVERSNDHSRRVLEEIRKLLRELEEEIRKRV

SEQ ID NO: 18306 - protein, 59 aa, Artificial Sequence
  Synthetic
EKLVREVEKTVEDLSRENKKLNEDVKRTVDELIKKSEKLNEDAKRTIDELLKRVKERIE

SEQ ID NO: 18307 - protein, 60 aa, Artificial Sequence
  Synthetic
SVEDLLRKLKTIVDENRERVKKSLEELRRILDENRRRVERSLRELRESNERLRKEIEDTV

SEQ ID NO: 18308 - protein, 59 aa, Artificial Sequence
  Synthetic
EEVLKKVEETVKRLSDENRELNKRIKEEVDEMSKRNKELNKRIKEENDKLIKEVKDEIR

SEQ ID NO: 18309 - protein, 60 aa, Artificial Sequence
  Synthetic
SVEDVLRELKELIDRNREEAKKTEKELRELIKRNDDEAEKVAKESKKLTEDLEKEAREKV

SEQ ID NO: 18310 - protein, 59 aa, Artificial Sequence
  Synthetic
EKVLREAKERAKEISKRNKDVNEEARKRIKEISDKDKRILDEVRRESKEIEKRLKEALK

SEQ ID NO: 18311 - protein, 60 aa, Artificial Sequence
  Synthetic
DDEERVREVVKRVKEDNERVDREIREIVKRLLEHDRELLEEIKKEVDRVAEELRKLKEDG

SEQ ID NO: 18312 - protein, 56 aa, Artificial Sequence
  Synthetic
SEVLERLRKTLEELEKRNEELLEEARRLLEESREEVRELLERAKKILEDLEREIRR

SEQ ID NO: 18313 - protein, 60 aa, Artificial Sequence
  Synthetic
SREERVREVVKRMLERDEELLRRIREEVERALRRNDEVLREIERVVEEMEERVERLKREG

SEQ ID NO: 18314 - protein, 56 aa, Artificial Sequence
  Synthetic
DEVLEDLRRLLEESVRRVEDLLKKLTDIVRESRKRVRDILRKAKRIVDKLREEIKK

SEQ ID NO: 18315 - protein, 60 aa, Artificial Sequence
  Synthetic
DVEREAKRLLEEVAEHVRRSIKELRKLLEDVARHVEKTLRELEKLTDDVRKRVEKLKRDV

SEQ ID NO: 18316 - protein, 56 aa, Artificial Sequence
  Synthetic
RKVVEDIREKVKDLKRKHDTVLEEIKKEVRRLEKEHKEVLDKSNEDARKLEEDLRR

SEQ ID NO: 18317 - protein, 59 aa, Artificial Sequence
  Synthetic
SEREEAKKLLRENEEDNRRVDREVEKLTEENERINRRVNEEVRKLTEDIKRKVESVKRL

SEQ ID NO: 18318 - protein, 56 aa, Artificial Sequence
  Synthetic
RDIVEDIRRKADRLRERNEETLKRDEDKLKKLEESNRKVLKEDEDELRRLADKLRK

SEQ ID NO: 18319 - protein, 60 aa, Artificial Sequence
  Synthetic
SEAEEAAKRSRDTAKRAEEIAREAAERLKKNAEDAERIAREAKKTSKKTAKEAEDAARSN

SEQ ID NO: 18320 - protein, 55 aa, Artificial Sequence
  Synthetic
DELRELAKRTEDKARKLADELRKLADETEKKARKLAEEVKKLADDTRRKAEEARR

SEQ ID NO: 18321 - protein, 59 aa, Artificial Sequence
  Synthetic
DEVEKAKEESRRTLKKIEDRVRKVAEDLKKNLEDIERRVREVLEELRRLLEEIEEVVRR

SEQ ID NO: 18322 - protein, 55 aa, Artificial Sequence
  Synthetic
EELERLVEKTEDKIRKLLEEIKELLKETEKKIRKLLKRIEELMKEIEDKIDEDKK

SEQ ID NO: 18323 - protein, 59 aa, Artificial Sequence
  Synthetic
DEVERVKEELKRNLKEIREDVERVKEESRDTVRKATEIVKRVLEELKKSLEEIKKLVDD

SEQ ID NO: 18324 - protein, 55 aa, Artificial Sequence
  Synthetic
EELRDTLRKSAEDIERLLREIEDLVRKTTEDAKRLADEVRRLVKESERTIKERAD

SEQ ID NO: 18325 - protein, 59 aa, Artificial Sequence
  Synthetic
SEVEKVDRELKDNLRRIEEEVRKVDEELRRLLEEIRRTVEEFKERSKRTVEEIEKVARE

SEQ ID NO: 18326 - protein, 55 aa, Artificial Sequence
  Synthetic
EELRRTLEESERRIRKLLEDLKRLLEEIEKDIRRLEEEVDKLVRDTEKRIDDLRR

SEQ ID NO: 18327 - protein, 60 aa, Artificial Sequence
  Synthetic
SLEDELRRRITEAEKRIRDLLRRVRELVERSKKTIKDLLRKLEETARETKDEIRKLEEEV

SEQ ID NO: 18328 - protein, 59 aa, Artificial Sequence
  Synthetic
EEKVRRVEREIKEILKKIEEDVTRLLEENKKILKEVEDLVRELEKEDRDVLKKVRDDVK

SEQ ID NO: 18329 - protein, 60 aa, Artificial Sequence
  Synthetic
DLRERLEEEIERARRDIEDLLRKAEELAKRSKDDIKRLMDEVRRLVEKTRRDIEKLLREV

SEQ ID NO: 18330 - protein, 59 aa, Artificial Sequence
  Synthetic
EEKVRKVEEEIRRVLEKIRRDARKLLEENKRITDEVRKRVKELLEENRKVLKRIKDEVD

SEQ ID NO: 18331 - protein, 60 aa, Artificial Sequence
  Synthetic
KLREELEKLAEEAKKRIEDLAREAREAAKRASESNKDLARRLRELAKRTEDEIKRLLDDA

SEQ ID NO: 18332 - protein, 59 aa, Artificial Sequence
  Synthetic
EEAARKAAEEIKKILEEAERLAREALKELERSNEESERLARRAAEEDKRVADEARERAR

SEQ ID NO: 18333 - protein, 60 aa, Artificial Sequence
  Synthetic
SLREELRKKIEEAKKRIEKLMDDVRKEAEKAKRSNEELLRRLRKLAKETKRRIEELLERV

SEQ ID NO: 18334 - protein, 59 aa, Artificial Sequence
  Synthetic
EEKVRRLLKEIEEILRRIEDKVRKLLKELRDSNRDSKRLVDELMRRDKEVLRRIEEEVK

SEQ ID NO: 18335 - protein, 60 aa, Artificial Sequence
  Synthetic
DLERELEELIKKAEKKIRDLRKEVEDVVRDASRSNKELLREAEKLAEETRKRIDDLRKEV

SEQ ID NO: 18336 - protein, 59 aa, Artificial Sequence
  Synthetic
EEKVRELEKRIRDVLRRIEEEVRRLLKRLKDSNDDSRRRLEELLRRDKKVLEDIERETK

SEQ ID NO: 18337 - protein, 60 aa, Artificial Sequence
  Synthetic
SLREELERLIKEAEEKIRRLLKEVKDLVRELSRTNKKLLKEVRDLAKRTKERIKRLLDEL

SEQ ID NO: 18338 - protein, 59 aa, Artificial Sequence
  Synthetic
EDKVRKLLEDIERLLREIERLVRELLEELKDSNRRSEELVRRLLKEDKDVLEKAERDVR

SEQ ID NO: 18339 - protein, 57 aa, Artificial Sequence
  Synthetic
DEEEELRRLVRRLMEEVKRLLEENKKLADELRKTVKKLLEDNEDLARRLREEVERKV

SEQ ID NO: 18340 - protein, 56 aa, Artificial Sequence
  Synthetic
VEEVKKELEELLREVEELSRRSLKELKELLERVKKRSEESLKELEDLLREAERKSR

SEQ ID NO: 18341 - protein, 57 aa, Artificial Sequence
  Synthetic
SEKEELKKEVDRLAEEVERLLRENEKRARDLERKIRKLLEENRRAADEVRKEVDRTV

SEQ ID NO: 18342 - protein, 56 aa, Artificial Sequence
  Synthetic
VEEVKKRLEDLLEEVKELSKRSEDTLRKLAEDVKRLAEDSNKKLEDLLEEAKERAR

SEQ ID NO: 18343 - protein, 57 aa, Artificial Sequence
  Synthetic
SEKEELRDLVRRAKEDVDRLRRENEELNRRIEEDIERLLKENEDRNREVKDDIDKRV

SEQ ID NO: 18344 - protein, 56 aa, Artificial Sequence
  Synthetic
VEEVKKELEELLRRVRKLSEDSLKHLRELLKEVRELSERSLRHLDELLRRVREKAR

SEQ ID NO: 18345 - protein, 57 aa, Artificial Sequence
  Synthetic
KDEEDAERRARESDKSIEELRERNEREAKRLKEEVEKLLEENEKKVDELRKRVEKTV

SEQ ID NO: 18346 - protein, 56 aa, Artificial Sequence
  Synthetic
MEEVKEELDRLNKEAEELSRRSLRKLEELLREARRLSRESKERLKKLLEDARRKSN

SEQ ID NO: 18347 - protein, 57 aa, Artificial Sequence
  Synthetic
SDEERAREEARRSKESIERLLEENRRLAKELKKEIRRLLKENEDLVRKLKEDVDREV

SEQ ID NO: 18348 - protein, 56 aa, Artificial Sequence
  Synthetic
IEEVLEELDRLNKEVEELSRRSLKRLEELLEEVRKLSEDSLRKLKELLDRVREKSR

SEQ ID NO: 18349 - protein, 60 aa, Artificial Sequence
  Synthetic
DERERLRKALEEVRRTVEKLVRENEELLKKVEERVRRLNDEDRRLVEEIKRRADELRKRG

SEQ ID NO: 18350 - protein, 59 aa, Artificial Sequence
  Synthetic
DEVIRRVEDELRKVLEDIKRLSDKNKRDLEEALRDIERLVKENNKRLKEALDDLERAAT

SEQ ID NO: 18351 - protein, 59 aa, Artificial Sequence
  Synthetic
SEREDLKRELDEVRKDVARLNEEDRRLLEDARRDLEKLVRDNEELVERVKKTLKELEDR

SEQ ID NO: 18352 - protein, 59 aa, Artificial Sequence
  Synthetic
DEVIRRVRDRLRRVDEELKELVKRNNERLREVLERIRKLSRDNSERLKAALEKIKEEVR

SEQ ID NO: 18353 - protein, 60 aa, Artificial Sequence
  Synthetic
SLKEKIEKLLEESRKDIEELNERDKKRVKESEDTVRRLNEEDEELVKRVREELEKLRKEG

SEQ ID NO: 18354 - protein, 59 aa, Artificial Sequence
  Synthetic
EEVIKEVEKRLRDVTKTSREKVRENNRRLEEMTEDTKRLVEENNKDLDKALKDIRKKAE

SEQ ID NO: 18355 - protein, 60 aa, Artificial Sequence
  Synthetic
KEREELEKLLEEVERDVARLNKEDKDLVDEIRRRVDELVKRDKELLDRVRDRLRELSERG

SEQ ID NO: 18356 - protein, 59 aa, Artificial Sequence
  Synthetic
SRVIEKVKRDLRRVLEELRRLAEENNRRLDKALKELEDLVRKNNKKVEDALRKIEEEVR

SEQ ID NO: 18357 - protein, 60 aa, Artificial Sequence
  Synthetic
ELAEDLRRLLKEVEDRSRDLLRKNRKLLEEVRERTERLIKELEDLLEEITRRVKDLIRKI

SEQ ID NO: 18358 - protein, 59 aa, Artificial Sequence
  Synthetic
EELVRRVKEEIKRLMEEDKKLNKKSVEEIRELLKRDRDLIEEVKKEAERLLKEIEDEVR

SEQ ID NO: 18359 - protein, 60 aa, Artificial Sequence
  Synthetic
DLERELEKLLDEVRRRVEELNKRNEDLARKVAEDTKELLKELRELLEEVKRRVRDLIRKI

SEQ ID NO: 18360 - protein, 59 aa, Artificial Sequence
  Synthetic
REVAERVKEEIRRLLKEIEELNKRSEERIKKLLEDDRRLIERVKERIEDLLRRIEERTR

SEQ ID NO: 18361 - protein, 57 aa, Artificial Sequence
  Synthetic
DEVDELLKRLEDSSRKAEEDVKRMLERLEDSTRDAARRVKEMIKRNEEVSDEAEKRI

SEQ ID NO: 18362 - protein, 59 aa, Artificial Sequence
  Synthetic
DKVVKEIDDLLRESERRNRELLREIEELLKESERINRELLKEVDKVLRDSEERVERRRE

SEQ ID NO: 18363 - protein, 60 aa, Artificial Sequence
  Synthetic
DLERRLDKILRDIEEAARDNIRRNEELLKRSEENVRRNLEENKKKLEEIKREVEELERRV

SEQ ID NO: 18364 - protein, 59 aa, Artificial Sequence
  Synthetic
EELAKRAEERLRELLKELHEISKKMLREIKRVNDEINKVSKESLDELDELVKEIKERTR

SEQ ID NO: 18365 - protein, 60 aa, Artificial Sequence
  Synthetic
SLEEELRKMLEKVERDVRRNIERNKRLLDRSRENVKENIKKNRELLKEIEKDVRKLETDV

SEQ ID NO: 18366 - protein, 59 aa, Artificial Sequence
  Synthetic
EKLAEDAKRRLEELVREIHKISEDALEEIKRVNKEINDVSKEMLDRLRELLKEIKERTR

SEQ ID NO: 18367 - protein, 60 aa, Artificial Sequence
  Synthetic
SLEEELEKLLDEVRKEVKKNIDENKRLLDKSREEVRKNIKTNEDLLRRIEEKVRRLLEEV

SEQ ID NO: 18368 - protein, 59 aa, Artificial Sequence
  Synthetic
EELAERAKRELKKLEEEIHRISREALERSKKTVEELHEISKRMLDELKRVDKRLEDETR

SEQ ID NO: 18369 - protein, 60 aa, Artificial Sequence
  Synthetic
DQREDLDRRLREIEERVEENLRTNEELLKEVEKNAKENIDRNRKTLEDIKRRVDDLRRRV

SEQ ID NO: 18370 - protein, 59 aa, Artificial Sequence
  Synthetic
DELVERVKDELRKLVKEIHDVSKKALEDLERLLRELNEISERALRTLEKLLRKLEEDTR

SEQ ID NO: 18371 - protein, 60 aa, Artificial Sequence
  Synthetic
SLEETLKRILDKVREEAKRNIKENEDLMRESRRNVEENIRRNEKTLEDIEEEVRRLREEV

SEQ ID NO: 18372 - protein, 59 aa, Artificial Sequence
  Synthetic
EELAKRVKEELDKIVRRVHEISRRALEESRKTVEELNRESEKVLRELERLLRRLEEEVR

SEQ ID NO: 18373 - protein, 60 aa, Artificial Sequence
  Synthetic
SDEDDLRRILEEIRRNVERNIRENERLLDEIKKRVDENIKTNKKTLEDIREEVRKLEEEV

SEQ ID NO: 18374 - protein, 59 aa, Artificial Sequence
  Synthetic
RELVKRVEDTLRDLLRKLNEISKRALEELKRAVERIHRISRDALRELDRLRKELEERTR

SEQ ID NO: 18375 - protein, 60 aa, Artificial Sequence
  Synthetic
DDEERLDKILRDIEENARRNIERNRTLLERSRENVKRNIDENRRKLEEIRRDVEDLKRKV

SEQ ID NO: 18376 - protein, 59 aa, Artificial Sequence
  Synthetic
KELVKRAEDELRRLLKELNEISERMLRRSEETVRRLNEVSERALRELDRLRKKIERRTR

SEQ ID NO: 18377 - protein, 60 aa, Artificial Sequence
  Synthetic
SLEETIRRILEESERNVKRNIDENRKLLKEIRDNAKRNIDENRRLLEEIERTVRDLERRV

SEQ ID NO: 18378 - protein, 59 aa, Artificial Sequence
  Synthetic
EKLAEDVLRELDKANKDINEISKKMLEDLKKAVEDVNRVSKEMLERLKRLREEIEKRTR

SEQ ID NO: 18379 - protein, 60 aa, Artificial Sequence
  Synthetic
KDEERLDEILDRSRRNAETNIKRNKDLLDESRENVKENIKKNEDLARRIRERVEDLERKV

SEQ ID NO: 18380 - protein, 59 aa, Artificial Sequence
  Synthetic
EELVKRVEDELRRLNEEVNKISEEMLKRSKDTVRELNKVSEDALRKLDELRERIERRTT

SEQ ID NO: 18381 - protein, 60 aa, Artificial Sequence
  Synthetic
SLEEDLRRILKEIRDNVRENIRTNEELLKRSRENVKENIERNKKLLREIEEEVRRLEREV

SEQ ID NO: 18382 - protein, 59 aa, Artificial Sequence
  Synthetic
EKLAKEVKDRLRDLLRKLNKISEDALRELKRLNDEINRISEEALERLKKLLEDLERRVR

SEQ ID NO: 18383 - protein, 60 aa, Artificial Sequence
  Synthetic
SLEEKLRKILEESRENVERNIRRNEDILRKSRRNVEENIKTLEKILEDIKRTVDKLKKDV

SEQ ID NO: 18384 - protein, 59 aa, Artificial Sequence
  Synthetic
EELARKVERELREMNKELNRISEEALKRIEEVNRDINRVSKEVIEELERLVEKIREDVR

SEQ ID NO: 18385 - protein, 60 aa, Artificial Sequence
  Synthetic
DLERELRKAAKESRENAEKNKEDNKEAAKRSKENAEKNIRDNEETARKIEEDARKLEKDA

SEQ ID NO: 18386 - protein, 59 aa, Artificial Sequence
  Synthetic
EDLARKALRDLREANKRANEISKKALDEIRKANEDANRASKKANDDLRRLAEKAKRDAE

SEQ ID NO: 18387 - protein, 60 aa, Artificial Sequence
  Synthetic
DLERELRELLERVRKDVRDNLETNKKLLEESRKNAEDNLRENDRLLKELEKRVKDLLDEL

SEQ ID NO: 18388 - protein, 59 aa, Artificial Sequence
  Synthetic
EEVVKRVLDDIKRIVDEINRISKEMLDKLKRINDEANKISKRMLDELRRIAEEIEREVR

SEQ ID NO: 18389 - protein, 60 aa, Artificial Sequence
  Synthetic
DLEERIKKLLEESRKNVEDNEKKNKDSLRRSREEVKRLSDENEKLLKRIRERAEKLKTDL

SEQ ID NO: 18390 - protein, 59 aa, Artificial Sequence
  Synthetic
KRVVETVLRELERINEEINDISRKMLKENEKILRDIKKINEDMLKRLKEALERVDREVN

SEQ ID NO: 18391 - protein, 60 aa, Artificial Sequence
  Synthetic
SLEEEIRDILRRAEERVKELTKENERSLRESKKRVEDLSRENEKTLEEIKRDVDRLLKEL

SEQ ID NO: 18392 - protein, 59 aa, Artificial Sequence
  Synthetic
EDVVREMLKDLERIVREISEDNARTLEENERILREIEEENKKTLERLREILKRIREEVT

SEQ ID NO: 18393 - protein, 60 aa, Artificial Sequence
  Synthetic
SLEEEIRKILKRIREEVKRLTEENDKTLKDSERNVRENLTEIERILREAADDVRRLEEEL

SEQ ID NO: 18394 - protein, 59 aa, Artificial Sequence
  Synthetic
EEVVERVLRELERLLEEIRDRNKKTLDDLRRINEEVNRISKDALEELRRLLRELRELVK

SEQ ID NO: 18395 - protein, 60 aa, Artificial Sequence
  Synthetic
SLEDEIRKILDELRKNVRENLEDNKRVLREAEEEAKKLSEDNRRLLKELKERVKELKDRL

SEQ ID NO: 18396 - protein, 59 aa, Artificial Sequence
  Synthetic
EEVVRRALEEIERINRDINRRSKEVLDELREIVREAKEDNERTLRKLKKILEEIEEKVR

SEQ ID NO: 18397 - protein, 60 aa, Artificial Sequence
  Synthetic
RLKEELERILREAEKNVRENLRRNRESLKESKETVDRLSEENKKTLEEVRTTVEELLKEL

SEQ ID NO: 18398 - protein, 59 aa, Artificial Sequence
  Synthetic
EEVVRDALRKLEEINRRINEISERMLKENKRLLEEIKRINKETLDRLKELLEEIKEDVR

SEQ ID NO: 18399 - protein, 59 aa, Artificial Sequence
  Synthetic
SDVERVEKELKKTNDELRKIVDEARKLLEKTNKEIRDINRTMMEELRRTNEDLKRVVER

SEQ ID NO: 18400 - protein, 59 aa, Artificial Sequence
  Synthetic
RRVIERIREIARKNEEDVKKLLKELKDLLEKNKRDVEKASEENKKLLEDNERDVRREST

SEQ ID NO: 18401 - protein, 59 aa, Artificial Sequence
  Synthetic
KEAEEAAKLLEDTNRRLKEIAEEAEELLRRTNEKAKKINDESREKIKDAARRAEDAARR

SEQ ID NO: 18402 - protein, 59 aa, Artificial Sequence
  Synthetic
EKAIREIKELAKKNKEDAERALERIKRLADKNREDAKRADEDNERAAEEARRKAEELKR

SEQ ID NO: 18403 - protein, 59 aa, Artificial Sequence
  Synthetic
DEAEDVERKLEATNKELNEINERSRKELETSNRELNRINTESEEEIRRIEERIDRVKKR

SEQ ID NO: 18404 - protein, 59 aa, Artificial Sequence
  Synthetic
KELIERIKRLLDKNREDVKRMNEDNKRLLKENRDDVKRMDEKNKKILDEVDEKAKEKEK

SEQ ID NO: 18405 - protein, 60 aa, Artificial Sequence
  Synthetic
SEEEELKKLLDRVRERVERSLDEIRRLAREVEEHVKKVNDDIRRLLDEIRREVEDIERRV

SEQ ID NO: 18406 - protein, 55 aa, Artificial Sequence
  Synthetic
DEVRELVRTLEERIDDSTREVKKLIEDLKRENKRILDTVRDLVRRLREKIKRIAD

SEQ ID NO: 18407 - protein, 60 aa, Artificial Sequence
  Synthetic
DEEERLAELLERVKRDVDRSLKRIRDLLKELEKHAKEVNDDIRRLLEEVERRVREMEKRV

SEQ ID NO: 18408 - protein, 55 aa, Artificial Sequence
  Synthetic
REVEELIRRMLKRIRDSTKKVEDELRRILEENRRILEEVRREIDELKKAIDEISR

SEQ ID NO: 18409 - protein, 60 aa, Artificial Sequence
  Synthetic
SEEERLEELLRRIEKHSRELIRELEKSLEDSEREVRKSLKRIEELLRRAERKVREIRKRV

SEQ ID NO: 18410 - protein, 55 aa, Artificial Sequence
  Synthetic
REVKKVLDDLLKRDRDAIDEARKLNEEMLKRIEDSSREVEKLLADMEKTIEDIEK

SEQ ID NO: 18411 - protein, 60 aa, Artificial Sequence
  Synthetic
SIDDKARKDLKRILDENRDIVRRVEELIRRSDELLKRILDDVKRRIDELRKKLEDIARKV

SEQ ID NO: 18412 - protein, 59 aa, Artificial Sequence
  Synthetic
EDVLRDIDRLLKEIKKHAEDSLRKIEKLLRESEEKVKDILRKIKKLLDEARKEVEDRRR

SEQ ID NO: 18413 - protein, 60 aa, Artificial Sequence
  Synthetic
SIAEEVEELIRRLETKNRKIVKDVEDAIRASDDKNRRVLDKVRKDVERLKRELDRIAKEV

SEQ ID NO: 18414 - protein, 59 aa, Artificial Sequence
  Synthetic
KEVLDRIKELLKKLEKHVKDSLDKIDDLLRKSEKHVRESLETIKRLLEELEREVERLAR

SEQ ID NO: 18415 - protein, 60 aa, Artificial Sequence
  Synthetic
DEKREVERLIRELIEENRDIVRRVEKLVRESNKKLDEILEEIRERLERLREKLKDIKRRV

SEQ ID NO: 18416 - protein, 59 aa, Artificial Sequence
  Synthetic
EEVLRRIRELLERVEKHVRDSLRRIDELLKRSEERVRRIIREVRERLKRLEEEVREAKR

SEQ ID NO: 18417 - protein, 60 aa, Artificial Sequence
  Synthetic
SISEDAERLVRELLRKNKEIRDRVEELVRRSNDKNRRVLEEVEKRLRDIIRKLEDIERRV

SEQ ID NO: 18418 - protein, 59 aa, Artificial Sequence
  Synthetic
EEVLRRIRDLLRRVTEHVEKSKRDIEKLLRESRDHVRRSKEKIKRLLDEARERVERSKK

SEQ ID NO: 18419 - protein, 60 aa, Artificial Sequence
  Synthetic
DEEDKLRKLLEEAREAVKRALERVDKLLRDSEREVRRILEEVKKLLDESRKAVEDIRRKA

SEQ ID NO: 18420 - protein, 56 aa, Artificial Sequence
  Synthetic
SEEAEELIRRVIRKAEKLLREVEELLRRSNDKLRKLTEKVRTDLERSKKRLEDEAR

SEQ ID NO: 18421 - protein, 60 aa, Artificial Sequence
  Synthetic
SILEKVRELLERIRDTVRKILREIEKSLEDNKRHSDEVLKEIEDLLRDLERRVKEIEERI

SEQ ID NO: 18422 - protein, 59 aa, Artificial Sequence
  Synthetic
EEILEEIERLIREVRRRLKKILDDVRELSRRANEKDRKSLEEVRKLVEDVRRELERVAT

SEQ ID NO: 18423 - protein, 60 aa, Artificial Sequence
  Synthetic
DVEEEVKKLLEDLERHSRKVLEEIKKLLKELEDHNRKTVEDIEELLRELEKEVRKLEEDV

SEQ ID NO: 18424 - protein, 59 aa, Artificial Sequence
  Synthetic
EEILEEIRRLAEELEKEDRKTLKEARDLAREVKKRNEEIKRRVEELIKKVDRELKEVAR

SEQ ID NO: 18425 - protein, 60 aa, Artificial Sequence
  Synthetic
DEDEDVRRLLRRLREKVRRVKKKIDDSLRENRKKVRKTNEEVKKLLEDNRRRIEDVKRKR

SEQ ID NO: 18426 - protein, 56 aa, Artificial Sequence
  Synthetic
SEEARKLMRELEKELKEIEDEVDKMSEEINRKNDEILRRARELIKRNNELLEEIRR

SEQ ID NO: 18427 - protein, 60 aa, Artificial Sequence
  Synthetic
SEEEEVRKLLERLERTVEKTNRDVERSLRENEKRVRETNDEVRRLLEENRRRIEDVERKL

SEQ ID NO: 18428 - protein, 56 aa, Artificial Sequence
  Synthetic
SEEAKRLIEELEKRNREVKKEVEEMSRRINKKNEEILREARKLIEENNKLLKDIER

SEQ ID NO: 18429 - protein, 60 aa, Artificial Sequence
  Synthetic
SELDEIAKAIRRLLEEVRRKNERIDEDIRRLLDELREHSEKVLREIEELLRRLEDAVRKR

SEQ ID NO: 18430 - protein, 59 aa, Artificial Sequence
  Synthetic
KDARKRAKDVLRDLEKKVEDLKRRNDKTLTDAKRELDDSRRRVKRVLDELEKVLRDLKR

SEQ ID NO: 18431 - protein, 60 aa, Artificial Sequence
  Synthetic
DEAERILEEVKKLLEEVERLNKKIDDEARRLLREVERENEEIDRDIKRLLDEVRKDVERN

SEQ ID NO: 18432 - protein, 59 aa, Artificial Sequence
  Synthetic
EEVRRRAEEVLRELEKVVEDSRRRNEKTLRDMERRIKELEDRNRDTLRKLREVVKELER

SEQ ID NO: 18433 - protein, 55 aa, Artificial Sequence
  Synthetic
SEEERVRELIERMREMLERLEESNKKVLEEIERVLEKSERDVERVIREIERTLEE

SEQ ID NO: 18434 - protein, 56 aa, Artificial Sequence
  Synthetic
TDRVIREAERVLEEVRRRNEKVNKEARDLLKEVEKHSRDVLEDIKRLLEEIRERAR

SEQ ID NO: 18435 - protein, 56 aa, Artificial Sequence
  Synthetic
SEKERIEDVIRRIEKVLKESRDEADRVKKEIEKRLRELEKRHKEVTTEVKRVAEEV

SEQ ID NO: 18436 - protein, 56 aa, Artificial Sequence
  Synthetic
SETVLREAEELLRRVKKHSKEVLDRVRELLKRVEEKSERVLRELERVLREIREKAR

SEQ ID NO: 18437 - protein, 55 aa, Artificial Sequence
  Synthetic
KDEERIEELLRRNEENLRRLEDSNRKVLRENEEILKELKRRHEKITEDLKRELEK

SEQ ID NO: 18438 - protein, 56 aa, Artificial Sequence
  Synthetic
TDTVLREATELSKEVHKENRRVNEEAKDLSRRVAEESDRILRELKKLLDEIRKRAK

SEQ ID NO: 18439 - protein, 55 aa, Artificial Sequence
  Synthetic
SDEERIRRVIEDIERKLRELEKRHKEVTRENKENAKELKERHDRVTKDIKKTLDD

SEQ ID NO: 18440 - protein, 56 aa, Artificial Sequence
  Synthetic
TDRVLEEIKKLLREVEERSDRALREAKKLSKRVHERSKEVIDRLRELLREIKREAD

SEQ ID NO: 18441 - protein, 59 aa, Artificial Sequence
  Synthetic
DSAREMERRIRELLKRVEDKSEKALRDSKKLTKEVEEESERALRRTEKLLREVAELARR

SEQ ID NO: 18442 - protein, 56 aa, Artificial Sequence
  Synthetic
EKRVRDVLREIEEVLRRLEERHERLTRDDERVLRELEDRHRKLSERVKKLLEELKK

SEQ ID NO: 18443 - protein, 59 aa, Artificial Sequence
  Synthetic
DRAEKAEREIRRLLERVKEDSERVLRESEELTRRVEEESRKILEETKKLTRTLEELSRT

SEQ ID NO: 18444 - protein, 56 aa, Artificial Sequence
  Synthetic
EERVKRVLEEIERLLRELEERHKRLTERDKEVVKRLADRHREVSEEDRRVLEELKR

SEQ ID NO: 18445 - protein, 59 aa, Artificial Sequence
  Synthetic
DEMEEVIRRIETLLKRVVDESDKVLEDIKRLLDRVVEESEKALETTRKLLEEVAELART

SEQ ID NO: 18446 - protein, 56 aa, Artificial Sequence
  Synthetic
EDEVRRVLERVKKVLDELAERHKELSKEIKRELRRLEKEHEDLSEEVKRLLRELER

SEQ ID NO: 18447 - protein, 59 aa, Artificial Sequence
  Synthetic
DEMREAEEEIKRLLDTVKTESDRVLEEARKLTRRVEEESERVLRETKKLTDELRKLSRK

SEQ ID NO: 18448 - protein, 56 aa, Artificial Sequence
  Synthetic
EERVRRVLKEIREVLDRLEKRHKKVSKDDKEVLERLEKEHKRLSREDEEVLRELER

SEQ ID NO: 18449 - protein, 59 aa, Artificial Sequence
  Synthetic
SRMEKVEREIRTLLKEVEERSRKVLDESRKLTEDVERISRDALKKIKELLEEVRDLART

SEQ ID NO: 18450 - protein, 56 aa, Artificial Sequence
  Synthetic
EKDVRRVLREIEELLKDLERKHKELTRRDEEVLKKLEDDHRRVSEEIEEVLRRLEK

SEQ ID NO: 18451 - protein, 59 aa, Artificial Sequence
  Synthetic
SRAERVKEEIKKLLEEVRKESKRVLKEVKDLTKEVDDKSKKVMRDIRELLKEVEELART

SEQ ID NO: 18452 - protein, 56 aa, Artificial Sequence
  Synthetic
AEEVKKVLREIEETLRKLEEEHRRLSDRDREKLDELAKRHKKVSRDIEEKLKELER

SEQ ID NO: 18453 - protein, 57 aa, Artificial Sequence
  Synthetic
KEVEDVLDKVKKALEEIRERNKRVNDEIRRLLDEVRRRNEDADREIEEILKRVADEV

SEQ ID NO: 18454 - protein, 59 aa, Artificial Sequence
  Synthetic
EELRERIKAVVEEVERVMDELRRSNEKVVREVEDVMRRLEERNRRTLERIEEVLERLKR

SEQ ID NO: 18455 - protein, 61 aa, Artificial Sequence
  Synthetic
EEVERLLTKVRELVRRIEEENKKANDDSRKSLKEIKDRVEKALDDSRKSLEEIEKIVRRDN

SEQ ID NO: 18456 - protein, 59 aa, Artificial Sequence
  Synthetic
EELKRRIETVIKEVRETIEELKKSNEESVRDSERTIRELEEEIKRTVRESEKEIKRLED

SEQ ID NO: 18457 - protein, 59 aa, Artificial Sequence
  Synthetic
EEVERMADEVRRLNEEVRRRNEESIEEVKRLNDEIRKTNEKSIEDVKELLKRVKEVRER

SEQ ID NO: 18458 - protein, 58 aa, Artificial Sequence
  Synthetic
DAREKMKRLVEENTKSVEELKKRNEETSRRNTKSVREVTRRNEKTSDDVRRLVREEEQ

SEQ ID NO: 18459 - protein, 59 aa, Artificial Sequence
  Synthetic
DEVEEAKEKVRRLNKELRRVVKEVEDEVRRLNEEVRREVEKVRDDVRKLRETIREVKAR

SEQ ID NO: 18460 - protein, 58 aa, Artificial Sequence
  Synthetic
SLEREIEKISRENTKSLRDLLDRLRRLVEENTKSVEELVRRLEELLERVEEEMRRLET

SEQ ID NO: 18461 - protein, 60 aa, Artificial Sequence
  Synthetic
SRVETMVKDIRRLLEEVKERVERALRDNERVLEDIRRRVDELLKTNEKINRDIERRVRRG

SEQ ID NO: 18462 - protein, 55 aa, Artificial Sequence
  Synthetic
EEIKEVLRRVEEEAERLKREIEESLKRSEDLVRKLKERIKRSLEESRKRIKKLED

SEQ ID NO: 18463 - protein, 59 aa, Artificial Sequence
  Synthetic
SEVEEAVKRIRKIVKEIEERVRRLLEENRRVIEEVERINKEMLKRNKEINKEVEELVRR

SEQ ID NO: 18464 - protein, 55 aa, Artificial Sequence
  Synthetic
KEIEDILRRAEETVEDLKRRIRRSLEDSRRVVEELAEENRKSLRESKKKVDELKK

SEQ ID NO: 18465 - protein, 59 aa, Artificial Sequence
  Synthetic
SRVEDFVRRIRDLLRKIEEIARKALKENKDVLREIKRINDEMLRRNEEILKRAEDLVRE

SEQ ID NO: 18466 - protein, 55 aa, Artificial Sequence
  Synthetic
EEIKRILEEAKKTIDELRKEIEKSLREVEKAIRELEERNRRSLERSEDLVRELKR

SEQ ID NO: 18467 - protein, 59 aa, Artificial Sequence
  Synthetic
RRVEEAVKRIKEILERVTRRVEKVLRDNKRVLDDIRRINEEMLKRNKEINRKVEELVRE

SEQ ID NO: 18468 - protein, 55 aa, Artificial Sequence
  Synthetic
EKIKEILEEVRRTIEELKERIRKSLEEVKELIKRMDEENRKSLEESDERARRAEK

SEQ ID NO: 18469 - protein, 59 aa, Artificial Sequence
  Synthetic
SELEEIRERVKRVEEELRKNLKDAERRVREAKRRSEESLKDIEKKVKEVRDELKELARR

SEQ ID NO: 18470 - protein, 58 aa, Artificial Sequence
  Synthetic
SAREDIKRLLKELEELLKRSEDEARRLLKEVRDLVDTTKKRIDKLLKEIEDLLREIER

SEQ ID NO: 18471 - protein, 60 aa, Artificial Sequence
  Synthetic
KIEEKVEKLVRELLKELETVDREVNERVKRSNEKLEKIDRDVNKLVEDSNRKLKEISDRV

SEQ ID NO: 18472 - protein, 55 aa, Artificial Sequence
  Synthetic
EKIKRLLEEVKKLVEDSERNIRELLKESRKKVEDSKRNLDRLLKESDDRVDRERR

SEQ ID NO: 18473 - protein, 60 aa, Artificial Sequence
  Synthetic
ETEKEVEELVKRVLDKDKRISDESEERIRRLMEKNKKILEDVKRLVDEVREKLEDIRRRV

SEQ ID NO: 18474 - protein, 55 aa, Artificial Sequence
  Synthetic
EKIKKLLEDVRRLIKRSKEKNDELLEELKRLSEETRETLDRLLKDLEDKIREAKK

SEQ ID NO: 18475 - protein, 59 aa, Artificial Sequence
  Synthetic
DEKEDVDRLLRELEELVERSERSIRKLLEDNRKLAEDLKRTVEKLLEDNRRKVEEVRRT

SEQ ID NO: 18476 - protein, 56 aa, Artificial Sequence
  Synthetic
SEELRKLIKRVLKKLRDLNRRVKELSRRSAEELKRLLDEVRKLSEDSLRELDKLRK

SEQ ID NO: 18477 - protein, 59 aa, Artificial Sequence
  Synthetic
DEEKRVRDLLEEVREEVERSDKSIEELLRELEKAVKDSERTIRKLLEDNERMVREVRRK

SEQ ID NO: 18478 - protein, 56 aa, Artificial Sequence
  Synthetic
SKEAEDLIREILEELKRLNEDVKRLIREVLETLKELNERVKKLVKESNDELRELAR

SEQ ID NO: 18479 - protein, 59 aa, Artificial Sequence
  Synthetic
REEEKLDKLRKDLEKRVEESKRSIDKLLEDNRRRVEESKKTIEKLLEDNKRRVDEIKKR

SEQ ID NO: 18480 - protein, 56 aa, Artificial Sequence
  Synthetic
SDEAEKLIRDVKKELDRLNEEVKKLSEDSLKELDDLNREVKELMERSNRKLDEDAK

SEQ ID NO: 18481 - protein, 59 aa, Artificial Sequence
  Synthetic
KEVEDVLREIKKLIKEIHEKSKRALDETRELLERIHRTTRRVLEEIRRLLKEVEELAKA

SEQ ID NO: 18482 - protein, 56 aa, Artificial Sequence
  Synthetic
KDRVEDLVRELERVVKEDKDRSKESEERIKKLVEDDTREAEKLIRELEKILEDTEK

SEQ ID NO: 18483 - protein, 59 aa, Artificial Sequence
  Synthetic
SEVEEVLRDIDRLAKEIHKRSRDVLRDIDRLLKEIHERSRRMLERIKRLLDEVRRLVEA

SEQ ID NO: 18484 - protein, 56 aa, Artificial Sequence
  Synthetic
RDRLRELVERLERLLETDKREIEKLIKKLEEMLEEDERRARELLEDIRRILEEIKK

SEQ ID NO: 18485 - protein, 59 aa, Artificial Sequence
  Synthetic
SEVEEVTKEIKRLVEEIHKRSREALEETRRLVETIHRDSKRVLDEIERLLEEVRKLAED

SEQ ID NO: 18486 - protein, 56 aa, Artificial Sequence
  Synthetic
EKRVRDLLEKLREDAKRDEDASRKSEEDIRKVVEEDKREAEKLLKRIEDELRKTEK

SEQ ID NO: 18487 - protein, 59 aa, Artificial Sequence
  Synthetic
SEVEKVLKDIRDLVKKIHDESKRVLDEIEELVRRINKRSRDALREIRELLRTVTELAKA

SEQ ID NO: 18488 - protein, 56 aa, Artificial Sequence
  Synthetic
KDRVRKLVEDLERMLRRDEAEAEKLIKKLRELLEKDRDDIRRLLEDIKRILDEIRK

SEQ ID NO: 18489 - protein, 59 aa, Artificial Sequence
  Synthetic
EEVERALDRARRLLERIHETSRDVLRRTEELLRRINEESRRVLKEAKELLDRVEKLVRD

SEQ ID NO: 18490 - protein, 56 aa, Artificial Sequence
  Synthetic
KDRVEKLERELEKVVREDEEESKKSIRRAEEMLRKDREDIRRLLEEIKKILEDIDK

SEQ ID NO: 18491 - protein, 59 aa, Artificial Sequence
  Synthetic
SEVEDVLRKAEELAKRIHDRSRKALKETEELLERINRDSERVLRESEKLLEDVRRLAEA

SEQ ID NO: 18492 - protein, 56 aa, Artificial Sequence
  Synthetic
EKTVRRLVDKLRRLVEEDTDESRKSEERIKKMVEDDKRESEKSLKRIKDIMKEITD

SEQ ID NO: 18493 - protein, 57 aa, Artificial Sequence
  Synthetic
SEVERVLEENERTLKRIEETAKKVLEEIEKLSKEVEDRAREVLDRVRRISEEVRRDV

SEQ ID NO: 18494 - protein, 59 aa, Artificial Sequence
  Synthetic
EEMRDRVRKLIKRNDEVLDRVRREIEKLHRRNKKILDDLRREIERLNRENKRLLDELRK

SEQ ID NO: 18495 - protein, 57 aa, Artificial Sequence
  Synthetic
SEVEEVLKRNEKTLKEIEERAREVEETVRELSERIRKRNEEVNRELEERSKRIRRDV

SEQ ID NO: 18496 - protein, 59 aa, Artificial Sequence
  Synthetic
KEARDRADELLKRNREVLERLRKRIEDLHRDNKRVLDELRRSNEETNRRNRKLLEELRK

SEQ ID NO: 18497 - protein, 57 aa, Artificial Sequence
  Synthetic
REVEEVLKENEKTLREIERRMEEVLKRVEDLSDEVRRRVDEVLRRVEETSKEIAKRV

SEQ ID NO: 18498 - protein, 59 aa, Artificial Sequence
  Synthetic
EEARKRAKDVLDRNRDVLRRLKDAIDKLNKRNKEILDRLRRKIEDLNRRNEELLRRLEK

SEQ ID NO: 18499 - protein, 57 aa, Artificial Sequence
  Synthetic
REVEEVLDKNRKTLREIRKRAKEVLDRVEELSRRVREENERVNRELRKISEEIARKV

SEQ ID NO: 18500 - protein, 59 aa, Artificial Sequence
  Synthetic
EEMKKEADKLLKENRDVLRELERRIEELNERNRRVLKELEESNRRTNEENKRLLDELRR

SEQ ID NO: 18501 - protein, 57 aa, Artificial Sequence
  Synthetic
DEVETVLDENRRTLKRIRERVDKVLKDVEKLSREVEDEIRRVLEEVEKELKDIERDV

SEQ ID NO: 18502 - protein, 59 aa, Artificial Sequence
  Synthetic
EDAREKAKRLLEENKRVLKELEERVKRLNDKNRRILERIKKRIEDLRRRVKELLKKLRK

SEQ ID NO: 18503 - protein, 57 aa, Artificial Sequence
  Synthetic
DEVERVLEENERTLRRVREIIREVLEEVRRLSEEVKRRIDEVLKENEDTLKKIKDEV

SEQ ID NO: 18504 - protein, 59 aa, Artificial Sequence
  Synthetic
KKARDRVREVEKRNRDVLEEVKDEIRKVNKDNRDILRRIKKDVEELLKRNEKVLRETEK

SEQ ID NO: 18505 - protein, 57 aa, Artificial Sequence
  Synthetic
RELEELLKRNERTLRELAKRVKRLLEENKETVRRIEERLRRVLTEVEKISRDIRDRV

SEQ ID NO: 18506 - protein, 59 aa, Artificial Sequence
  Synthetic
EEVRERVKKVEDENRKLLERAEREIKKVAEENRRLMEKMKDDVRKANKRNKELLERRTK

SEQ ID NO: 18507 - protein, 57 aa, Artificial Sequence
  Synthetic
SEVEKVLRENEKTLREIEREIDRVLRDNERTLKEVRERNEEVNRRVEEDSKRVKDEV

SEQ ID NO: 18508 - protein, 59 aa, Artificial Sequence
  Synthetic
EKARERIKRILDENRKVLREIERKIREVLERNKKVLEEVRKSNEETNDRNRKLLEELRR

SEQ ID NO: 18509 - protein, 60 aa, Artificial Sequence
  Synthetic
SVDERVEDLRRDVERVLRELRKSNEESIRRSEEIVTRLEEELKRNSKEVEEVLKRLEDEL

SEQ ID NO: 18510 - protein, 59 aa, Artificial Sequence
  Synthetic
SKDLEKALRDVEKLIREIRERNKEMLRRSEEILKEIEKRARDMSRESKRLIEDIERRTK

SEQ ID NO: 18511 - protein, 60 aa, Artificial Sequence
  Synthetic
SVEEKVDRLKRRVEEVLKELKKSNEDNTREVREALKRLKKAIEESIDRSRKILEDLRRKL

SEQ ID NO: 18512 - protein, 59 aa, Artificial Sequence
  Synthetic
DEDLERALKEVEELIRRIREENKEMSERSKKIIRKIEKDVKKALDDSERVLREIAERTK

SEQ ID NO: 18513 - protein, 60 aa, Artificial Sequence
  Synthetic
DVEKKVKELLDEVRDALRRLRKSNKDNTDEVDRALRELEETNKKSIEDSRRIVEDLKRKL

SEQ ID NO: 18514 - protein, 59 aa, Artificial Sequence
  Synthetic
DREADKVLKRVKEEIERIERENRRMSEKSERLIREIRKRNKEMLDRSKKLLEDIKRRVT

SEQ ID NO: 18515 - protein, 60 aa, Artificial Sequence
  Synthetic
KEVEEILTESEDMNRKIDKLVKEILDESEEMNRRIRELVKRIVEELRELLREIRRLAEER

SEQ ID NO: 18516 - protein, 59 aa, Artificial Sequence
  Synthetic
EEVRDRLRRSHEKNKEVLDRIRKRVKESHEKNEKSLREIEETVKKLERDVERLLREIKR

SEQ ID NO: 18517 - protein, 60 aa, Artificial Sequence
  Synthetic
EEVERILKESRDANERIKKLVEDILRRSKELNERIRDEVRKILAKSEEVNRRIRRLAKER

SEQ ID NO: 18518 - protein, 59 aa, Artificial Sequence
  Synthetic
EEVKEKAKESHKENKKVLDRIKRELEKSHEENKKSLDEIRDRVRRSHEKNRKVLEEIRK

SEQ ID NO: 18519 - protein, 60 aa, Artificial Sequence
  Synthetic
EEVERILKESEDMNRRIRDLVRRIAEESDKVNREIRKLVDEIRRKLDRVLREIEDLIRKR

SEQ ID NO: 18520 - protein, 59 aa, Artificial Sequence
  Synthetic
EEVKKRAEKSHRENEKSLREIRKELEELHRKNKKSLEEIRKTLRKLEEKVRKLLEDLRR

SEQ ID NO: 18521 - protein, 60 aa, Artificial Sequence
  Synthetic
SRVEEILRESKRMNDEIREKVKKILKTSRDMNKRIEDRVREILKKSEDLNRKIRKLIDDR

SEQ ID NO: 18522 - protein, 59 aa, Artificial Sequence
  Synthetic
EEAKRELEKSHKTNEKVLRDIERRVEDSNRENEDSLRKIERAVTESHRRNEEVLERLER

SEQ ID NO: 18523 - protein, 60 aa, Artificial Sequence
  Synthetic
EEVERILEESKRLNDEIRRKVDEILRKSEEINERVRRLVEKIRTDLERVLEEIRDLADKR

SEQ ID NO: 18524 - protein, 59 aa, Artificial Sequence
  Synthetic
EEVKRRLEESHKDNDRVLKEIERRVRESLRRNRESLRRIDEKVKELERRVEKLLREIKK

SEQ ID NO: 18525 - protein, 60 aa, Artificial Sequence
  Synthetic
EEVERILDESKKMNDDIRRKVKEILDESEKLNEDIRRLVKEILEKSKRVNDRIRKLAKDR

SEQ ID NO: 18526 - protein, 59 aa, Artificial Sequence
  Synthetic
DEVRRRAEKSVRENDKSLKEIEDEVRRSVEKNEESLKRIEDEVRKSHEKNKKVLDEIKK

SEQ ID NO: 18527 - protein, 61 aa, Artificial Sequence
  Synthetic
SKAEEVLKEIRERIERIRKRAEDVLRHDEESLKRAEEVNRKMEKESRRINEEIRDRVRKEG

SEQ ID NO: 18528 - protein, 56 aa, Artificial Sequence
  Synthetic
EKDVRKVEDDIRRVIKKLKEELDRSADKSRDVVRRLRDSNKKLNDKNRRDIEEIKK

SEQ ID NO: 18529 - protein, 61 aa, Artificial Sequence
  Synthetic
DSEEEVRERIRKIIEDVKRIIEEVLRRDDKILKEIEKRNRDMLKRSKEINKEARDRVREAG

SEQ ID NO: 18530 - protein, 56 aa, Artificial Sequence
  Synthetic
DRSVRELERRIKEVIDELRELVERSKRKVDKLLKDLTRSNEKVNRENREDLERLEK

SEQ ID NO: 18531 - protein, 59 aa, Artificial Sequence
  Synthetic
DDERRAKKAAEDAAKRLKEIAEKAHRISEKALEELKRINDDANKISEDALRRLEKLKKE

SEQ ID NO: 18532 - protein, 56 aa, Artificial Sequence
  Synthetic
SEEAKELAKKIKEIADEARKRAEDNARTNKEAAERSKENADRNAEENKKAAEKAKR

SEQ ID NO: 18533 - protein, 59 aa, Artificial Sequence
  Synthetic
KDEDEVRRRVEELLKRNKELVEEIHKLSEDALRDLERINEEVNRISDEMRRRLDKLKKD

SEQ ID NO: 18534 - protein, 56 aa, Artificial Sequence
  Synthetic
SEEAKKLKERVDRSLKESEKEVRENLERNRKLLDESRRNAEENLRENKRVLDELRR

SEQ ID NO: 18535 - protein, 59 aa, Artificial Sequence
  Synthetic
SEEDEVRERVKRVLDELRKINEDLNRISREMLERNKDILRRIHEISKRALDKLKKLKED

SEQ ID NO: 18536 - protein, 56 aa, Artificial Sequence
  Synthetic
SEEVRKLLEEVKDSLRKSEENARRNLDENRRSLKKSEDEVRRNLEENEDTLRKLEK

SEQ ID NO: 18537 - protein, 59 aa, Artificial Sequence
  Synthetic
DEMDEVRRTIKKLDKDSRDKVRTVEEKIRRLDEESRRENEEIVRKIEELLEEIERRVRS

SEQ ID NO: 18538 - protein, 56 aa, Artificial Sequence
  Synthetic
EKEVKKIKEESDESLKEIEKLLREIEEESKRSLREMEKTLEDIERRVRRVLEEIKR

SEQ ID NO: 18539 - protein, 60 aa, Artificial Sequence
  Synthetic
SIEELAKRNEEENEKAAEDVERLAEEVKERAERVARESEKLAREAEKEAERVAREIRRDR

SEQ ID NO: 18540 - protein, 59 aa, Artificial Sequence
  Synthetic
EEAAKRASEENRKAVRDAREKARRAAEEAKKLLDEARKHSEEAAKRAKELLEEAKKRAD

SEQ ID NO: 18541 - protein, 60 aa, Artificial Sequence
  Synthetic
KIEELMKRNEKENREVLERVKELADRNRRENEEVVKKSKKELDDLKRKIEEVLERIKRER

SEQ ID NO: 18542 - protein, 59 aa, Artificial Sequence
  Synthetic
EEVVEKVSRENKKLVADIEDEVRRASTRNKKLVKDIEKHSEDVVRELEKLLKDIKDKVD

SEQ ID NO: 18543 - protein, 60 aa, Artificial Sequence
  Synthetic
SIEDEARRNEKRNREVLKRSKDLLDEIARKIEEVEKRIRDLVKRVKEEIDEVLRRIKRER

SEQ ID NO: 18544 - protein, 59 aa, Artificial Sequence
  Synthetic
DELLRRVSKENEDLVREIEDHTRRVLETIERKLRRVEEKVETVVREIKRRLEDIERRVK

SEQ ID NO: 18545 - protein, 59 aa, Artificial Sequence
  Synthetic
EEVDRVIERIKRLLEEVERKIRRASEKNRRLIEKSRKELEKVSKENKDLIDRVRELRDA

SEQ ID NO: 18546 - protein, 55 aa, Artificial Sequence
  Synthetic
EKVKTVEKEIREVIERADEIIERNERENKKSVEEIEEILERNKRRNEEALREVDK

SEQ ID NO: 18547 - protein, 57 aa, Artificial Sequence
  Synthetic
DELDRAIEEVKRLLDEIRRRLEKVVREVRKLNEEIREDLRRVVEEVRRTNKEIRDRV

SEQ ID NO: 18548 - protein, 56 aa, Artificial Sequence
  Synthetic
SDKVRRLEREVEELLKTVEELIRRLEEHTRRVLKEVDEEIKRLKEHTEKVLRDVEK

SEQ ID NO: 18549 - protein, 59 aa, Artificial Sequence
  Synthetic
SAEELVKELERRIEELLKELEEIVRRNRKHSEDVLRKIKELVRDVLRRVKEALKDLTKK

SEQ ID NO: 18550 - protein, 59 aa, Artificial Sequence
  Synthetic
EDVVRKLIKEIDDRLKEVKKEVEKLSDENRRLNEDVERRIKELLDDIERLLKEIRDTVT

SEQ ID NO: 18551 - protein, 59 aa, Artificial Sequence
  Synthetic
DVEDIVRRIRERVKEALERLRKTNDDNRKHSEEVLRKLAESDKRTMERIERVLEELRRR

SEQ ID NO: 18552 - protein, 59 aa, Artificial Sequence
  Synthetic
KEVVREMKRKIEELLKRIEDENKRLSDENRELNKRVEEDNRRLNKEIEDELRKVEEDVK

SEQ ID NO: 18553 - protein, 59 aa, Artificial Sequence
  Synthetic
DLEELVKELEKRIEDVLRTLRKTNKDNEKAVEESLRKLEDELRKLKEKIDRLLDKLTKE

SEQ ID NO: 18554 - protein, 59 aa, Artificial Sequence
  Synthetic
EEVVRRIIEDIRRLLEEVKKVNEDLSEENERLNRDAERRVREAIKEVEDLLDEIEKTVR

SEQ ID NO: 18555 - protein, 59 aa, Artificial Sequence
  Synthetic
SVEDELRKLEEKIRRLLEELRRTNDENRRHSEKVLEELRRELEKLKRRIEELLRKLREE

SEQ ID NO: 18556 - protein, 59 aa, Artificial Sequence
  Synthetic
EEVVERLIRDVERKLREVKKENDRASKENEDLNREVKRRAEKLLRDVERLLREVEKTVK

SEQ ID NO: 18557 - protein, 59 aa, Artificial Sequence
  Synthetic
SAEDRLRELEERIRRALKELEDTNRRNEEHSKKLLEELARSDRETEEEIKEALKRLTER

SEQ ID NO: 18558 - protein, 59 aa, Artificial Sequence
  Synthetic
EEVVDRLIREVEERLRDVRRLNEELSKRNKELNDRVREVNEELNRRIKKRLEEIKRRVE

SEQ ID NO: 18559 - protein, 59 aa, Artificial Sequence
  Synthetic
SLEDLVRTIREEIERLMKEAEDTNRRNKEESEESLRRLKKLVEDIDREVKEVLDRAEKN

SEQ ID NO: 18560 - protein, 59 aa, Artificial Sequence
  Synthetic
EKVVEELIRRIKDELKKIRERNKELSDRDKKLNEDVEREVRKLIDEIRKKLEDVERTVK

SEQ ID NO: 18561 - protein, 60 aa, Artificial Sequence
  Synthetic
REVDKVREDVKRLIKEIEDRVRKVLKEDEDLIRELRERVKKVSKENKEVVKTLRELVRDL

SEQ ID NO: 18562 - protein, 55 aa, Artificial Sequence
  Synthetic
ELVKELEKRIREVLERLRRLIERSKEEIDRVLREVEEDVRRNKEENKRLLEEAER

SEQ ID NO: 18563 - protein, 59 aa, Artificial Sequence
  Synthetic
DEKDKVRKTVEDILREIEKIVEDLVRRNERVDREIRERVRELLRRDDEILKRMEEVKRR

SEQ ID NO: 18564 - protein, 56 aa, Artificial Sequence
  Synthetic
EREVTKLKEDIDRLLEKLERDLDELRKRNDELLKELEDRVRKSKEKVEKILRDVRR

SEQ ID NO: 18565 - protein, 60 aa, Artificial Sequence
  Synthetic
SIEDKLRELKERHKELSKRIKEELERLTEEHRRVSEKIRKSLEEDKRRADKVLERIRRER

SEQ ID NO: 18566 - protein, 59 aa, Artificial Sequence
  Synthetic
EDVLRKVEEDSREVLKDSKRLLDEVATRSEEMLRRSEELLKRIHETSKKVLDEIKTKLK

SEQ ID NO: 18567 - protein, 60 aa, Artificial Sequence
  Synthetic
SIEDLARDLERRHKELSEDDKRKLDELRKRHKDVSDEARRSLERDERRVEKVEREITKRR

SEQ ID NO: 18568 - protein, 59 aa, Artificial Sequence
  Synthetic
EKVLDDVRRRSDKMLEDSRRLTREVEETSKEMLERSRRLLEEIHKESDRVLREARERDR

SEQ ID NO: 18569 - protein, 56 aa, Artificial Sequence
  Synthetic
RIEDILRRLEEHHRRLDKENKEILERLKKHHEEVLRKIKEILERLEREARDIERKI

SEQ ID NO: 18570 - protein, 59 aa, Artificial Sequence
  Synthetic
DEVVEKVVREVEDTNEKIRRRSDEVRKEVEDTNRRIDKRLKEVEEEVRRLLDEVRKESE

SEQ ID NO: 18571 - protein, 60 aa, Artificial Sequence
  Synthetic
SELEDVAKKAEDLLTKSAEILKEVVDRHRRLNERSEDEARRVEEEHRRTNKKLLDLARRG

SEQ ID NO: 18572 - protein, 56 aa, Artificial Sequence
  Synthetic
SEELRKLKKRIEDISREHERILRELREHVERVSDKHRKILKELEEDVERILREVTK

SEQ ID NO: 18573 - protein, 60 aa, Artificial Sequence
  Synthetic
SEIEKVVEDIKRLLEESKDRLRKAEEEVRDLSRRSREKLRRAEEDIKRLLDEIERMLRAG

SEQ ID NO: 18574 - protein, 56 aa, Artificial Sequence
  Synthetic
SDELRKLAEEIERVSEEHKRILDELRDHLRKNTKDVRDILRELEKEAERLLRELRR

SEQ ID NO: 18575 - protein, 60 aa, Artificial Sequence
  Synthetic
KDVEDVLKRVKDVNREVEKRLEKVIRDDEKINEEINRRLDEMAERVKRVNETVEDIARKE

SEQ ID NO: 18576 - protein, 56 aa, Artificial Sequence
  Synthetic
EKLVEELRRESDTSKKRVEKLIRELKEKNKRSEERARRIIEKLKKESKDSLKRVKD

SEQ ID NO: 18577 - protein, 56 aa, Artificial Sequence
  Synthetic
EEKEILDELEKEVRDLNRKNKEILRRLEETARDLHRRNEEILDRIRKRVEELKRRV

SEQ ID NO: 18578 - protein, 56 aa, Artificial Sequence
  Synthetic
KDTVAKEAKRLIRDLERLSREIEERVRRLIEEVKEESERIRERVTRLIKEVEDRRK

SEQ ID NO: 18579 - protein, 56 aa, Artificial Sequence
  Synthetic
DDEEILKELEERVKKLHEKNKRILEKLKREVERLNDENRRILKEVKEDVDRLLKEV

SEQ ID NO: 18580 - protein, 56 aa, Artificial Sequence
  Synthetic
SETVARRVEEMIKEVEELSKEIEERAKRLIDRLRELSKRILEELKRLLEEVREKRR

SEQ ID NO: 18581 - protein, 59 aa, Artificial Sequence
  Synthetic
REEDEVLEDARRLSEESRKKLREVERRAKELSDRSRKRLRDVKRRVDDALRKIEDLRRR

SEQ ID NO: 18582 - protein, 56 aa, Artificial Sequence
  Synthetic
SEKLRELEEEIRRNSKDVKEVMKELDKHIKRNSEEVDKVLKELEERLKRLLDRVRK

SEQ ID NO: 18583 - protein, 59 aa, Artificial Sequence
  Synthetic
SDEDRVKDKAEELSRRSREELERVKEEAKRLSDESKKRLEEVTRRIEKVLREIRELRER

SEQ ID NO: 18584 - protein, 56 aa, Artificial Sequence
  Synthetic
SEKLRRLREEIKKNSDEVKKVLRRLEENLRDNTRRVREVLERLEDEARKLLKDVKK

SEQ ID NO: 18585 - protein, 59 aa, Artificial Sequence
  Synthetic
SEVDDVLRRLKELSERSEKTLEDIRDEAEKLSKESEDLLREVLRRSEKVNEDIRRLREK

SEQ ID NO: 18586 - protein, 56 aa, Artificial Sequence
  Synthetic
SRRLEKLRREIEDNSRRVREVLKRLKENIKRNTDRVREALKRLEREHEEVLREVET

SEQ ID NO: 18587 - protein, 60 aa, Artificial Sequence
  Synthetic
SIEEAITRLRKEVEDSNKRSEDVIRELHERDKESLEEVREIIKRLKDKVRTLLEEVDKRV

SEQ ID NO: 18588 - protein, 59 aa, Artificial Sequence
  Synthetic
EEILKEVLKRLRKLLEDNERVLDEARRRVEKTNEEIKEVLKRVAEEVDRLIKEVREEVE

SEQ ID NO: 18589 - protein, 59 aa, Artificial Sequence
  Synthetic
SIDEIIEELRRRIEELRKEAEKIIRDSKKHLEDNKRDADRVIKESKEEVDKLLKEIEEA

SEQ ID NO: 18590 - protein, 59 aa, Artificial Sequence
  Synthetic
EELLEEVRKRIEDLLRELRDILRKLLERDKRLSKESERLVREMLREDRRLLDELRKEVK

SEQ ID NO: 18591 - protein, 59 aa, Artificial Sequence
  Synthetic
SIEEIIRDLRRHIKENAEEAEKVIKESEDHLRENKKRAEDVIRRLEEELRKLAERVRRA

SEQ ID NO: 18592 - protein, 59 aa, Artificial Sequence
  Synthetic
EELLKRAVDAVRKLSEDSKRLVEEALRRDEELSKRSRDLVEEVRRRAEELLRRIEETVK

SEQ ID NO: 18593 - protein, 59 aa, Artificial Sequence
  Synthetic
SSKDDVRRRMKEINERDKRLLDEVLRRLEKLIEELKRHTEEVERDADRIIEEIERMLRN

SEQ ID NO: 18594 - protein, 55 aa, Artificial Sequence
  Synthetic
ERIIKEIRDLIRENEERNKEIVRRIEELLRELEKRSRDVIKRIREKLDRLRKRVE

SEQ ID NO: 18595 - protein, 57 aa, Artificial Sequence
  Synthetic
SKVEEIERRIREEVTRSEKEDRDNVREIRKLVEELRRESKRILDESRRLVKRLIDEA

SEQ ID NO: 18596 - protein, 59 aa, Artificial Sequence
  Synthetic
DEILKRIEEEVRKILEDSRRSTEESHEKVRRIITKIRKLLEDDERRNRKVVREAEEAMR

SEQ ID NO: 18597 - protein, 57 aa, Artificial Sequence
  Synthetic
SKLEELLRRAREVARRLKEELERILKEVEDRVRKSEKEDEDNVKRITDEMRKLKERV

SEQ ID NO: 18598 - protein, 59 aa, Artificial Sequence
  Synthetic
DRVIKRIEEDVRRVIEEIKRLLRELEEEIRRILDESRESTERSHRTARKIVEEVERAAK

SEQ ID NO: 18599 - protein, 59 aa, Artificial Sequence
  Synthetic
SKMETIERRVEEAIRESEELNERDEERVKKVIDELKKLIDDIRRRLEEALRELKKVTDD

SEQ ID NO: 18600 - protein, 55 aa, Artificial Sequence
  Synthetic
EEILKKVRELIEETKRRTDDLHKKVKERVDDIKRRLDELLEEAKRALDEIRERVK

SEQ ID NO: 18601 - protein, 60 aa, Artificial Sequence
  Synthetic
SAVEEIKRRLEEIIRDLERLIDDDRKRVEEMVKRIEDLIKKDEEDVREALKKLEEVVTRG

SEQ ID NO: 18602 - protein, 55 aa, Artificial Sequence
  Synthetic
EEILERADRLVKEIKEKLDRLVKTSEELIRRLEEELRRLHEKVKELMKRAEEKVR

SEQ ID NO: 18603 - protein, 60 aa, Artificial Sequence
  Synthetic
SREDVLREIRRLVEETKKENEKILERLRRLVRTVERRNDEVVKKVRTLVKRLEEEIDKTV

SEQ ID NO: 18604 - protein, 56 aa, Artificial Sequence
  Synthetic
LDELLRKLKEDLDRSKEELKEIEKRVRELLERNKRKTEEVEKEVKRDLDDIRRKLK

SEQ ID NO: 18605 - protein, 60 aa, Artificial Sequence
  Synthetic
SEKEALDEVRKRVEDVRRDNKRILEESERLNRESRKRNRDILERLRKEAEDLKREIDETV

SEQ ID NO: 18606 - protein, 56 aa, Artificial Sequence
  Synthetic
LDKLLEDLERLLKENLDRLRKILEEDRRLNKENNDKLKEIEKRVRELLKDIKDKLK

SEQ ID NO: 18607 - protein, 60 aa, Artificial Sequence
  Synthetic
KEVEDVLRKIRDLVRKNLEDAERVVEEAKRLIDENRERLREVLREDEELNREILKRLREL

SEQ ID NO: 18608 - protein, 56 aa, Artificial Sequence
  Synthetic
EEALKEVRRLIDELRKANKRILEEIRDLVRRLREENEEILRRLKRKNERTADEIRK

SEQ ID NO: 18609 - protein, 60 aa, Artificial Sequence
  Synthetic
SEVEDVLRRIRELLEEIKRRLEDVRRRIKELLDRNRRESEDVLRRDKELNDEVRDKLRKR

SEQ ID NO: 18610 - protein, 56 aa, Artificial Sequence
  Synthetic
ERMLKTVEDLVREVSKEVRRILEELRDEVRKSEEENRRILDKLEKENRKTAEDVKR

SEQ ID NO: 18611 - protein, 60 aa, Artificial Sequence
  Synthetic
SEVEEVLRRIKELLDRNREELKKVRERIKRLLDRNREKSEEVRERDKRLNDEIKKRLDED

SEQ ID NO: 18612 - protein, 56 aa, Artificial Sequence
  Synthetic
KRVLEEARRLVKKSEEDNRRILKELRELVKESERENEEILRELKKLNEDTKKRIED

SEQ ID NO: 18613 - protein, 58 aa, Artificial Sequence
  Synthetic
DEVEEVLRKIEELIRENIKRAREVLEEDKRLNERNKRESEKVLEEDERLNREIEKELR

SEQ ID NO: 18614 - protein, 56 aa, Artificial Sequence
  Synthetic
EEVLRRIKKLIEESMEDNERILRDAERLNRESKERNERILKRLKKRNDETRKEVEK

SEQ ID NO: 18615 - protein, 59 aa, Artificial Sequence
  Synthetic
SSAEEVKERSKRINEEIEKTLEKMLRESRRTNEEIKKTLKRLAEEAEKLLRDVERLVRA

SEQ ID NO: 18616 - protein, 56 aa, Artificial Sequence
  Synthetic
EDIIREIRELNKRTRDKIEEIIERIRKLNKETRDRIRKIMREIEKKIRDLAEEIRR

SEQ ID NO: 18617 - protein, 59 aa, Artificial Sequence
  Synthetic
KSMEEARKKSKEINDRILDRLKKVLEESRKINKDIKDTVERLRERSEDINRRIKELVDS

SEQ ID NO: 18618 - protein, 56 aa, Artificial Sequence
  Synthetic
EEIIKEIRKLNEETRKEIERIAREAEELNKRTADKIETIIREIEKLNKKLKDDIEK

SEQ ID NO: 18619 - protein, 60 aa, Artificial Sequence
  Synthetic
DEVRELVKEIEELIERIERTLRKMTKDSRDLNRKINEKLKKVLEDSRRLNEEIKRTIDSN

SEQ ID NO: 18620 - protein, 56 aa, Artificial Sequence
  Synthetic
ESILRRLEKLLEELRKRVEDIIRELEKLNKESREEIDKIIREAERLTEETERRARK

SEQ ID NO: 18621 - protein, 60 aa, Artificial Sequence
  Synthetic
DEMEELLERIRRLIREIDERLKEMLKRSRELNRELNERNKDVLRRIKELIDRIRRLIERD

SEQ ID NO: 18622 - protein, 56 aa, Artificial Sequence
  Synthetic
ERILRELKKLVDDLRRRIKKILDESKELLERSEKKADESNKELRKLVEELRKEADD

SEQ ID NO: 18623 - protein, 60 aa, Artificial Sequence
  Synthetic
SRVEEIERRIRELIKRIEDRNRKMLETSRRLNEDINRRLRELLERIRKLIEEIEELIKRD

SEQ ID NO: 18624 - protein, 56 aa, Artificial Sequence
  Synthetic
EKILRDLEELLKELARRLERSNEESRRLLEDSRRKMEKIIRELEKLLDDLRRKIEK

SEQ ID NO: 18625 - protein, 60 aa, Artificial Sequence
  Synthetic
DEKEIDEEIERLVRDSKRRSRKVLRDIEELAKRVKEENDRVLEKLRKLIEDLKRKIDETI

SEQ ID NO: 18626 - protein, 55 aa, Artificial Sequence
  Synthetic
ERLKEEVDRVIADSRRLNKEILDEVKRELDKLRKHLEDVLRRAEKMIRDIDEELR

SEQ ID NO: 18627 - protein, 59 aa, Artificial Sequence
  Synthetic
SEVDKVREDVERLSARSEEKVREVLERVKRLLDKSKRDNEDVKRRVRELAERLRDLRRK

SEQ ID NO: 18628 - protein, 56 aa, Artificial Sequence
  Synthetic
KEVLDRIRRRIEENSKKIDDMVKKVRTLVKRSEEESERVLKELRDLMRDVERRIRE

SEQ ID NO: 18629 - protein, 60 aa, Artificial Sequence
  Synthetic
SEVERVEKEIRDLSRKSNEDLKRILDEARELSKKSNEDTKRVLKETRDLLKEIADRLREV

SEQ ID NO: 18630 - protein, 55 aa, Artificial Sequence
  Synthetic
EEVKKRVEESLRENEKLLRTIAKEIEDLVRENRKVNEDVNREVEKLVRELEERIK

SEQ ID NO: 18631 - protein, 61 aa, Artificial Sequence
  Synthetic
REVEELLKRIRELVKRNNEKTKRLLDESRRLNEEANRRLDKVLKELRDLAKRIKEELDEKG

SEQ ID NO: 18632 - protein, 55 aa, Artificial Sequence
  Synthetic
EDLEREVKKLLDENRESSERVIRESEKSLRDHAERTRKVREEIRKLLEELKRAVE

SEQ ID NO: 18633 - protein, 56 aa, Artificial Sequence
  Synthetic
SEKEDIKRKLDDLLRRHREVSRESNRELKRLLEEHRRTSKRLDDEIKRLLREIEEA

SEQ ID NO: 18634 - protein, 56 aa, Artificial Sequence
  Synthetic
TETVRKEIEDIARRSKEKLEKNTRDVKRMVDRSKEELKRILKELEDAIREIKKKVD

SEQ ID NO: 18635 - protein, 60 aa, Artificial Sequence
  Synthetic
SEKERILERLKELVERSNEKLERILRRSEKLFTDSNKELKDILDRARKLIEEIDDRIRKV

SEQ ID NO: 18636 - protein, 55 aa, Artificial Sequence
  Synthetic
KKIRDDAERLITENKERNERVNKRDEDLLRRNRKENEELNRELERLVKEIREKLK

SEQ ID NO: 18637 - protein, 60 aa, Artificial Sequence
  Synthetic
EEKERILETAKKLAEEIKRRAEEILKRSEELVRDSNKKLREVLEEARRLIKKIEDEIREI

SEQ ID NO: 18638 - protein, 55 aa, Artificial Sequence
  Synthetic
KEIEDEVRRLVREIEELLRDIERRDKELLDENRKLNEEVNRDAERLVRKIRKALE

SEQ ID NO: 18639 - protein, 60 aa, Artificial Sequence
  Synthetic
SEVEELLRRIRELSKRSKDEIKRMLKEIRELSEKSKRDIERMLRRNEDLARKIKELIDRD

SEQ ID NO: 18640 - protein, 55 aa, Artificial Sequence
  Synthetic
EEIKREVEKLLEENRKLLEDLEEDVKRLIEENKRALEEVERESKRLNDESRERTK

SEQ ID NO: 18641 - protein, 57 aa, Artificial Sequence
  Synthetic
DDLERVLKEIKKAADKIREDNKRTADKIRKRVKELDDETRDMLRRIRKLVKEIKERV

SEQ ID NO: 18642 - protein, 59 aa, Artificial Sequence
  Synthetic
DEALRRVEEEVERLIRDLRRVLKETSDRVRELIDKHRRLSEEVEKDVKRLIDELKKKTD

SEQ ID NO: 18643 - protein, 61 aa, Artificial Sequence
  Synthetic
SEIEEILERIKKISEDSKRRLEDILRKAKKISDESRETNKKTLEDVRRIADEIRKRLEEAG

SEQ ID NO: 18644 - protein, 59 aa, Artificial Sequence
  Synthetic
KDKLERVEREIRRLIKENKDIVERIERAIEELVRRNEKSVEDSKKDIKRLVDELDREAR

SEQ ID NO: 18645 - protein, 57 aa, Artificial Sequence
  Synthetic
SEVERIKERIDKLVEENRKLVEEIEEEDRRLLEENREIVKRIEEEIEKLLRDLERRV

SEQ ID NO: 18646 - protein, 59 aa, Artificial Sequence
  Synthetic
EDVLRDILREIERLSKESKDRLKDLLRKSEELSKESKKLLKDILKKVEDLIREAREEAR

SEQ ID NO: 18647 - protein, 60 aa, Artificial Sequence
  Synthetic
EEKERLKKSLEDLAKRIRDILRKHEEDSRRLSKEIRDVLRRHREASRKLVEEIKELIKSV

SEQ ID NO: 18648 - protein, 59 aa, Artificial Sequence
  Synthetic
EEMLKRVLEELERIVRDIERRIKEASERIRKIVEDIKKRIKEADDRIKDIVREIAERIR

SEQ ID NO: 18649 - protein, 60 aa, Artificial Sequence
  Synthetic
DEEEEALKDVERLLRRNEKLIEEHERRSEKLLRELEDVVRRHEERSKELLERIRERIKRL

SEQ ID NO: 18650 - protein, 55 aa, Artificial Sequence
  Synthetic
EEVLKKLRKLSKESEDDIRKMSEEVEEIVRRIKRLLEEATRKLEELVKRIEERID

SEQ ID NO: 18651 - protein, 60 aa, Artificial Sequence
  Synthetic
DEDEEAKREVERLLRENEKLIEDHKRLSEELVRRLEDLIRRHEETSERLLRELREIIKRQ

SEQ ID NO: 18652 - protein, 55 aa, Artificial Sequence
  Synthetic
EDVLRELRDLSRRSKEEIKKMSEEIEKLARDILKRIREMTEEAKRIVKEIKDRIR

SEQ ID NO: 18653 - protein, 61 aa, Artificial Sequence
  Synthetic
SEIERVLKELDEVSKKSLEEIRRMSEESRRLSKESIDRIREMLERAREKADRIRETIKREG

SEQ ID NO: 18654 - protein, 59 aa, Artificial Sequence
  Synthetic
KDKLRRLRERVEELKKRNEDLLKEHRDENKRLIDENRDLVDKLRKTIKRLIDDLERRVR

SEQ ID NO: 18655 - protein, 60 aa, Artificial Sequence
  Synthetic
SKVDELRKTVEKLLRELRDSLRRYEEESKRLLEELDDSLRRSKKTVEDLLREIKEILKRV

SEQ ID NO: 18656 - protein, 55 aa, Artificial Sequence
  Synthetic
DRAKERLERLVRKIKEDNKRSLTENERLVRKIKKENEDAIRRLKDVAKKIKEELT

SEQ ID NO: 18657 - protein, 57 aa, Artificial Sequence
  Synthetic
SEKEELKKEIRRNLEENKDVLRRHEEENRRLKKRIKELLERHARTNKRLKEEIDRTI

SEQ ID NO: 18658 - protein, 59 aa, Artificial Sequence
  Synthetic
SRLLEELLRKLEKLSRDSKEKLKEISKRSKELVKRIERELEKMTKKSRDLVKKIKEEEK

SEQ ID NO: 18659 - protein, 60 aa, Artificial Sequence
  Synthetic
SEVEELRKELERIVKETKDVAEELSRESEEVLKKSEENLRRLTEKSDDVLRRVAELIRSN

SEQ ID NO: 18660 - protein, 55 aa, Artificial Sequence
  Synthetic
KELKERIERVNREVREEARKHHDKNRDIRRRVTELHKRHKERNEEIRRKVEEDAK

SEQ ID NO: 18661 - protein, 60 aa, Artificial Sequence
  Synthetic
DEIEDLRRKVEKVVRDAEKVLRDLSRKSRKVHEDSRENVDRLLKEVEDVVKRVADLIRSN

SEQ ID NO: 18662 - protein, 55 aa, Artificial Sequence
  Synthetic
EELKRTLEELLKRVEDLVRRHHEENKKLTDDNRRLHRRLRERLKEVLREVERRRD

SEQ ID NO: 18663 - protein, 60 aa, Artificial Sequence
  Synthetic
SDVERIEEELRKLTEENRKLTETLKTELRKIRREVEKILKELEDRLRELSERVKDLIRKR

SEQ ID NO: 18664 - protein, 59 aa, Artificial Sequence
  Synthetic
KEVLDDIRRKLKKLHDESKKTHRDILERLKEALKRLLELAERVLEELERRAEELRREIK

SEQ ID NO: 18665 - protein, 60 aa, Artificial Sequence
  Synthetic
DDVERLEERLKELDKRNKELTKDLEDKLRKLTRDNRELLKKIEKRLEEVRREVKRLITER

SEQ ID NO: 18666 - protein, 59 aa, Artificial Sequence
  Synthetic
KEVAERIREELERLHEESKRLHEKILEDLERAHDETRRIVEDILRRLEKVARELKEEIR

SEQ ID NO: 18667 - protein, 57 aa, Artificial Sequence
  Synthetic
DELRELIKTLREILERLLDRSRRLNDKLKEILERIERASKKMNDDDRRRVRRLEEEV

SEQ ID NO: 18668 - protein, 59 aa, Artificial Sequence
  Synthetic
SRRLEDVERVVEEAKRALERSLRENEKSVEDIKKRIRESVEENKKSVRDTLERLKRTLE

SEQ ID NO: 18669 - protein, 57 aa, Artificial Sequence
  Synthetic
STEEEVRKRVEEIERTLRESLERNRETVERSEERLEELLRRARRVVEESKKRLDKEI

SEQ ID NO: 18670 - protein, 59 aa, Artificial Sequence
  Synthetic
DEVMRDLIRKLEDILRRLKEESDRLNEEHKEILKELVRRLEEIIKEHREIVERILKKTR

SEQ ID NO: 18671 - protein, 56 aa, Artificial Sequence
  Synthetic
DEEEEVKRLLDRIREEVKRLHDENKKRLDELRRTVDKLLRESERENKRVNDEVRKD

SEQ ID NO: 18672 - protein, 56 aa, Artificial Sequence
  Synthetic
VETLKRRIEDVLRRVEEESRRLNKELEDVLRRAKELVDRSKKKLEEVLRRVKEKAK

SEQ ID NO: 18673 - protein, 56 aa, Artificial Sequence
  Synthetic
DEEREIEELLRTLTREVKRLLDESRKLNEEILRKVKRLHDENRKRIREVLEDVKRR

SEQ ID NO: 18674 - protein, 56 aa, Artificial Sequence
  Synthetic
VETLKEEVKRALEEVEKRVRDSKRDLKRVAEEVEETSRRLNDELRKVREDVRRRAT

SEQ ID NO: 18675 - protein, 61 aa, Artificial Sequence
  Synthetic
EEAERIADEARKVEEDVRRMVEESKRKLKKVLDDSKRLIDELKRRLEDIRRKVAEMAKRLR

SEQ ID NO: 18676 - protein, 59 aa, Artificial Sequence
  Synthetic
ERVLRDIERLLEEIRRELERLARESEKVNERVNREDRRLLEEIRELLERIRKELEERTR

SEQ ID NO: 18677 - protein, 56 aa, Artificial Sequence
  Synthetic
SLKEEVDELLRRIEEEIRRLADKSRRTNERVKEEIDRLARESEETNKKLKKKIEDI

SEQ ID NO: 18678 - protein, 59 aa, Artificial Sequence
  Synthetic
AKIVKKLLEDLKRLLKEVKELMERINKETKELLERVAREVKRLNTDTERLLKEVEDRVR

SEQ ID NO: 18679 - protein, 60 aa, Artificial Sequence
  Synthetic
SEREEIEELSRRSRRSLEELKKEIRKVNERNKRLLEELEREIRRVSKESRDRLRELRRRL

SEQ ID NO: 18680 - protein, 56 aa, Artificial Sequence
  Synthetic
TKDLIRRLRELTRTIERRATELIKRLEEVSREIAERVRKLIKELRDMTRKIDEDAR

SEQ ID NO: 18681 - protein, 59 aa, Artificial Sequence
  Synthetic
SEVEKLLERLKKILEEIARLVDRSNTEDDKILRKAEEDVRRLLDKLKKILERAAELLAR

SEQ ID NO: 18682 - protein, 59 aa, Artificial Sequence
  Synthetic
EKLRREIRKLVKELKETIKRLEKKSRDTVKRTEDELRRLEEEAERLITELKERLDELRK

SEQ ID NO: 18683 - protein, 60 aa, Artificial Sequence
  Synthetic
REDEEMLKDLKRVLEDAERVSRDTLRELEDAVRRLHELSEDTLDKLRKVLEEADRLIRSN

SEQ ID NO: 18684 - protein, 55 aa, Artificial Sequence
  Synthetic
EDVRRILERVRKELKRLLEENEKLLRRVEKELEENERRNEEEIRRVKKTVEERAK

SEQ ID NO: 18685 - protein, 59 aa, Artificial Sequence
  Synthetic
SRVEEVLKENRDTNEELKDTVRKILETNRRTLERAEEEVRKILEDLRDIARKIEEMVEN

SEQ ID NO: 18686 - protein, 59 aa, Artificial Sequence
  Synthetic
KEMLERLRRSLEESKETVKRLLEELRKSLEKSKRDVERLLKELEDLLRELEKKVDDRRR

SEQ ID NO: 18687 - protein, 59 aa, Artificial Sequence
  Synthetic
DEAREILTRIRKLLEEIRKEAEEVSERHKRLVDELDKEVKDINKRAEDLLRELAEIVKR

SEQ ID NO: 18688 - protein, 56 aa, Artificial Sequence
  Synthetic
EKEVRKVLEEIKRVLEELKRHAEDNLRRAREVLKKLADEAKRVNERSEELLRELKK

SEQ ID NO: 18689 - protein, 60 aa, Artificial Sequence
  Synthetic
SMADEILRELKELTEEIERRVREASREHRERLEKLRREVREINKELKRRLDELREIVERG

SEQ ID NO: 18690 - protein, 56 aa, Artificial Sequence
  Synthetic
KDRVEKILRENKERTDRLRRHIEKNLEDARDLLRKLKEEVKRVNEESEKSLRDLRK

SEQ ID NO: 18691 - protein, 60 aa, Artificial Sequence
  Synthetic
SLEEDIRRILDENRRSTERIKEEIREINERDKRSLEDIERRIRKVLEDLRKLLEDLAREG

SEQ ID NO: 18692 - protein, 59 aa, Artificial Sequence
  Synthetic
EEAVRKILKEVRDVNEELKRRVEKILEDIRDANRRLRETVEEIIRRAKEAVDKLRDEVR

SEQ ID NO: 18693 - protein, 59 aa, Artificial Sequence
  Synthetic
SEKERVDDLLRRVDELLKRSKREVEKLLEDNKRLLERIERENRRLTKELEDKVRRLKEK

SEQ ID NO: 18694 - protein, 56 aa, Artificial Sequence
  Synthetic
VEEIAKEIRDVLREHKELIDEIRKKAKKISDKSRKLMEELERHLRRVIKELDEKAR

SEQ ID NO: 18695 - protein, 60 aa, Artificial Sequence
  Synthetic
SEEEEVEELLRRNRKKAEEVDREIDRLLKEVEKLVKDSRKRIEDLLRRAREKVEDLRRKG

SEQ ID NO: 18696 - protein, 56 aa, Artificial Sequence
  Synthetic
VREISEEIERITRETEDRIRKIAEEIRRVLKRHKELIEELEKEIRDVLKKLDDDVR

SEQ ID NO: 18697 - protein, 57 aa, Artificial Sequence
  Synthetic
SEIEKLLKDLRDLLKKSEETVREMLKRLEEIVRRAEEDHKRLLEKLKRLLEKLRRDV

SEQ ID NO: 18698 - protein, 59 aa, Artificial Sequence
  Synthetic
EEVRKRLEDLADEVDKRNRDIERKIRELMKRAKEVSERLNKELEDLAREAEKLLRELKK

SEQ ID NO: 18699 - protein, 57 aa, Artificial Sequence
  Synthetic
DEIEELLKRLRDIVRKIREDHERLSRESERINKDARRRHDEMLRRLEELLRKVEKEV

SEQ ID NO: 18700 - protein, 59 aa, Artificial Sequence
  Synthetic
EKVKRDIERIRKEVKEESKRLNDHIRDNERRNKESSEELNRRIKKIADEVRELLEKLKT

SEQ ID NO: 18701 - protein, 56 aa, Artificial Sequence
  Synthetic
REEERLRELMDESRKRIEAVEKRARDLKRKSDRLIEDAARKIKTILDKIRKLIEDL

SEQ ID NO: 18702 - protein, 56 aa, Artificial Sequence
  Synthetic
LKDVEKKIREVNKTVKEEVDRLVEKNERLNDEARRVVKELLDKVERMLEEVEREAR

SEQ ID NO: 18703 - protein, 60 aa, Artificial Sequence
  Synthetic
SEKEDMARKIKELIDRDRERIERVIREIEKLIKELRDHNKRVLETDKRLLDDLKRVADDG

SEQ ID NO: 18704 - protein, 55 aa, Artificial Sequence
  Synthetic
EDLRRLKEEVDRVAEETRRLLEEIKKKVDKVVREVETSNRRSEEEVRRLLDEIRR

SEQ ID NO: 18705 - protein, 60 aa, Artificial Sequence
  Synthetic
DEKEEAARRVEKLITELRKHNEDVLRDIKRLIDELRRHNEEVLKRDRELLERLRKVAEEG

SEQ ID NO: 18706 - protein, 55 aa, Artificial Sequence
  Synthetic
KELDDLRKRAEDVLRDLRRTNRKILEDVRRVIEELERSNERSLTEVERLLREVRK

SEQ ID NO: 18707 - protein, 59 aa, Artificial Sequence
  Synthetic
SEKERVLTELEKILEELRRRVEEILKEIEKLIEELRRHNERALERDKKLLEELKEVRER

SEQ ID NO: 18708 - protein, 55 aa, Artificial Sequence
  Synthetic
RELEKVKEKLDRLMKDIKEKLDRVKEKVRRVLKELEESNRKSEKDAKELIDRIRK

SEQ ID NO: 18709 - protein, 57 aa, Artificial Sequence
  Synthetic
SEVEDLLRDIERLIEESRRLVERLLERLEELIRRHTRLVEELIRELERMLKKVADEV

SEQ ID NO: 18710 - protein, 59 aa, Artificial Sequence
  Synthetic
DEIRTEIKKVVDKAREVNKRIKELIDKIKREAEENSKRANELIERITREIRRLLEDLRR

SEQ ID NO: 18711 - protein, 60 aa, Artificial Sequence
  Synthetic
SELEELRKRVKDLIRETKKLVEEVAEKVERLNKETKKLLEDVARIVEELIRRAEEVAERI

SEQ ID NO: 18712 - protein, 59 aa, Artificial Sequence
  Synthetic
EEVLRDIERLAREIEKVNREAEERIRRLKKKSEETNERVKRAIDKLAEELRRVLEEIRR

SEQ ID NO: 18713 - protein, 60 aa, Artificial Sequence
  Synthetic
SELEELAKAVEKLLEDLRRMTREVEEKVKEINERTKKLLKDVAERVKTLLREIEELAKKI

SEQ ID NO: 18714 - protein, 59 aa, Artificial Sequence
  Synthetic
REVLKAIKELMERIKKTLDEIRKRIKELEDESEKTNRELKKKIEDLKRELEELLREIKR

SEQ ID NO: 18715 - protein, 61 aa, Artificial Sequence
  Synthetic
SEIDEVIKTLEKLLEDLRRELEELSRRNKKVLEDILRRVKRLSDENRRLLERIKRTVDKRG

SEQ ID NO: 18716 - protein, 59 aa, Artificial Sequence
  Synthetic
EKIEKKVKEVRERVKEVLERIERLVDENRRENKEVVDRIKKLLKENEEEVREVLKRIRD

SEQ ID NO: 18717 - protein, 61 aa, Artificial Sequence
  Synthetic
SEIDDLVKKNKELVKKIREDVERLSEENKEVLKDIERKVRKVSEENDRLLEEIKDTVRKRG

SEQ ID NO: 18718 - protein, 59 aa, Artificial Sequence
  Synthetic
RKVEKKVRENKKENEDVLRDIERLVKENKDRNREVLKRIEDLLRKNAERVKRVADEIRR

SEQ ID NO: 18719 - protein, 59 aa, Artificial Sequence
  Synthetic
KEVEDIVDDVRRVIEELKRKVEEVSKKNEKLVREIEERVERISRRNKKLIKELKEIVDR

SEQ ID NO: 18720 - protein, 56 aa, Artificial Sequence
  Synthetic
EELLRKIARDLEKVREEIKELVKENRKTNEEVVRRIEKLAKENDDENRKVLKEIED

SEQ ID NO: 18721 - protein, 60 aa, Artificial Sequence
  Synthetic
DEVERIVEDIRRLLDEVRREVEKVSRENKELVDRVREKVKEISKRNKKLAKDLTDLVREG

SEQ ID NO: 18722 - protein, 56 aa, Artificial Sequence
  Synthetic
KELLDRIKEEIERVIKEIRELVEENKRTNEEVLRRIRELARRNEEENKRVLEDIRR

SEQ ID NO: 18723 - protein, 60 aa, Artificial Sequence
  Synthetic
SVEELIKEVKDRLRKVLREIEELIRENEEENRKNVEDVKRTADKLRRDLEKVVDEIDKRV

SEQ ID NO: 18724 - protein, 59 aa, Artificial Sequence
  Synthetic
KEVIDKVVKRVEDLVREIKEEVDKISEENKELVKRDTRRVEEVRERIRKLVEELRREVT

SEQ ID NO: 18725 - protein, 61 aa, Artificial Sequence
  Synthetic
SEIDRVIEKSDKTNEEIKRDVDRAVRRSEETLKRIRETVEEIVKTVEKLIRDLRRRVEDKG

SEQ ID NO: 18726 - protein, 56 aa, Artificial Sequence
  Synthetic
KDKAKELRDRLERSLREIAKKIKKVLDDTDRVLRDIERTIEELKKRLREVLERVRK

SEQ ID NO: 18727 - protein, 61 aa, Artificial Sequence
  Synthetic
SEIDDVIKKLKDLIEELEREVKEMSDENKRLLEEIEERVKEAIKRSKDTLEEIADRVRKKG

SEQ ID NO: 18728 - protein, 56 aa, Artificial Sequence
  Synthetic
KDKATKIEKDLRDVLRKIEKTMEDNRRENEELLKKVEEEVRRLEEETEKVLRDLRR

SEQ ID NO: 18729 - protein, 60 aa, Artificial Sequence
  Synthetic
SEVDEILKRIEELIRRIEDEVEKMIRESEDTIRRDEKEVKDAVRELADLIRRIEKRVRER

SEQ ID NO: 18730 - protein, 56 aa, Artificial Sequence
  Synthetic
EKKVREIDKRLKDALREIRKLIERSKEESRRALKRSRELMKRLEEELRRVLKEIRD

SEQ ID NO: 18731 - protein, 61 aa, Artificial Sequence
  Synthetic
DEVDKVLKRIKELIDEDKKEVEKVIRDSKRTLREDEERVRRAAKEVEDRIRDIEDIVRRRK

SEQ ID NO: 18732 - protein, 56 aa, Artificial Sequence
  Synthetic
KKKLEDIDRELDRVLEESKKEIEKSKRESEEVLKKSRDLVKRLAEELKRVLDEIRR

SEQ ID NO: 18733 - protein, 60 aa, Artificial Sequence
  Synthetic
SRVEEVLKEIDKLIKEIKERVKRLIEESKRLNREDEERVRKVIEESKKTLEEIREVMERN

SEQ ID NO: 18734 - protein, 56 aa, Artificial Sequence
  Synthetic
KDLLREIERRLREMLKEIEERIRRSKREVEESAERSERLIRKSEEDSERVLRELRR

SEQ ID NO: 18735 - protein, 60 aa, Artificial Sequence
  Synthetic
DEVERILERIEELLRKIRKDVEEAIKDSERLNKDDLKRVRDAVETLRELIRRIEEEVRRR

SEQ ID NO: 18736 - protein, 56 aa, Artificial Sequence
  Synthetic
KDLARDIDEKVRRLLEDIRRLVEESEKKVDESTEESRRLVTELERELREVLKRIRD

SEQ ID NO: 18737 - protein, 57 aa, Artificial Sequence
  Synthetic
SRVDELVKEAEDLLEEAKKANAESIRRIEELLKRVAEEIRRLSEEDKKLVEEVRKRV

SEQ ID NO: 18738 - protein, 59 aa, Artificial Sequence
  Synthetic
KRAEDKLRRVEEDARRVLEDLKRTLKRLEEEVRRVLEEARDILRKNAEENRKVLEDLRR

SEQ ID NO: 18739 - protein, 57 aa, Artificial Sequence
  Synthetic
SRVEELVEELKRLLRTVEKENEDSIREIERLLREVKRRNEESSREDEKTIRTVRREV

SEQ ID NO: 18740 - protein, 59 aa, Artificial Sequence
  Synthetic
KRAEEILERLRKEAEEVLKKLEDTLRELRKRAEKVLRDMEETLKKNKKDNEKVLRDLRK

SEQ ID NO: 18741 - protein, 57 aa, Artificial Sequence
  Synthetic
SEVDKIIKEIEDLLDEARKTNEKSSRDDKRLVEEVKELNKESSERNKRLVKEAREKI

SEQ ID NO: 18742 - protein, 59 aa, Artificial Sequence
  Synthetic
KRAEDKIRRIAKDAEDVLRTMEKTLRDNERENREVLKELEKTLRENEKENEKVLRDLKR

SEQ ID NO: 18743 - protein, 56 aa, Artificial Sequence
  Synthetic
EEIERVEEKVRRLIKELEDELRKIEERIERLLRRSRERNKEISDRNRRLLEEMRRS

SEQ ID NO: 18744 - protein, 56 aa, Artificial Sequence
  Synthetic
EEKARELEEELRRAVERVDRKIEELEERLDRVLKESRDTVDENEKRNEKVLRELET

SEQ ID NO: 18745 - protein, 56 aa, Artificial Sequence
  Synthetic
KEIEDVVETVRRLLRTSEELNERISRDNEKLLRDSEKLNREISERNRKLLKDLKDS

SEQ ID NO: 18746 - protein, 56 aa, Artificial Sequence
  Synthetic
EEAARDLARKLKEVHDRSRETIKRNEDKNRRVLEESKKTARENEERNKRVLDELRK

SEQ ID NO: 18747 - protein, 60 aa, Artificial Sequence
  Synthetic
SEEDRVLEDVERLLRELKKETDRIAEKNKKLNEDVTRETEEIVRRVRELLERLLDLVRKV

SEQ ID NO: 18748 - protein, 56 aa, Artificial Sequence
  Synthetic
SEKAREVEREVRRIREEDERILRELEERNRENKKRDEDILKELEDRAERVLEEIKR

SEQ ID NO: 18749 - protein, 60 aa, Artificial Sequence
  Synthetic
SEEDRVLKEAKDLLEEIERELDEVAERNKELNKRLTDETRKIERRVRELLRELKDKVRKV

SEQ ID NO: 18750 - protein, 56 aa, Artificial Sequence
  Synthetic
SRKLEKLEKEVREVEKRIRDILKKLEDDNRANRKRDEDIIDELRKEADRVREEIKR

SEQ ID NO: 18751 - protein, 59 aa, Artificial Sequence
  Synthetic
SEVEELVRRVEKSNRDIEEMVKKIDKRNRDLLRKIEKDLREADRRNEELLREIDDLVRR

SEQ ID NO: 18752 - protein, 56 aa, Artificial Sequence
  Synthetic
EKLLKEVEDRNRESAKEVKRLADENRKANEELKRRVEKLVRDNRRKNEELKKKVKD

SEQ ID NO: 18753 - protein, 59 aa, Artificial Sequence
  Synthetic
REVEELLKEIRKRIEDVRRRVEEIDRRNRKLLKEVEERLEKVRREVEKSNTDIKELAER

SEQ ID NO: 18754 - protein, 56 aa, Artificial Sequence
  Synthetic
EDLLRRVREEIERVIREVKRLLEENKKRNDEVRKRVEDIVRRLEEHHRELKRRVEK

SEQ ID NO: 18755 - protein, 56 aa, Artificial Sequence
  Synthetic
KDIEDILKESEKTNREILKRAEDASEENERINKRITDRVDRVRKEIERLLEELTRR

SEQ ID NO: 18756 - protein, 56 aa, Artificial Sequence
  Synthetic
KKLVDELRRRVEETLKRLRKLIADNREKNKDNLRRIEEEVKKLEEEIKKIKDEMKR

SEQ ID NO: 18757 - protein, 56 aa, Artificial Sequence
  Synthetic
KELEDIARESEKTNRDIKRRVDEVRKTIEDLLRRIDEEVKRAAEESKDTNRRIREE

SEQ ID NO: 18758 - protein, 56 aa, Artificial Sequence
  Synthetic
EDLMRKLKREVEETDKEIKDIIRRLKEEIEKIKRKIEEIIKKLKKENEDTRREADK

SEQ ID NO: 18759 - protein, 56 aa, Artificial Sequence
  Synthetic
SDIDDILRESRKINKEINDTVTEMMKRSKKTNDEIREKVKEVREESEKTNEEIRRE

SEQ ID NO: 18760 - protein, 56 aa, Artificial Sequence
  Synthetic
EKLVKELEDELRKSEERARRIIERLKEELKKTRKEIEDIIRELRKKLEDTLRDVEK

SEQ ID NO: 18761 - protein, 56 aa, Artificial Sequence
  Synthetic
SDIEKILRESKDINRRINERVDRVVERSKKTNEDILKKVKDAAEESKKTNDDIRKS

SEQ ID NO: 18762 - protein, 56 aa, Artificial Sequence
  Synthetic
EELVRELRRLVEESLKRIEKIIKDLEELIKETKRRLEEIIERLEKKNEDTEREARK

SEQ ID NO: 18763 - protein, 56 aa, Artificial Sequence
  Synthetic
DEIREIVKESKRINEEINRKVEEVVRRSEKTNEDIRDTVRRLVRESDETNRRIEES

SEQ ID NO: 18764 - protein, 56 aa, Artificial Sequence
  Synthetic
EDLVRELRKEVKRSEDRIRKIIRDLDELNRRSKEDIKRKIDELRKRVEETKRRVTK

SEQ ID NO: 18765 - protein, 56 aa, Artificial Sequence
  Synthetic
DDIEEILKDVKRLLDEILAKVKKASDDNKRILDEIERKVEEMVRRSEKTNEDIRRS

SEQ ID NO: 18766 - protein, 56 aa, Artificial Sequence
  Synthetic
EELVRELKKRVDEIKERARRLIEENRERNKEIKERAERIIERLRKINEDTKREAEK

SEQ ID NO: 18767 - protein, 56 aa, Artificial Sequence
  Synthetic
DEIEDIVRRVKKLIRDLEERVKKLEEDSDRTNERIRREAEKASKRNKEILDKLRKS

SEQ ID NO: 18768 - protein, 56 aa, Artificial Sequence
  Synthetic
EELVKELRKELEEVKEEIRKIIEELKRRNDKSRRDLERLIRDNEDKNRRLKKEAED

SEQ ID NO: 18769 - protein, 56 aa, Artificial Sequence
  Synthetic
EEIERIIRESEKINKEINRTVKEVEKRSEETNRRIREELKRISKRNKEILDRLRKE

SEQ ID NO: 18770 - protein, 56 aa, Artificial Sequence
  Synthetic
EKEVEKLKRKVEKSEEDIRRIIEKLREENKRSEEEVRRLITENEKRNRKLLEEAKK

SEQ ID NO: 18771 - protein, 56 aa, Artificial Sequence
  Synthetic
SELEKIAEDSERINKEINERVKRISDENKRILEEIEKAVEEASRDNKRILDELRKS

SEQ ID NO: 18772 - protein, 56 aa, Artificial Sequence
  Synthetic
EELVRELERRVDESRKRAEDLIRDNKKKNDEARRRVEELIRRNREENRRIAEEARK

SEQ ID NO: 18773 - protein, 60 aa, Artificial Sequence
  Synthetic
SDAERIMRESEELNERINDVVRRVAEESKRLNDRINDVLREVSKRNKDLIKRIKEVVDRN

SEQ ID NO: 18774 - protein, 56 aa, Artificial Sequence
  Synthetic
ERIIERLDRLTKKSLEELKRIIEDLKRRTKESEDRARELIKRNREENKRLLEEAEK

SEQ ID NO: 18775 - protein, 60 aa, Artificial Sequence
  Synthetic
DEAERIREESEELNERINREVDKMIDEDRKLNEDIRRTVEEMVREIKELLDRIRKVLEEN

SEQ ID NO: 18776 - protein, 56 aa, Artificial Sequence
  Synthetic
KEIIKELRETTERSRKRLEELIRDSEEKNRRTEDELEKIIRELDERLRRLEEEARK

SEQ ID NO: 18777 - protein, 60 aa, Artificial Sequence
  Synthetic
DEAEDIARKSRELNERILRRVKEMIDEDRDLNREIEKTLRRVSERNRELVEEIKREVERN

SEQ ID NO: 18778 - protein, 56 aa, Artificial Sequence
  Synthetic
ERIIEELRRLTEDTKRRADKLIKDSEDENRKTLRRARELIEENRDRNRKLEEDVRR

SEQ ID NO: 18779 - protein, 60 aa, Artificial Sequence
  Synthetic
DEVREIVKRSDDLNDTIREVLKRVADDSRRLNEEIRRKVTEASRENEELIKEIEDRARKN

SEQ ID NO: 18780 - protein, 56 aa, Artificial Sequence
  Synthetic
EEIIKRLRDRTKKTLDEVRKIIEDLKDESRKTSEELRELIKRNKEKNDELLERLER

SEQ ID NO: 18781 - protein, 60 aa, Artificial Sequence
  Synthetic
SEAEKIERESRDLNRRIREVVERASEDNERLIREIRKRLEEVVRTIEKLIRDILERVRKN

SEQ ID NO: 18782 - protein, 56 aa, Artificial Sequence
  Synthetic
EEIIKELKKITDKTRRELERLIDENRKRNEELLKRVEDIIRELKRRLEKLDEEVKR

SEQ ID NO: 18783 - protein, 60 aa, Artificial Sequence
  Synthetic
SEVERIEKESRDLNREIKEEAKRASEDNRRLLEDIRRKLEKVSEENKDLLRKIEEEMRRN

SEQ ID NO: 18784 - protein, 56 aa, Artificial Sequence
  Synthetic
EEIIKKLKRLTDETEKELEKLIRKNEKENRDLEREIRRLIKENRDRNRELKKRAED

SEQ ID NO: 18785 - protein, 60 aa, Artificial Sequence
  Synthetic
SEVEKAVREIEELIKRIEDRLREMARRVEETNKTLLRDVERLSKENEELVREIKERVREN

SEQ ID NO: 18786 - protein, 56 aa, Artificial Sequence
  Synthetic
EELVRELERKIKTVLDRVEEIIRRLDKKTKDTVRRVRELIEDNKRKNKKILDEVRK

SEQ ID NO: 18787 - protein, 60 aa, Artificial Sequence
  Synthetic
SEVERIVKESEELNEKITRDLEEAEKEVRKTNDEIRRVVEEMSRRNEKLIRDIDDEVRKR

SEQ ID NO: 18788 - protein, 56 aa, Artificial Sequence
  Synthetic
DEIIKELEKKTRDNLDKVRKIIERLRRETDKTEKELRDIIRKNEDENRKLEEKVRR

SEQ ID NO: 18789 - protein, 60 aa, Artificial Sequence
  Synthetic
SKVEKLAKEVEETNRRILDEVRRASEENKDLVRRIEETVKRAVEEIKRLIEKIDDVVTKN

SEQ ID NO: 18790 - protein, 56 aa, Artificial Sequence
  Synthetic
EEIIKELRKRSEDSEREARKLIRRNEEENEKLRKKLKEIIDRLREELEKVLDRVRK

SEQ ID NO: 18791 - protein, 61 aa, Artificial Sequence
  Synthetic
SEVERAAEESKRLNKTIRDENREVLREIRDLIRRMKEENRRMVKRVDEVLKEIRELFRRDK

SEQ ID NO: 18792 - protein, 59 aa, Artificial Sequence
  Synthetic
EKVREILERLERESRKTAKELDESNREAEELLKRVADEAKKSNETLRERLERLAREAEK

SEQ ID NO: 18793 - protein, 61 aa, Artificial Sequence
  Synthetic
SELEELIRKIEELIRRIEEENKEMVRRSRKLNEDLERRLDEVRRRVEKLIREIEELLKRDK

SEQ ID NO: 18794 - protein, 59 aa, Artificial Sequence
  Synthetic
ERAKRLLDELKRLIKELEDKLRESNEELKRRSDDSARKAEKILRELKKKVDEMADRARK

SEQ ID NO: 18795 - protein, 60 aa, Artificial Sequence
  Synthetic
DEAEKLAEDVRRVIKRIREDNKRLSDRNKELLEEVEKDNKKSEEDVKRVIEDIERRVREL

SEQ ID NO: 18796 - protein, 56 aa, Artificial Sequence
  Synthetic
RELLDELRRRIEELRKRLEDSNRENEEELRKIADKVRKTNKRLNEEVEDMFRRAKT

SEQ ID NO: 18797 - protein, 57 aa, Artificial Sequence
  Synthetic
DEARELLRDDERLNRELNDLDRDSSKKDEDLNRKLNEDDKESVERADTLLERIKREV

SEQ ID NO: 18798 - protein, 56 aa, Artificial Sequence
  Synthetic
RELIRELEERNRDSVRKSRKSNEDNERTNRESIERSRRSNEELRRRAEELIKDLRR

SEQ ID NO: 18799 - protein, 57 aa, Artificial Sequence
  Synthetic
SEVEELLERDKDLNRRVNELNEKTSREDEKLNDEINKRIDRLVERARELLERIRREV

SEQ ID NO: 18800 - protein, 56 aa, Artificial Sequence
  Synthetic
ERLIRELEERNRESVERVRRSLKENEDRNRESKKRLEDLLREVKRLMDKLEEDLRK

SEQ ID NO: 18801 - protein, 57 aa, Artificial Sequence
  Synthetic
SEVEELLERDKRLNDEANRLNRELVERDKRLNEELNKELKRMADEIKRLLEEIRRKV

SEQ ID NO: 18802 - protein, 56 aa, Artificial Sequence
  Synthetic
ERLIEKLERENRESEKRARDSNKELEKRNRESEDRARRILKKLEDDVRRLKKELET

SEQ ID NO: 18803 - protein, 60 aa, Artificial Sequence
  Synthetic
SELEKVRTDVERVIRELEKELKEIDEENKKVNKDVEEEVKRIEEENKEMNDRLDDLRRRG

SEQ ID NO: 18804 - protein, 56 aa, Artificial Sequence
  Synthetic
SKEMEEVREELERLLRRIKKILEELRDENRKSLERLEDVLRRLEKRNRDTLEEVKR

SEQ ID NO: 18805 - protein, 60 aa, Artificial Sequence
  Synthetic
KETEDVERDVERVIREIDTKLKEIEKKNDKANKELEEKLKKIEEDNKRVNERLKRLREEG

SEQ ID NO: 18806 - protein, 56 aa, Artificial Sequence
  Synthetic
SEEMRRVREEAKRLLDKVKKILRDLERRNEEVLKKIKDIMRRLEKRNRDTLEEIRT

SEQ ID NO: 18807 - protein, 60 aa, Artificial Sequence
  Synthetic
SEEEKVLEEVKRAIDELKKELEEVEERNKRVNDDIRRLTDEIRKENKTANDRLRKLLEEG

SEQ ID NO: 18808 - protein, 56 aa, Artificial Sequence
  Synthetic
SKKLEEVRKEVKRLKDEVEKILKDLRKRNKDLLEEDKRVLDRLRETNEKTLDDVRR

SEQ ID NO: 18809 - protein, 61 aa, Artificial Sequence
  Synthetic
KEEEDITRRIDKILRDLREKLRDVNRRVEELSKRLHDKLEKVLKRIKDEAERLRKEIREKL

SEQ ID NO: 18810 - protein, 55 aa, Artificial Sequence
  Synthetic
KELEDKVEKDARDVERHIRKDLTDVRRRHEDLDRKIKELLDRVRKAIRDVEEKIK

SEQ ID NO: 18811 - protein, 61 aa, Artificial Sequence
  Synthetic
SKAEELLRRVEELLKRVKDKVDDIVRKIEKSNRDLERRDEEVLREVEETNRRLEEELRRRG

SEQ ID NO: 18812 - protein, 55 aa, Artificial Sequence
  Synthetic
EEVLRRLEELIRRAERKLEKMLEDLTRLNKEWEDRTRKLLEDLRRINEEIKRKIK

SEQ ID NO: 18813 - protein, 61 aa, Artificial Sequence
  Synthetic
SEKDELLRDVRRLLKEVEKELEEIRRRVTESNRELEKLVREVLEESKRSDDKLREDLERAG

SEQ ID NO: 18814 - protein, 55 aa, Artificial Sequence
  Synthetic
KDLLERLKELIKRLKDKLKEIADRLRRINEDIERKIREILEDSRRFNEEIKKKID

SEQ ID NO: 18815 - protein, 58 aa, Artificial Sequence
  Synthetic
STLETLEDEVRKIVTDIERVIRESNKHLKKSIDDVERVIEEIERRAREIVKKVRDVIS

SEQ ID NO: 18816 - protein, 58 aa, Artificial Sequence
  Synthetic
EKLERILREIKRIVEDLKKKVEDSLKRYEEELERLKEDLRRLLKRIRDEVEELKKESD

SEQ ID NO: 18817 - protein, 59 aa, Artificial Sequence
  Synthetic
DEEEKLRDEVEKIVKKIEKAIEDLRRHAEKSVTDIRKVLKELEDHIRESVKDAERFISE

SEQ ID NO: 18818 - protein, 58 aa, Artificial Sequence
  Synthetic
EKLEKILREIERIVEKLKEDLDRLLKRYEDELRRLKEELERILDTYRRLLEELERRLR

SEQ ID NO: 18819 - protein, 58 aa, Artificial Sequence
  Synthetic
DTARELEREVKKIVDEIEDVIRRLRRHIEESVKRAEKVLREIEKHARESAKRIADVVS

SEQ ID NO: 18820 - protein, 58 aa, Artificial Sequence
  Synthetic
EELKEILERIEEIVKRLEEELRRLLEEYKKRIEELAKRIKEVLDEYRKILKRLEDETK

SEQ ID NO: 18821 - protein, 60 aa, Artificial Sequence
  Synthetic
DEAEELRKDVKRVLDEIKKRHEELLRKVREDLDRIRRKLEELAKRHRELLKEVKKIVDRD

SEQ ID NO: 18822 - protein, 56 aa, Artificial Sequence
  Synthetic
DKIRREIDELIKKLEEESRRIEEEIKKLVEDLKREADKIMEELERETDKLKKELDK

SEQ ID NO: 18823 - protein, 57 aa, Artificial Sequence
  Synthetic
SEKEKILEEIREVLKRILDRLKKELEDDKKSLDDNKRRTEEALREDKKSLEEIRRAN

SEQ ID NO: 18824 - protein, 56 aa, Artificial Sequence
  Synthetic
DKILRDLEKALDKLRRDIEEILKRSRDLNKKLEDDNREALRRSEELNRELEERERK

SEQ ID NO: 18825 - protein, 57 aa, Artificial Sequence
  Synthetic
SEEERIRREIKKILDDIKEEAERRLEEDKKSLDENRKKTEEVLKKIRDDLKRIEEAK

SEQ ID NO: 18826 - protein, 56 aa, Artificial Sequence
  Synthetic
DEILRRIEKLIEDLKRTIDKILEDSERLNRKLEKENREALKELRDLLRELEERLKK

SEQ ID NO: 18827 - protein, 56 aa, Artificial Sequence
  Synthetic
EELERILRKITEMLREIARKLKKLLEDDKESLDRNKEKTEDDLRRDKESLDRLRKS

SEQ ID NO: 18828 - protein, 56 aa, Artificial Sequence
  Synthetic
DKILRDLEELLKDLERKIRRILDESRKLNDELRKENKKAEDTSRRLNEELEERLRT

SEQ ID NO: 18829 - protein, 56 aa, Artificial Sequence
  Synthetic
SELEEILKRVEDVLRDILRKLKEVLDRAEKVIRDNKRKTKKMLDDDKRSLDEIRKA

SEQ ID NO: 18830 - protein, 56 aa, Artificial Sequence
  Synthetic
DKILRELEKRLEDLRKRIKDILDDLKRKLEELKRENEKFLRRSKKLNEDLERELET

SEQ ID NO: 18831 - protein, 56 aa, Artificial Sequence
  Synthetic
DELEEIRDRIKRKLEKLKEETKRTLEEDRKSLDDNRRKTEEALRRDRESLERIERA

SEQ ID NO: 18832 - protein, 56 aa, Artificial Sequence
  Synthetic
RDILEELTRLLDKLRRDHERVSEESKRRNDELEEENRRVLKESEDRNRELEERLRQ

SEQ ID NO: 18833 - protein, 55 aa, Artificial Sequence
  Synthetic
SELEKLLDDVKKDLKRIEEHLRRDEEDSKRRIEELERHLERDKKEVEKAIRELDK

SEQ ID NO: 18834 - protein, 56 aa, Artificial Sequence
  Synthetic
EKVVRTIEKLLTDLERKIREIEKRSKELLTRLEEKIKKAERESRKLLRELTERIDR

SEQ ID NO: 18835 - protein, 61 aa, Artificial Sequence
  Synthetic
DELKKLLDDVREVSKRLNDELRKIMEEIRKVSEDLNKELDDIVRKIKKVIDDISEKIKRDG

SEQ ID NO: 18836 - protein, 55 aa, Artificial Sequence
  Synthetic
EEIEKEIRELLKENRRRADEIRRRAEKSLKDNERRVEKVEREAERLLREIEKELK

SEQ ID NO: 18837 - protein, 61 aa, Artificial Sequence
  Synthetic
SELEKLAEDVKRKLTEIREKIKKLLKETRDVSRELNKELEDLLRRTTEVIDEIRKKIEKEG

SEQ ID NO: 18838 - protein, 55 aa, Artificial Sequence
  Synthetic
EDIKKEIEDLLRDLERLLRDVNREVEELLKENRKRLEEINRTVERLLEEIEKRLR

SEQ ID NO: 18839 - protein, 61 aa, Artificial Sequence
  Synthetic
SELEELVRRLREVSKRLNEELDRILDRTRRLAERISEDIKRLADETKEVIERIKEEIKKKG

SEQ ID NO: 18840 - protein, 55 aa, Artificial Sequence
  Synthetic
EEIEKEARELLRDNRRRIEEINREVEELIRRLEKLLKEVNETVKRLLEEIRKDLD

SEQ ID NO: 18841 - protein, 61 aa, Artificial Sequence
  Synthetic
SELEKLMKDVKEVIDEIRKKLRKILEDTTRVAKRNEEKLKRIADEAEKVIREIRDEIEKKG

SEQ ID NO: 18842 - protein, 55 aa, Artificial Sequence
  Synthetic
EEIKKRIDDLLRRIEKEIEEINRRVEELHKRLEDLHKEIEDKVRELLTRIEERLK

SEQ ID NO: 18843 - protein, 56 aa, Artificial Sequence
  Synthetic
SEVEEILERIERLIRDDNRKLKDVERRNRENIKEDNERLKRMMEELKKIADEIRKA

SEQ ID NO: 18844 - protein, 55 aa, Artificial Sequence
  Synthetic
DSIRRTVEKLLEDNRRRNEEILKESEDLLRKNREKTKEIVERAERLLDKLRRERK

SEQ ID NO: 18845 - protein, 57 aa, Artificial Sequence
  Synthetic
DEAEELKERIERLSRRIDEEYRRLLEDYERLLRELEKKIEDLKRELEKLVEELRREG

SEQ ID NO: 18846 - protein, 55 aa, Artificial Sequence
  Synthetic
EELKEKVKEIVKRSEEDIRRLKKHLDESIRTAEEVIRRLREKIKRIIDTVRDAKR

SEQ ID NO: 18847 - protein, 57 aa, Artificial Sequence
  Synthetic
SELEELEKRIRRLSEEIKKLLDDLRREYEELVKELRRRLEELRKEIERLSEELKAEG

SEQ ID NO: 18848 - protein, 55 aa, Artificial Sequence
  Synthetic
DEMREKVDEIVKRSRDVIKELREHIEESIRRAEKVLRDLEREVRKIIEDARERTR

SEQ ID NO: 18849 - protein, 56 aa, Artificial Sequence
  Synthetic
REVDELRKEIERLSRKIEDDLKKLEDRYEELLEKLERDLEKLKEDYDRLLRKLEED

SEQ ID NO: 18850 - protein, 55 aa, Artificial Sequence
  Synthetic
EKAEEDVRRTVTESKKVIDELREHIKKSIREVEEAIKRLREHVERSIRRAEEATK

SEQ ID NO: 18851 - protein, 60 aa, Artificial Sequence
  Synthetic
SEEEKLDEDLERLREEIRELHRELEELIKKLREEVRRIIEKVRTHLKRDRDRAKEVIEKV

SEQ ID NO: 18852 - protein, 55 aa, Artificial Sequence
  Synthetic
ERMREKLEKIKKDVDKLSKELHDKLDKVLKEIEELLRDVKRAIKKVNDDIKERLR

SEQ ID NO: 18853 - protein, 61 aa, Artificial Sequence
  Synthetic
DEIRELVRRFEELVRRNVEHLKKLLRDAEKLVKENEKHLEDLLREIEETVKRLLDKIRREG

SEQ ID NO: 18854 - protein, 59 aa, Artificial Sequence
  Synthetic
KDKARDVEKRIEDLNREIKEIIRRVEERLKELNKRIEKLLEEVRDTLRRLKEELDRAMT

SEQ ID NO: 18855 - protein, 61 aa, Artificial Sequence
  Synthetic
SEIEELLKEVERRVRENKKHLKRLLEDIKRLVERNAEDLERILRDAERIVRELIKKIRRDG

SEQ ID NO: 18856 - protein, 59 aa, Artificial Sequence
  Synthetic
KDKLRRIEKALEDLNREIEEILRRVKEEIERLNREIEELLKRVEEELKRLEKELEEELK

SEQ ID NO: 18857 - protein, 61 aa, Artificial Sequence
  Synthetic
SEIEELLKEVRKRVKENAEDLKRLLDEAKKLADDNVKHIEDLIREVEDIIRRLKERIKRTG

SEQ ID NO: 18858 - protein, 59 aa, Artificial Sequence
  Synthetic
KDKARRLREELRKLNEDIERLLKRVEDELRKLNKKIKDILEEVEEVLERLLRELREEER

SEQ ID NO: 18859 - protein, 63 aa, Artificial Sequence
  Synthetic
REKEELKKELKKLIEELKRSHDELKEELKRLLKRIEDILRENRKTTEDLSRELKKLLEELRKK

SEQ ID NO: 18860 - protein, 59 aa, Artificial Sequence
  Synthetic
REELKRLLEELRRMIKELKDRNRKALEELEKVIREIEEEIKDINRRLREEIRRLEEEAR

SEQ ID NO: 18861 - protein, 63 aa, Artificial Sequence
  Synthetic
SKEEELRETLKRLVDEIRRMLEEDRRSDEELVRRIERVLEEDKREDDRLHKRLRDELRRLRKD

SEQ ID NO: 18862 - protein, 59 aa, Artificial Sequence
  Synthetic
EDELRRLLRELEEMAKKLEKELRDNNRDLRRVAEELKELIDDNTRKLKEVIEKLEREIK

SEQ ID NO: 18863 - protein, 63 aa, Artificial Sequence
  Synthetic
SEKETVRDELRKLVETIRKLLEEDKESDKRLADRIRELNEENKEDTERLIRELEKVLEELRKK

SEQ ID NO: 18864 - protein, 59 aa, Artificial Sequence
  Synthetic
EERLRKLLERLERVIRDLLRKIEENNKRLRKAIKELLDELRKINKELREVIKKLLDDAR

SEQ ID NO: 18865 - protein, 63 aa, Artificial Sequence
  Synthetic
SEKERLKEELEKLSKEIEDILRDDKRSDDELRRRLRELLEKDRREDERLNEELKRMLEEARKR

SEQ ID NO: 18866 - protein, 59 aa, Artificial Sequence
  Synthetic
EELLRRLLEKLKRMAEKLKRDIEDNNRKLRKVATELAKEIEDNSEKLREDAKRLSEKIK

SEQ ID NO: 18867 - protein, 63 aa, Artificial Sequence
  Synthetic
DEEEELRKRLEKLSKEVRELLRRDEEEDRRLNRELEELLKDHERTVRDLSREVEDLLRKARRK

SEQ ID NO: 18868 - protein, 59 aa, Artificial Sequence
  Synthetic
EDELRELLRRLEDVIRKLAEDLKRNTEDLRRVIKELAERLEELNKRLKREIRRLKEELR

SEQ ID NO: 18869 - protein, 60 aa, Artificial Sequence
  Synthetic
EKSERLRERLRDLLRKHKELLDRNEKTLEEAERRVEKLLEDNERELKKIEDEVRELLKRL

SEQ ID NO: 18870 - protein, 55 aa, Artificial Sequence
  Synthetic
KEILREIEERFKRLAEDLKRSNDKVRELVDKAEKDIRKSNEELRKLARDVRERVR

SEQ ID NO: 18871 - protein, 60 aa, Artificial Sequence
  Synthetic
SDEDRLRELLRKLREDHERIVRELRKRLEEVLREIERLLKKNEEDLERIRREVEELLKRI

SEQ ID NO: 18872 - protein, 55 aa, Artificial Sequence
  Synthetic
EDIEREIRDTLRRLREDLERIKEDVERLRREIKKRIEDSNRKVRDLLRRVKEAVR

SEQ ID NO: 18873 - protein, 60 aa, Artificial Sequence
  Synthetic
DEERKLEKSLKDVEDTHRRLLEKNDEDLKELRKRVEDMLRRLEDALRRILEDIEEKLKRI

SEQ ID NO: 18874 - protein, 55 aa, Artificial Sequence
  Synthetic
EKILREVEDLLRKVAEDLKRSNDEVKELAERLEETIRDLLRRIEEILKEIEERVR

SEQ ID NO: 18875 - protein, 60 aa, Artificial Sequence
  Synthetic
KDEERLKRFLEDIRRRHRELLERNERALDEIRRRHEELLRRNEEAIKDIERRVRELLKRL

SEQ ID NO: 18876 - protein, 55 aa, Artificial Sequence
  Synthetic
EEILKEIEELLRRLEENLRRNHKEVRELLEKVRRNIEENHREVRRLLEEVERRAR

SEQ ID NO: 18877 - protein, 60 aa, Artificial Sequence
  Synthetic
DEEETLEDVLRELEERVEKLLRDLTRDLERVEKEHKELLKRNKEAIDEIEKRIEELLKRI

SEQ ID NO: 18878 - protein, 55 aa, Artificial Sequence
  Synthetic
DEILRKIEELLRRAEEVIRDLERKVRKLERDIRENIKKNHREVREILRKIEEDVR

SEQ ID NO: 18879 - protein, 57 aa, Artificial Sequence
  Synthetic
KDEERLRELIKRINTEVKKSLDENKERLDKVEEDIRRSLKENEDRMERVRREVEKAN

SEQ ID NO: 18880 - protein, 56 aa, Artificial Sequence
  Synthetic
IEEIKKRLEDILEETRDMSRRLNEELRRILERVKEVSKELNRELEEILKRVEDARR

SEQ ID NO: 18881 - protein, 57 aa, Artificial Sequence
  Synthetic
SEKEDLERELEEVRRRVEESLRKNEEDVKRVRDELKKLLDENRKELERIRREVERAN

SEQ ID NO: 18882 - protein, 56 aa, Artificial Sequence
  Synthetic
MEEIKKEIEKILRDIERVSRELNKKLEEIVRRLKKVSDELNRRIEEIAERVRRRRK

SEQ ID NO: 18883 - protein, 56 aa, Artificial Sequence
  Synthetic
KDEERLDEELKRVNDEVRRLLARNEETLERIEREVKRLLDENEKRAEDIRKEVEDS

SEQ ID NO: 18884 - protein, 56 aa, Artificial Sequence
  Synthetic
IEEIEKTIREELKETRKVSEELNRELERILRELRKVSEELNKDLEKILRRVKKERK

SEQ ID NO: 18885 - protein, 56 aa, Artificial Sequence
  Synthetic
SEEERLREILKDINRRVEELLKENEERMERIREELEELLERLKEELERIRKRVEEE

SEQ ID NO: 18886 - protein, 56 aa, Artificial Sequence
  Synthetic
VEEIEKDIRRLLRETERVSEELNKKLEEIARELREMIKEIKERLKRILEEVEKRRR

SEQ ID NO: 18887 - protein, 56 aa, Artificial Sequence
  Synthetic
SEEDELRRLLKEVNERVERLLDEIRKELEKIAEELRDLLKKNEDKLREIKRRVEEN

SEQ ID NO: 18888 - protein, 56 aa, Artificial Sequence
  Synthetic
TEDIAREIRELMERTRRVIEEIKKELRDILEKLRRVSEELNKKLDEILKRIEDRTR

SEQ ID NO: 18889 - protein, 60 aa, Artificial Sequence
  Synthetic
REIEKLIRDYRRILRELSEKIRRLAEEHEDIVRKLIETLKRLIDEIRKIMEDLSRLLRRD

SEQ ID NO: 18890 - protein, 59 aa, Artificial Sequence
  Synthetic
KKLMDELRRVSEEVNTRLEKLLRDLEKKLRDSEERAKELIRRIEKTLEDIDRRLKEEEK

SEQ ID NO: 18891 - protein, 61 aa, Artificial Sequence
  Synthetic
RELEKLMEDAERYAKRSMEAFEDLIRKHDELLKRLEKKLRDLIKRIEKLLREIKEKIERTG

SEQ ID NO: 18892 - protein, 59 aa, Artificial Sequence
  Synthetic
EELLKRAKELIETIEERSKRVVDENKRVVERSRRRLKKLLEDIERVLERIERRLTEAKK

SEQ ID NO: 18893 - protein, 61 aa, Artificial Sequence
  Synthetic
SELEKLLEDIERYVKRSKEKARELIKRHKEYVRRSEERLRRLIEKLEKLAEKLKELIRRTG

SEQ ID NO: 18894 - protein, 59 aa, Artificial Sequence
  Synthetic
DSLLKEVEDLLRKVEEESRRVIEENKRVVEESRKRSERLLREIEKELRRVEKEFRDEKR

SEQ ID NO: 18895 - protein, 61 aa, Artificial Sequence
  Synthetic
SELEDLMRDVKRYADESARRIEEIIKRHRKLVREISKKIEELIRELRKLIERILELIRRDG

SEQ ID NO: 18896 - protein, 59 aa, Artificial Sequence
  Synthetic
EELLDRARKLIREIEERSKELSKRNKEEVDRSEERIRRLLKRAEEELRRVREELKEASR

SEQ ID NO: 18897 - protein, 56 aa, Artificial Sequence
  Synthetic
SREEEIRELLKRSKESLEKLLRELDKEHKESEKSARELLKRNEKRLREIREEIRRL

SEQ ID NO: 18898 - protein, 59 aa, Artificial Sequence
  Synthetic
EEVMKRLLKEIRDVNKEITERLEEHRKRLEEINRDVERIIRELNEEHKEVLKRIREKAK

SEQ ID NO: 18899 - protein, 60 aa, Artificial Sequence
  Synthetic
SEREELRKLLRRIEEEAKRLLEELKRTTDDTRRENEELLRRLEELSKETKKRVEDLLREL

SEQ ID NO: 18900 - protein, 56 aa, Artificial Sequence
  Synthetic
VKDVLKKLEDVLRELKKAVEKIKRDNKRAVDENRELVERIMKENKDAMKKLEEDVR

SEQ ID NO: 18901 - protein, 60 aa, Artificial Sequence
  Synthetic
SEREELRDLLRRIKEDAERLLKEHRDLLEEVRKEVEKLLRELRKLSKETEDEAERLLREL

SEQ ID NO: 18902 - protein, 56 aa, Artificial Sequence
  Synthetic
IKDVLKKLKEVLKKLRDDVEKSKRDTKRVLDRLRDTVRKIMEENRRALKEIADEVK

SEQ ID NO: 18903 - protein, 60 aa, Artificial Sequence
  Synthetic
DDEERLREEVERVERTVRDLLRRLRELTKKTDEDNRKLLKEHEDLLREVVKRVTDLLKDL

SEQ ID NO: 18904 - protein, 56 aa, Artificial Sequence
  Synthetic
VKDVLKEIKEVLREVTERAKEIADDNRRALEENEREVKRSKEDTKRALRKLEEEVK

SEQ ID NO: 18905 - protein, 56 aa, Artificial Sequence
  Synthetic
SSSEELEKLLEEVRRELRRLAEEVKRLNEEIDKDIDRLAEENDRLHKEVKKDLDRL

SEQ ID NO: 18906 - protein, 59 aa, Artificial Sequence
  Synthetic
EEVVKRILDEIRRTLEEIKEIARRYLEKNKKEMREIRETMKRDNDHLEDLLRKIRETAR

SEQ ID NO: 18907 - protein, 56 aa, Artificial Sequence
  Synthetic
SDEERIRKKLREIEERHKKLSEELKELLRRSEESVRRLLEKNRKDLDEVRKRIEDL

SEQ ID NO: 18908 - protein, 55 aa, Artificial Sequence
  Synthetic
EEVERRLDRLLDESRRLAEELKERIKRVNKRARELVRESEEHLRELLEKVERDAT

SEQ ID NO: 18909 - protein, 56 aa, Artificial Sequence
  Synthetic
SDKDELKTRLDRVREIIERLARESEELHKELKKRLEDLKRDSERLHRKNLEDIRRS

SEQ ID NO: 18910 - protein, 58 aa, Artificial Sequence
  Synthetic
EVTDRIREDIKRVIEEVRRLAEEDKESVKEILKKIEKLADEDRRSVEKNHKEVEDTRR

SEQ ID NO: 18911 - protein, 58 aa, Artificial Sequence
  Synthetic
RDEERAEELLKEIKDTVDELKKEVEKVLDESRKRDKKLNDELRKLLEDSRRTIERDVR

SEQ ID NO: 18912 - protein, 55 aa, Artificial Sequence
  Synthetic
DKLLEELRKILEELRKKVKDLIEEHRRLVKTSADRVKRLLDEHRRILKELKDRRK

SEQ ID NO: 18913 - protein, 61 aa, Artificial Sequence
  Synthetic
DEAEELIKRIEDLLRELARRMEEILRRHEEYVKKSAEDVKRLLEEVEKLADDLRREVERDG

SEQ ID NO: 18914 - protein, 59 aa, Artificial Sequence
  Synthetic
EEVARKIEEVLRRVKEELTKLVEENERKLRESRERSKKLAKEVEDLLREIKRRVEELER

SEQ ID NO: 18915 - protein, 56 aa, Artificial Sequence
  Synthetic
SERETLEELLERVERLLEKLKRELDEAHKKNKEDLDRLRDKNRKRLEDIKRTIDRI

SEQ ID NO: 18916 - protein, 55 aa, Artificial Sequence
  Synthetic
EELLKELKEVLERIRKEVEKLLRTLEEINKTTRKLVEETNEKADRILEKVKRDAK

SEQ ID NO: 18917 - protein, 56 aa, Artificial Sequence
  Synthetic
SEDEKMEELIKRSEDKLRKLEEDVRRLLEEIRRRAEDNTRRNERTLREIERTLREI

SEQ ID NO: 18918 - protein, 55 aa, Artificial Sequence
  Synthetic
EELVRELEKIDRETTEVVKKLLEELKDIMRRVHERSEESLREAKKILREVEERAR

SEQ ID NO: 18919 - protein, 60 aa, Artificial Sequence
  Synthetic
SEEEELDKLLKEVREKDERLKREVEELLRRIKKRLEELKRENDELLKEVREVLKKLAKET

SEQ ID NO: 18920 - protein, 56 aa, Artificial Sequence
  Synthetic
VEDVLRRIEEVARRIERLYEELLKKLRDVVREIEKRVREHNEDVKRVVREIEKRIK

SEQ ID NO: 18921 - protein, 56 aa, Artificial Sequence
  Synthetic
DEVEKVKEEIKRLNEDVRRLVEEYRKRLEKLNRDHRDYVKKSEKRIRDLIREVRRR

SEQ ID NO: 18922 - protein, 59 aa, Artificial Sequence
  Synthetic
EDATREIDKALEDHRESVERLVRELERLNEENRKSVKKSEEDSRRLLEEVRRELRRKRK

SEQ ID NO: 18923 - protein, 58 aa, Artificial Sequence
  Synthetic
DEEERVEELLRRDRESDKELRERLRKLNEENRDETEKLIRELEDSLRRLKEELEKKGK

SEQ ID NO: 18924 - protein, 55 aa, Artificial Sequence
  Synthetic
KELEKELRDNNRRLEEVIRRLEEELKRISEELRKVIKKLKRDNEEKLRRLDEATR

SEQ ID NO: 18925 - protein, 60 aa, Artificial Sequence
  Synthetic
DEEERVKDINRRNEEDSRRLERRIRELNRENRKSSKELADRVRELLKRAEERLRTEGKDK

SEQ ID NO: 18926 - protein, 55 aa, Artificial Sequence
  Synthetic
EELVKKLEDINRRLREAIKRLEDTIREINKELRKKIKELLDRLKEIVKRLEDRAR

SEQ ID NO: 18927 - protein, 58 aa, Artificial Sequence
  Synthetic
SAEERIKRINKKNRDDSEKLKRRIEESNRENKRSSDELVKRLEELLRKLEEDLKRKGK

SEQ ID NO: 18928 - protein, 55 aa, Artificial Sequence
  Synthetic
KELEKKLRKINEDLKRAIRKLEEDNKRANEELKKRAEDLLREIEEIIRRLEERTR

SEQ ID NO: 18929 - protein, 58 aa, Artificial Sequence
  Synthetic
DEERRAEEINRRNKKDSDRLAETIEKILKEDEDRDKELHDRLEEILKELRKRLEEEGK

SEQ ID NO: 18930 - protein, 55 aa, Artificial Sequence
  Synthetic
EELVKELEKINEELRRDIKRLIDEIRENTERLERMIRELEKKIRKILKELDDRAK

SEQ ID NO: 18931 - protein, 55 aa, Artificial Sequence
  Synthetic
DLEKELTDLMKKHAEENDRLRRRLEELLKRHAEENDRLRDRVRRINEEVEEILRR

SEQ ID NO: 18932 - protein, 59 aa, Artificial Sequence
  Synthetic
EDVIREALERIKRISDESKRTIDEVVKEIEKITKESRDLITKYERDVERSIEEAERRAT

SEQ ID NO: 18933 - protein, 60 aa, Artificial Sequence
  Synthetic
SLEERIRELLKRHEDLTRKLKKENDESLRRHRELTKKLRKELEELLKRAEDVLRDLEREG

SEQ ID NO: 18934 - protein, 59 aa, Artificial Sequence
  Synthetic
AREVDDLLRKIEDISKKSADRNRELNEELEDISRRSKEEMKKLLDELRRDVEEIKKRTK

SEQ ID NO: 18935 - protein, 60 aa, Artificial Sequence
  Synthetic
DLEDRIRRLLEESKKNLDELKRRNEESLKRSEDLLKDLKRKLDDLLRKAEEVLRELRKRG

SEQ ID NO: 18936 - protein, 59 aa, Artificial Sequence
  Synthetic
ARDVDRLLEDVKRISDTVHKRNEELNRRLREISERAREAVEDLLRRLEEIVRRIKTRTE

SEQ ID NO: 18937 - protein, 60 aa, Artificial Sequence
  Synthetic
EEIERILEKLRRDLEEVRKKVKKVLDELRELTEELKRKVEKVLRELKRLSEEIARRVEKG

SEQ ID NO: 18938 - protein, 55 aa, Artificial Sequence
  Synthetic
RELRTVAREIREELKKLREELDKLLREHRETSKELEKRLKEVLDRHRELSDRLRR

SEQ ID NO: 18939 - protein, 59 aa, Artificial Sequence
  Synthetic
DELREMIRKVREINERSKDEIRKILEAIKKIVEDHRRVVEKLLRDLKDIVRRARETRSR

SEQ ID NO: 18940 - protein, 59 aa, Artificial Sequence
  Synthetic
EEARKRLEDLSRENKRSLDELRKRIDDILDENRRAVEESRERAKRVLDEVRETLKRDEK

SEQ ID NO: 18941 - protein, 60 aa, Artificial Sequence
  Synthetic
SEVDEVEKRIREAIKRHRDRVKKIIDEIKKLLDDHRRRVKKLEDDLKKRADDVRKETKDG

SEQ ID NO: 18942 - protein, 59 aa, Artificial Sequence
  Synthetic
KEARDRIRELLKKYEDDLRRSEKEIEDILRRYERELRESEKRMREVLKRLEDELRRAEK

SEQ ID NO: 18943 - protein, 60 aa, Artificial Sequence
  Synthetic
DEVKEVEKKIRKVLREHKKLVEELIRKIKEMIDRHKEIVERIIRTIRRELKRAEELARKG

SEQ ID NO: 18944 - protein, 59 aa, Artificial Sequence
  Synthetic
EEMEKRIEDLLREYREELERSRRELERLLEEYEKVVDESRKRIKTILDEVEKLLRDLDR

SEQ ID NO: 18945 - protein, 56 aa, Artificial Sequence
  Synthetic
SSRERFKELSDRNKEVVERSRRRLEKLLEENKREVEKSKKRIEDMLRKADDLLRKL

SEQ ID NO: 18946 - protein, 55 aa, Artificial Sequence
  Synthetic
ERLSEEIKRLIETHEKLLRELEKKIRDLIRKHREDVERIIKEIDKLLKKIDEDTR

SEQ ID NO: 18947 - protein, 57 aa, Artificial Sequence
  Synthetic
SEEETLDELNRENEELLRRSKERLDRSHEKLKKILDDISERVKELLKRAEKLLRDEN

SEQ ID NO: 18948 - protein, 56 aa, Artificial Sequence
  Synthetic
KDRVSDRIRRLLEEHERVVRELLESNDRMAERLRRVAEELVKEIKKELDDLRRRTT

SEQ ID NO: 18949 - protein, 56 aa, Artificial Sequence
  Synthetic
SEEETLERLLRKNEEELKKSKERLKELNRTNRKELRDSERRIKRALEEVEDLIRRE

SEQ ID NO: 18950 - protein, 56 aa, Artificial Sequence
  Synthetic
KDEVTKTIERIIEEHRRMIEELIKEIRKLIKEHRDKVRELLKRIKDILRRLKEERR

SEQ ID NO: 18951 - protein, 61 aa, Artificial Sequence
  Synthetic
SLDERIDELRRTLEEMLDRIRRSNEEVLRDSRRVLEEIDERARRVVEEAEKLLREIDKRKG

SEQ ID NO: 18952 - protein, 59 aa, Artificial Sequence
  Synthetic
EEDIKRLLEKVREIIEELKRRNDELNKRIKDLSEEMRRRVKKLLDEIKEDLERIKRRAD

SEQ ID NO: 18953 - protein, 61 aa, Artificial Sequence
  Synthetic
SLEEEIKELIKRAEEVLERLARSNKEVLDRSRKVLKELRETNKRLLEELKRALDKIRKDKG

SEQ ID NO: 18954 - protein, 59 aa, Artificial Sequence
  Synthetic
EEDIKRLLEEVERIIRKLAEENKKLNKEIEDLSRRARERNERLLREVEKIIRDIRERAR

SEQ ID NO: 18955 - protein, 58 aa, Artificial Sequence
  Synthetic
SEVEELTKKAKKIIEDHRRYVEKSARDVERLIREHERYVEESAKKVEKLLREIKELDK

SEQ ID NO: 18956 - protein, 56 aa, Artificial Sequence
  Synthetic
KDKIRELERENEEVIKESRERSERLARKNKKVLEDSERRSRELSERVERLLDESRR

SEQ ID NO: 18957 - protein, 56 aa, Artificial Sequence
  Synthetic
REEDVLRKLEKEIRDLLERIKRKSEELIERNKRTNDDIRRRSKETIDELRELTKRV

SEQ ID NO: 18958 - protein, 56 aa, Artificial Sequence
  Synthetic
DEDIRREAERLLREMEKRAKENEEDVRRNLKRLRDALKEHKEKVEKLLEEIKKDAK

SEQ ID NO: 18959 - protein, 56 aa, Artificial Sequence
  Synthetic
SETDDIIRRIRRLIEELLRNSKRTSDDNRRTLEELERNSERAIKKIKDVLEKLSRD

SEQ ID NO: 18960 - protein, 55 aa, Artificial Sequence
  Synthetic
EKAEKIRKELEDMARESRKLMRENKREVDRVEKKSRKLLKDILDEIDKVDEDEKR

SEQ ID NO: 18961 - protein, 57 aa, Artificial Sequence
  Synthetic
SEAERIAREVERVLREIEEEVKRLSEENRELVERIERESRKSIEDIERRLEEVKRKV

SEQ ID NO: 18962 - protein, 56 aa, Artificial Sequence
  Synthetic
RRLLEALRREVEEVLKRIRETLEENRRRNEEVLRRDKELLERIRDKIRRVLEELKR

SEQ ID NO: 18963 - protein, 60 aa, Artificial Sequence
  Synthetic
DEERELRKLERELEDVVRKDRKILEDLRRTLDTVRREDERILRELEETLKEVVKRVREKG

SEQ ID NO: 18964 - protein, 56 aa, Artificial Sequence
  Synthetic
IRRISEEAKELLKRWEDESRKVEEEHRRSLEEWRERSERIAREHKKSLEKLEKDVE

SEQ ID NO: 18965 - protein, 56 aa, Artificial Sequence
  Synthetic
SIEELLKKLEEDIERVLRKSEELLKRNEEENKKVLDESKRLLDELKKRAEKVLREL

SEQ ID NO: 18966 - protein, 59 aa, Artificial Sequence
  Synthetic
EEVLKEIVKRVRDDIERHDRESKKLSDENKRVVDEHRKRSEELARKLEELLREIRERVT

SEQ ID NO: 18967 - protein, 59 aa, Artificial Sequence
  Synthetic
SDIEKLAEEVDRLNKELTDRLERLREEHKRTLDEIRKTLEKLKREVDKELEEVKKIVKD

SEQ ID NO: 18968 - protein, 59 aa, Artificial Sequence
  Synthetic
ERVKKILDDLKRKNEENDERVERIMRELRERNRKLNEEIDKIVEDIRREVEKVSREARR

SEQ ID NO: 18969 - protein, 59 aa, Artificial Sequence
  Synthetic
DAVDRVREENKKDSERNKKRVEDVKRRAEERSRRNKKKVKELRDRNREEIKRIKELKDR

SEQ ID NO: 18970 - protein, 56 aa, Artificial Sequence
  Synthetic
RKVEEESRRSFKRNKEENKKVRDEIKKTIEENEAENRKAHEDSKRSFEELEDELRK

SEQ ID NO: 18971 - protein, 60 aa, Artificial Sequence
  Synthetic
DKEREATRRLRELEKENTKLVKEIRDADREIEKRLREIHKKLEDENRKLEEEIKDMVRRK

SEQ ID NO: 18972 - protein, 54 aa, Artificial Sequence
  Synthetic
RIVEEVKKHHERNERRLREYLDESRKYLEDHIRRLEKYLEDSRRLATRIKEETK

SEQ ID NO: 18973 - protein, 57 aa, Artificial Sequence
  Synthetic
SSVEEVKRKNEKSLREIERASEEHLERLKRELEKSEDEARKHNKKLDDDLERLERKG

SEQ ID NO: 18974 - protein, 58 aa, Artificial Sequence
  Synthetic
ERVKDLERTHEESKRRVEELMKENDDLLKRIEEESKRLNEENERKVEDIEKKVEDLKR

SEQ ID NO: 18975 - protein, 59 aa, Artificial Sequence
  Synthetic
SEIERVAKELKDEADRLRKEVEKHRRRSKEELDRLREESKKVNEDLKRMLERIREIAAQ

SEQ ID NO: 18976 - protein, 58 aa, Artificial Sequence
  Synthetic
EEFKKLRDLIEDIKRRLEELVKALEETNKKIEDDVRDSVRKNRETLERIKKEIEDTAT

SEQ ID NO: 18977 - protein, 61 aa, Artificial Sequence
  Synthetic
KDVERILREIRETLRRVEEEAKRSNDEIRKLNEEAERIVREILKEIEKELREVRKRLTEKG

SEQ ID NO: 18978 - protein, 59 aa, Artificial Sequence
  Synthetic
DELLRRLKEELDRVERTIRELIRRNEEVLERSDESVEKLLRELEELLRRVEEEIKKAAT

SEQ ID NO: 18979 - protein, 60 aa, Artificial Sequence
  Synthetic
SEREERAKRLRKILEDLKRESEEHLRRLKTRLDKLREDSKKHLEDVRRKLEDLKRIVEEN

SEQ ID NO: 18980 - protein, 55 aa, Artificial Sequence
  Synthetic
DELRKLVRKVEEDLKRLDEENKKLLEKVKRDLDRLKKENKDLLKRVEEELRREAT

SEQ ID NO: 18981 - protein, 60 aa, Artificial Sequence
  Synthetic
SEEEERKRRLEEKLERLEEKSRRHLKEVKRTLEELEERSRRHLDENRRLLKRLKEIVDRN

SEQ ID NO: 18982 - protein, 55 aa, Artificial Sequence
  Synthetic
EEIKKLVKDIKEELKRLLEENKRLLEEAKKTLKKLLEDNRRLIEKIKKELDEARK

SEQ ID NO: 18983 - protein, 60 aa, Artificial Sequence
  Synthetic
REEERLKRELEKDLERIKKLSDEHKKRLEEENRDLRRKSREHKEKLERDLRRVEEIRRRE

SEQ ID NO: 18984 - protein, 55 aa, Artificial Sequence
  Synthetic
DEVERLLKEIEDRVRKLEKENEEIARRSTETLEKLLKENRETLKEIRDRVREAKR

SEQ ID NO: 18985 - protein, 60 aa, Artificial Sequence
  Synthetic
SEEEELKRRLKEILRELKELSERHKKRLRELNEKLKRLSEEHKRKLEEITEDLRRIATRE

SEQ ID NO: 18986 - protein, 55 aa, Artificial Sequence
  Synthetic
EEVKRLLDEIRRELERLKEENRKIVEDSTRTLKELLEENKRILEESSRDLERLKR

SEQ ID NO: 18987 - protein, 60 aa, Artificial Sequence
  Synthetic
SEEEKIKEEIKRDLEDLRRLSKEHKDRLRKLLEDIKKLSEEHKDKLRRITKELRDVVRRE

SEQ ID NO: 18988 - protein, 55 aa, Artificial Sequence
  Synthetic
EEVKRLLEKVKEDLKRLLDENKRIIERIEREVERLKRENEEILKESSRDLERAKK

SEQ ID NO: 18989 - protein, 60 aa, Artificial Sequence
  Synthetic
SKEEKLKEDLKRTLDDARRLAEETKRRLEEILEKLKRLSEKSKEDVKRTTDELRDIVRKR

SEQ ID NO: 18990 - protein, 55 aa, Artificial Sequence
  Synthetic
EEIKDLLRRIREELKRLKDELRRIIEEIRKELERLKRENEELNRRSSEELKKAKK

SEQ ID NO: 18991 - protein, 57 aa, Artificial Sequence
  Synthetic
SEVEELLERHKRALDKAKKVSEDHKRDLKEKLDDVKRKVEELERRLKRALDELTKEG

SEQ ID NO: 18992 - protein, 59 aa, Artificial Sequence
  Synthetic
EDLVRTLDELHKDIERRLRKLEEENRDILRRIREEIERLKRKLDEIARRIKEEVKKLKK

SEQ ID NO: 18993 - protein, 57 aa, Artificial Sequence
  Synthetic
SEVEELKKEHKKVLDEVRRASKKHKEELEEMLRDLKRKADELARRLEDALRRLEEEG

SEQ ID NO: 18994 - protein, 59 aa, Artificial Sequence
  Synthetic
KKAVDELRELHKEIKRRIEKLLKENEEILRKIEEDIERLLEDLRRKAEEIKRRVDETRR

SEQ ID NO: 18995 - protein, 57 aa, Artificial Sequence
  Synthetic
SEVEEIEKENKDAVRRMREKSRRHKEELKDALREAEEISRRHKEELKRKLEELTKRG

SEQ ID NO: 18996 - protein, 59 aa, Artificial Sequence
  Synthetic
EELVRKLRRLDKRTHEDVRRLLDENRRTLEKIEEDIRRLIKENEDTLREIEKRVEDKKR

SEQ ID NO: 18997 - protein, 59 aa, Artificial Sequence
  Synthetic
SEDEELKKEIEKLLRELRKRSTESKKEIEDLLDELRRKSERSRKEIEDTLRELEERAKG

SEQ ID NO: 18998 - protein, 55 aa, Artificial Sequence
  Synthetic
EEIKELLERLRRDAERLKKENEDLNRRLREEVEKNKEDNKRLNEELRKKVEEDRR

SEQ ID NO: 18999 - protein, 61 aa, Artificial Sequence
  Synthetic
SLEETLDKILEDIRRRIRENEERNRRLKEEIDKAIKRNEEENRKTNEDIKRKIDDLERKRG

SEQ ID NO: 19000 - protein, 59 aa, Artificial Sequence
  Synthetic
KKEVEELIRELEDELRKLEERSKEHLDRLREELKELDERSKKHLDELRKLEEKLRRDAD

SEQ ID NO: 19001 - protein, 60 aa, Artificial Sequence
  Synthetic
SETEKLLERIRRNVEENEKYAREHLKKLDKNLKDNKEYIDRHVKKLKERLDTLREIAREK

SEQ ID NO: 19002 - protein, 55 aa, Artificial Sequence
  Synthetic
ERIEKLLRELERTHRELKEELDKLHKRLEEEHRRLEKKLRDIHRKVEKDLRDLKR

SEQ ID NO: 19003 - protein, 60 aa, Artificial Sequence
  Synthetic
EEKERLKKRIRDNVEENKKYAEEHLKRLKEKLEEVRKYIEDHKDRLRRKIEELKKDAERK

SEQ ID NO: 19004 - protein, 55 aa, Artificial Sequence
  Synthetic
EEIRRILEELRRTHKKLEEELEELHKRVEDELRRLEDELREIHERLEETLRRLRK

SEQ ID NO: 19005 - protein, 60 aa, Artificial Sequence
  Synthetic
SEKEKLKEEIKRNVEENRRYVEEHKRDLERNAEENEKYIREHLKRLKEEAEEVRDRVAKE

SEQ ID NO: 19006 - protein, 55 aa, Artificial Sequence
  Synthetic
KEIERLLRELERTHRELRKDLKRIHDELKKKHDDLRRTLEEVHKRVKEELDRARR

SEQ ID NO: 19007 - protein, 60 aa, Artificial Sequence
  Synthetic
SEKEELIERIRRNLEENRRYIERHLEELEKKLDDVRRKAKRHLEKLREELEKLKDDARKK

SEQ ID NO: 19008 - protein, 55 aa, Artificial Sequence
  Synthetic
EEIRKLLEELRKTHEKLKRDLERLHKKVRDTLKKLEDELKELHKRVDDELRKLRK

SEQ ID NO: 19009 - protein, 60 aa, Artificial Sequence
  Synthetic
DEERKLEELEKENDKLLEDAKRTLEKLLKDNRDLVKRVEDELRRLEEENKKLADDVRRDG

SEQ ID NO: 19010 - protein, 56 aa, Artificial Sequence
  Synthetic
SKELEDRSREHLERLKARLKELEDKSRKHLEEVKKELRELEEKSKKHLKRLEDARR

SEQ ID NO: 19011 - protein, 60 aa, Artificial Sequence
  Synthetic
DEEETLKRLDEENDKLLEEVKKTLEDSLRRLEELHKRTEEELRKSRRELRELVKDVERKG

SEQ ID NO: 19012 - protein, 56 aa, Artificial Sequence
  Synthetic
KEELRDKSRRHLEDVKRRLEELKKSNEEALRRDEKKLEDLRRSNEKVLRELKEKAR

SEQ ID NO: 19013 - protein, 60 aa, Artificial Sequence
  Synthetic
SEEEEVRRLEEELKKLHDDIKRRLEELLRENEKILRDIDREIKKLLEELRKTIDKADKDG

SEQ ID NO: 19014 - protein, 56 aa, Artificial Sequence
  Synthetic
KDELRKIVEELKRDHEKDLRKVEKLSEEHKEKLRRALEELKRLAEEVKKRLDDERR

SEQ ID NO: 19015 - protein, 59 aa, Artificial Sequence
  Synthetic
SVEERLEEMERRNKDLIRRVEEDLERLLKENRDLIRRIKEELKRLKEELKELVERISRE

SEQ ID NO: 19016 - protein, 59 aa, Artificial Sequence
  Synthetic
EEVLKELEEENRKHEKRLRDALERLRRRSKKHKDEARKILEELKERAKTIKRRLEEDRR

SEQ ID NO: 19017 - protein, 60 aa, Artificial Sequence
  Synthetic
SVKEDLRKAKEENKRLIEKAEDDLRKLLRENKELLKRIDEELKRLKKELDDIVRRIEDKG

SEQ ID NO: 19018 - protein, 59 aa, Artificial Sequence
  Synthetic
EEVLEKLKRDNEDHKRRLKEDLRRLREESKKHKKKLEDRLKKLEERARRIKEKLKEEER

SEQ ID NO: 19019 - protein, 62 aa, Artificial Sequence
  Synthetic
DDEERIRKIAEDIKRKLKETLERLRDESRKNKRKLEDLLRKSEEKAKRLKDKLRKMEEEKER

SEQ ID NO: 19020 - protein, 55 aa, Artificial Sequence
  Synthetic
EDVKRLLRELKEITDRIDEEVKRLREENERITRRIEEEHKRLNKELERILREIER

SEQ ID NO: 19021 - protein, 57 aa, Artificial Sequence
  Synthetic
SSEEKAKELRKRLRETHKRVKDEIKRLKEELEESHKRLEERSRETLRKLEELIKELN

SEQ ID NO: 19022 - protein, 56 aa, Artificial Sequence
  Synthetic
DTELEKDVRRVEEKNRRALEDVRRKVEEVKESNKRALEKNERIVREVERRLREEKK

SEQ ID NO: 19023 - protein, 57 aa, Artificial Sequence
  Synthetic
SSEERFEKLDRELKRTHEELERAIRELKKDYERSLKRVEEELKRLLDELEELARRVG

SEQ ID NO: 19024 - protein, 56 aa, Artificial Sequence
  Synthetic
DTKVTETVRRVREENKRMLEDVKRDVDRLRTSNEKVLRDIRRTVKRAKERLKELKE

SEQ ID NO: 19025 - protein, 60 aa, Artificial Sequence
  Synthetic
SAEDELRRLRRELEKSHEELKRRIDELLKRLRELVKRVKDRSKELLDELRKLLEDVKRKG

SEQ ID NO: 19026 - protein, 56 aa, Artificial Sequence
  Synthetic
DTRVRERVKETRRRNEEVLREVERIAKEVEDDLKRILEELEDNVRRVKKKIKDVER

SEQ ID NO: 19027 - protein, 60 aa, Artificial Sequence
  Synthetic
SSEEELKKLEKELEETHRKLKEDVERLLRDLDRKVKKVEDDSKKLLDELRKLLEEAKRRG

SEQ ID NO: 19028 - protein, 56 aa, Artificial Sequence
  Synthetic
ERDVRKRVKEMKEDNRRALEDIRRKTEEVAKKLREILKKLRENVRRVAEEIKRVAD

SEQ ID NO: 19029 - protein, 60 aa, Artificial Sequence
  Synthetic
STEEELERLRRELERTHERLREESEKLVRELRKLVEEVREALERLRRDLKRLLKEVREKG

SEQ ID NO: 19030 - protein, 56 aa, Artificial Sequence
  Synthetic
ETEVREEVKRTKEENKRVEEKLRRNVDEMRKKLEEILRRIKEEIDKMRRKIEEIER

SEQ ID NO: 19031 - protein, 60 aa, Artificial Sequence
  Synthetic
DVEEDLKRLEKKNRDLNKRMEDSNRKLEEDDERVNRKIRKDHKKAEDDLRRVIKEVEEEN

SEQ ID NO: 19032 - protein, 55 aa, Artificial Sequence
  Synthetic
EKTIEDIERHLDRLRKENDKLRKELEDHIRRLEEEVRKNLDRIREEIERARERVR

SEQ ID NO: 19033 - protein, 59 aa, Artificial Sequence
  Synthetic
RAEDEVRKIKKEIDELIRRLEKLNEDIKREIDELVRRLEELNKRVKEEIKRLIEELKKE

SEQ ID NO: 19034 - protein, 56 aa, Artificial Sequence
  Synthetic
DRELKERLDRMRDHARKHEEKLKESLKRVREHVKRHAERVEESLRRLKRDVDELRK

SEQ ID NO: 19035 - protein, 57 aa, Artificial Sequence
  Synthetic
SSDEKLEEIERHHRKVEEESRRLDEDIKRHHKEVEDESRELLERIKKKLEDVTRALG

SEQ ID NO: 19036 - protein, 55 aa, Artificial Sequence
  Synthetic
DEILEKLERDNRRYKEESEEEVERAKEENRRYLEESRREVEEFDRKLKEIADRAR

SEQ ID NO: 19037 - protein, 57 aa, Artificial Sequence
  Synthetic
SELEERVKKVEKVNEDLKRRVEEHERRVKRTLERLEEEVRRHAEKVKKRLEELRRLA

SEQ ID NO: 19038 - protein, 59 aa, Artificial Sequence
  Synthetic
ERIEDLLRRLDDRNRETEREIEERHKRLKEELDKVEERIRREHEKLKRELEEVERRTRK

SEQ ID NO: 19039 - protein, 60 aa, Artificial Sequence
  Synthetic
DVVDELRRIAKEVRDRLREIVERLDRIAKEVVKENEEVVRHNDELAKRVVTTAKRIVDEV

SEQ ID NO: 19040 - protein, 58 aa, Artificial Sequence
  Synthetic
EEVKRVVETVRKLLRDAEKEIEEVVKKVRDLLRRVNKELKESVERVRRLLEEVRERAR

SEQ ID NO: 19041 - protein, 61 aa, Artificial Sequence
  Synthetic
SDLDRVLRKIEELVREIEKESERTNRKSERDTEEVARRSEDSDRDIERLVREIRDRLRKAG

SEQ ID NO: 19042 - protein, 59 aa, Artificial Sequence
  Synthetic
KDVVRELEEIVKELEERAKENVKRSEKSVKEDLDVLADNVRRSKEIVEEIKKRADEVVT

SEQ ID NO: 19043 - protein, 57 aa, Artificial Sequence
  Synthetic
SEKEKVIKEARELLERLRKRLKDVNDDVTRLLDELRKENEKSREDVEREVKRLEEEV

SEQ ID NO: 19044 - protein, 56 aa, Artificial Sequence
  Synthetic
AEELKRVADRLRRRLERLVEENERVVKKILDEIRRSVEENKRIVDKVRKDLDERRK

SEQ ID NO: 19045 - protein, 57 aa, Artificial Sequence
  Synthetic
DEDEKVLRKIEELVRRLHEKNRKVLEESKRTLEKVEERLRRVLKEIEDLVRDAARRV

SEQ ID NO: 19046 - protein, 56 aa, Artificial Sequence
  Synthetic
VSELDKIIKELKREADESVKKLKEIVKRSLDHLEEVVKELKKRLDDLKREIDTKAK

SEQ ID NO: 19047 - protein, 59 aa, Artificial Sequence
  Synthetic
SLEEEVKKVVEEIKRRIEDDVRRIRELVERIKKLIEKDVTDLKRVVDENRDLAEKAKRI

SEQ ID NO: 19048 - protein, 55 aa, Artificial Sequence
  Synthetic
EELLRELRRVLEEAREDSRRLLEEIRKVLEEAEEKSRRVLEESKRVNDELRERLR

SEQ ID NO: 19049 - protein, 59 aa, Artificial Sequence
  Synthetic
SLDESAKRVLEEIKRLAKEDLDELKRVLDEIKEILREVLEANRDSVRRIEEEVEKLARV

SEQ ID NO: 19050 - protein, 55 aa, Artificial Sequence
  Synthetic
DRVLEEIERVIRKIEEDSRRLLKEIADVIKKVREESKRLLDDLKRVIDELRERAR

SEQ ID NO: 19051 - protein, 59 aa, Artificial Sequence
  Synthetic
SLEEVLDRVRRESDKVRKTLERVKEEVERVSREVVEDLKRVEEEVRRLIERVKDILRRS

SEQ ID NO: 19052 - protein, 59 aa, Artificial Sequence
  Synthetic
EELIRDVLREAERLVKESLDDIRRLLDEVRRLVEESRRNIERLLEEVRRLVEEIERAAE

SEQ ID NO: 19053 - protein, 60 aa, Artificial Sequence
  Synthetic
DKVDEVLKRVKRVVEEIEDRVRKLNKEVRDVVKRIEELAREVLDHSRKVVEEIKKTAEDR

SEQ ID NO: 19054 - protein, 56 aa, Artificial Sequence
  Synthetic
EEVVRTVKEELDKALEKAERVLEHSRRMLERVLKEAKRVLDEVKELNKRVIDEVRR

SEQ ID NO: 19055 - protein, 56 aa, Artificial Sequence
  Synthetic
SVEDVAREVDKLLKRANEESKRVLEEVERLLRTVSRELEKVIRDVKKLIDDVEKRV

SEQ ID NO: 19056 - protein, 59 aa, Artificial Sequence
  Synthetic
SETAEKVLRDVERIVRRNEELVREVLRRVKKIVDENRKIAEDALRKVEELVKELEERAR

SEQ ID NO: 19057 - protein, 59 aa, Artificial Sequence
  Synthetic
SEAEEALERVKELVKRSEELAEESLRRARKSVEEVARRAEEALERVKKSVEEVKEVRKE

SEQ ID NO: 19058 - protein, 56 aa, Artificial Sequence
  Synthetic
KEVLDKVRDLVRRVDEENRRVIEEAKKLSEDVARRVDKVIKDVERLSKRVEDEVRR

SEQ ID NO: 19059 - protein, 58 aa, Artificial Sequence
  Synthetic
DEDRRAVEELRRVVEEVNKLNEDTLRELERIVRENIRRVRELLKEAEDVVREVEKEVR

SEQ ID NO: 19060 - protein, 55 aa, Artificial Sequence
  Synthetic
EEVLREAKDLIDHVRKTIEEVNDTVRDLVRKVHEVNKEVLDRIRKLVEEVRKTVE

SEQ ID NO: 19061 - protein, 61 aa, Artificial Sequence
  Synthetic
SSLDRVRRAIEELVKKVNTDSKRVKDRVRKLLKEVNDTSDRVRRDVKRKLDKVKDDARKAG

SEQ ID NO: 19062 - protein, 59 aa, Artificial Sequence
  Synthetic
DRVVERVVREVERIVRENEELVKEVVRRAEEIVERNERHSRELLRRLAELVDDLRRKIE

SEQ ID NO: 19063 - protein, 61 aa, Artificial Sequence
  Synthetic
SSLDEVRKRVTELLKKVDDTSKKVEDDVKRLLDKSTRTSDEVRKAAERLLEEVEESARRKG

SEQ ID NO: 19064 - protein, 59 aa, Artificial Sequence
  Synthetic
DEMVKRVLEELKKIVDDLERHSRKLLKDARRIVEESIEHSDRVLKEATRIVEKLERDIR

SEQ ID NO: 19065 - protein, 59 aa, Artificial Sequence
  Synthetic
DEIEEVLREMRELVERNVREIEKVVRENEKLVEDNIRLVREVAKELRDLVRKLIERVAR

SEQ ID NO: 19066 - protein, 58 aa, Artificial Sequence
  Synthetic
EELEEVVKEARRLLKKSEEDLRRVEKRVEELNEKSKEEMERVRDDVRRLLEEVKERAR

SEQ ID NO: 19067 - protein, 60 aa, Artificial Sequence
  Synthetic
SEVDELLRLADEIVRELRELVRRHDEIVDKLVEENRRIVEEHLRRVEDVVRRLKELVKKI

SEQ ID NO: 19068 - protein, 58 aa, Artificial Sequence
  Synthetic
EEAERVVKEARRLLREIEELVKRSVERVERLHREVHERIKESTKRVEELVDEVRKAVK

SEQ ID NO: 19069 - protein, 60 aa, Artificial Sequence
  Synthetic
SAVDEVRKVIKEIFDRLAELLKHNSDMVRRLLEEIRELVKNNTEIVREVLKKLEDILREL

SEQ ID NO: 19070 - protein, 59 aa, Artificial Sequence
  Synthetic
EEKLEKVAEDARRAIKDIEDKLRDSNRRLDKLIKEVRRRLEESHKRIEREIKEIEERVR

SEQ ID NO: 19071 - protein, 61 aa, Artificial Sequence
  Synthetic
DKLDEVKEAARRVVEEAHKKNRRVLEKLDEVSRRAHELDKRVKEKLKEVVKRADDLLKEKG

SEQ ID NO: 19072 - protein, 60 aa, Artificial Sequence
  Synthetic
VDTLVERLRRLVEELRKHSDDTVRRMEDIVRRNKKHSEESVRKMDDIVKKLEELAREVVR

SEQ ID NO: 19073 - protein, 61 aa, Artificial Sequence
  Synthetic
DRLDKVKEDLKRSSEDAHRKNKEAIELLDEVSTEAHKLDEDVRRKLEKVVREVRKLLEDKG

SEQ ID NO: 19074 - protein, 60 aa, Artificial Sequence
  Synthetic
IDTIVRDAEKIVEDNRRHSDETVRRIERLVTENLRHSEESVRTLDRLVEELLRTAEEVVR

SEQ ID NO: 19075 - protein, 61 aa, Artificial Sequence
  Synthetic
DKLERVLRELERSSKEAHEKDKKVLEDLDEVSKRAHKANEEVIARLEDVVRKAEDELRKKG

SEQ ID NO: 19076 - protein, 60 aa, Artificial Sequence
  Synthetic
LDTLVKRIEDIVKENEDHSRRSVEEIRRIVEENERHSRESVKTIKDLVEELERRAEEVVR

SEQ ID NO: 19077 - protein, 61 aa, Artificial Sequence
  Synthetic
SELEKVLKDLEESSKEAHKADEEVLRRLERVSREAEKELKRVLDDLRRVVEEVERLLREKG

SEQ ID NO: 19078 - protein, 60 aa, Artificial Sequence
  Synthetic
LETLVRDARRIVKENEEHSRDSVRRIDKIVKENADEVRRVVKEIKDIVKRLEELARETVR

SEQ ID NO: 19079 - protein, 56 aa, Artificial Sequence
  Synthetic
SLDEDVDELVKRVEEEMRRNVKELDKLVKEDKRLAEENVRRLEEIVDRSRKLADRK

SEQ ID NO: 19080 - protein, 55 aa, Artificial Sequence
  Synthetic
EEVLKRLREVIERARRDSERVLRKLEKTTDKVRRDSERVLRENEKSIEDVARKMT

SEQ ID NO: 19081 - protein, 61 aa, Artificial Sequence
  Synthetic
DELERLLEELKRTTRKIEEELKEVNRRLDDTTREAEKELRRLKEKLEEVVKRAEELLRRRG

SEQ ID NO: 19082 - protein, 60 aa, Artificial Sequence
  Synthetic
EKDVVKRLEDLVRDDDRIAKEDVKRLEDLVREDRTLVKEIVDRLEELVRTVEKLVKEVVN

SEQ ID NO: 19083 - protein, 56 aa, Artificial Sequence
  Synthetic
SAIEKVKEVVERVLETVRDSVRRSHEESKRLIDKVRKRLEEVREEVKELIERVRRK

SEQ ID NO: 19084 - protein, 59 aa, Artificial Sequence
  Synthetic
KDAVEDVLRRIEELIRDLNKKNDDNVRRVKEVIDRAEKLVRDLLREIRKLIEKLIRDTE

SEQ ID NO: 19085 - protein, 57 aa, Artificial Sequence
  Synthetic
SVLEEVRRRVEELLKTVKESVDRSHERSERLIEEVRESLKEVKRRVKELVERVREKG

SEQ ID NO: 19086 - protein, 59 aa, Artificial Sequence
  Synthetic
DKVARDVLEEIERLIREANERNKRNLEDVERVIRELNKENERVLREVEKKIEKLIRETE

SEQ ID NO: 19087 - protein, 57 aa, Artificial Sequence
  Synthetic
SSIERVEKEVRRLLRESDESLKRVMEEAKELIKSVRESTKRVEEDARDLLRKVVERT

SEQ ID NO: 19088 - protein, 59 aa, Artificial Sequence
  Synthetic
EEEVERVLEEVRRIIEKLKEDDKRSLERIERIVRRNNELNKESVDRIRKIIKEMEERAD

SEQ ID NO: 19089 - protein, 57 aa, Artificial Sequence
  Synthetic
DESEDVEEKMRRLLEKSKDETRRVKEEVERLNEESKRVTEEVEKRVRDLLREVREKV

SEQ ID NO: 19090 - protein, 56 aa, Artificial Sequence
  Synthetic
VETVLREAKRLIEESIERIERVLKENRELAERSIKVLRDVLREVEDLIRKLEERAK

SEQ ID NO: 19091 - protein, 56 aa, Artificial Sequence
  Synthetic
RKVEEVKKEAERLLRRSEEVSKKVADDADRLLKRSREVSDRVRRESERLLKEVAEA

SEQ ID NO: 19092 - protein, 59 aa, Artificial Sequence
  Synthetic
DKRVEDVLREARDLVRRSIKKIDEVLKEAKRLVEESIKLSEDNVRRNEEIIRDLERRTR

SEQ ID NO: 19093 - protein, 56 aa, Artificial Sequence
  Synthetic
SAVERVKEEVDRLLERSKKESERVRKESEDLIRESDEVSRKVEEDSRRLIEEVERS

SEQ ID NO: 19094 - protein, 59 aa, Artificial Sequence
  Synthetic
ERVVTRLLEEAKRLVERSIEEIKRNVKENRKLVEESIKLSEENVKRNKRLVDEAIRAAE

SEQ ID NO: 19095 - protein, 61 aa, Artificial Sequence
  Synthetic
SVVEEVVERVKRIAEELKRSSEENVDTVRKVVAEAKKLVEDDVREVEKLARRLKEVVTRDI

SEQ ID NO: 19096 - protein, 59 aa, Artificial Sequence
  Synthetic
ERVLKDVKDKADKLIREVEETSKRSEEDVRKVIEEVREVLRESHERVKELIKEVREAER

SEQ ID NO: 19097 - protein, 60 aa, Artificial Sequence
  Synthetic
SEAEKVAEDARKLAEEVIRLIEEVVERSKELVDRNEKEIRRVIEESDKLVEEVIRLLRRG

SEQ ID NO: 19098 - protein, 58 aa, Artificial Sequence
  Synthetic
ESVREVEKIVRDVVREIREMLKRSKDETRRVIKRVREVNDRSEKRSRDVVREARETSR

SEQ ID NO: 19099 - protein, 60 aa, Artificial Sequence
  Synthetic
SEAEEVARRARKLVRELEELIRKSVEDSRELVKRNIEKIKRNVRKSEEDVDRVIKLLRRG

SEQ ID NO: 19100 - protein, 58 aa, Artificial Sequence
  Synthetic
EAVREVDRIVKEVVRRVREALERSREETRRVIEEAKKANKESDDVSRKVAKEIDEEAT

SEQ ID NO: 19101 - protein, 57 aa, Artificial Sequence
  Synthetic
RVIEEVDKEIKRVIKESEDVTKEVKDTSRKVLEDSKRESERVRRRSEEVLKKVEEEG

SEQ ID NO: 19102 - protein, 59 aa, Artificial Sequence
  Synthetic
EDEVRRVAEKVKRLVDESIKRLKDNVKRNKELVDESIREVERNVEENERLATKVIEEAK

SEQ ID NO: 19103 - protein, 57 aa, Artificial Sequence
  Synthetic
SVIERVEEEMEKVIRDSERVTKEVEDRAREVHERSEKRIREVEETSRRVLEELRRAG

SEQ ID NO: 19104 - protein, 59 aa, Artificial Sequence
  Synthetic
EEEVKKLAEEVRRLVEDSIRKLEELARRVDELVRESIERVDRNVEENKRLVREAIERRR

SEQ ID NO: 19105 - protein, 57 aa, Artificial Sequence
  Synthetic
SVDREVEEIMRRVHKESEDVIRKVKDTVRRVLERSREVSERVKRDAERVLEEVKRAG

SEQ ID NO: 19106 - protein, 59 aa, Artificial Sequence
  Synthetic
KDFLKRVAEEVKRLVEESIKRVEDVAREVERLVEESIRLLEAVAKKVRDLVREVKRRRT

SEQ ID NO: 19107 - protein, 59 aa, Artificial Sequence
  Synthetic
KEIEDLVKKIREIVDRIKKTVEDSVREVRRIVDESAKSVEELVKELKKLAEELRKLVED

SEQ ID NO: 19108 - protein, 58 aa, Artificial Sequence
  Synthetic
ELIRTVERELREVEKEVKKMLDESTEVLKEVEERVRRMNDDVRRVLEKVARDVERDLR

SEQ ID NO: 19109 - protein, 59 aa, Artificial Sequence
  Synthetic
KEVEEVVTKVDDLVRELEERSRRHVERVKEIADRNEKLVREVVKRSRDNVRELEELVRR

SEQ ID NO: 19110 - protein, 59 aa, Artificial Sequence
  Synthetic
REVLEEVKKRIRDVLKRVEDASKRVKETIDEVLKRIKELTEDVERKSREVLRRVKEARK

SEQ ID NO: 19111 - protein, 59 aa, Artificial Sequence
  Synthetic
KEVEDIIRKLRRHVKEIERTIREMVESVKRLADEVVKVLKDALDSARDHVRKILETLRD

SEQ ID NO: 19112 - protein, 59 aa, Artificial Sequence
  Synthetic
EDVLRELRKVIEDTERTIKRLVDELEKVHREVKERIRKIAKDLRDKHKKSKRDIRETER

SEQ ID NO: 19113 - protein, 57 aa, Artificial Sequence
  Synthetic
SAKDEVKDVNDKVRKEVRRVIEESRAVNEEIKRRVDTVLKESEDVNREVKREVEDKV

SEQ ID NO: 19114 - protein, 59 aa, Artificial Sequence
  Synthetic
EKVAKEIVRKSEDVVRRIVEELKEDAKRSRDLVRELVKEIKEDVKRSRELVKRVVEEAK

SEQ ID NO: 19115 - protein, 60 aa, Artificial Sequence
  Synthetic
REAEELVKRNEKIVTDIRRLVEKTVRDSRRVVEELKREAEETVERSRRVVTKLKELVERG

SEQ ID NO: 19116 - protein, 58 aa, Artificial Sequence
  Synthetic
RMVEEVERTSREVEEEVKRVLKKSRDVTREVEEEVRRLLERSRKETDDVRKRLEEAER

SEQ ID NO: 19117 - protein, 60 aa, Artificial Sequence
  Synthetic
DEAERLVEEIKRVVKEAEDLVRRTVEISRRVVETLRKEAEDLVRDSERVVKELTELARRG

SEQ ID NO: 19118 - protein, 58 aa, Artificial Sequence
  Synthetic
ELVEKVRRVIEEVEKRLRDMLRKSRDVTREVKERVARMLEKSKKVTDDVEKRVTDEDR

SEQ ID NO: 19119 - protein, 60 aa, Artificial Sequence
  Synthetic
KEAEDLVRRVEEVVEELERRVEKLVRESEEVVKKLSKEVKESVDTNRDIVRRITELARRG

SEQ ID NO: 19120 - protein, 58 aa, Artificial Sequence
  Synthetic
EKVEEVERVIRRVKKRVEEVLRKSKTTTTDVERRVREMLERSEESTRRVKERADRERT

SEQ ID NO: 19121 - protein, 59 aa, Artificial Sequence
  Synthetic
SEADDVVREIEDLVRRDKELVDEVVKRIKDLVRRDKKLVDEVVKEIKDLVTELEDLARK

SEQ ID NO: 19122 - protein, 59 aa, Artificial Sequence
  Synthetic
EEMLRKLERVVEEVKRRSTEALKRLREVVKEVKETSKRANEELERVVREVKKRLDDATK

SEQ ID NO: 19123 - protein, 59 aa, Artificial Sequence
  Synthetic
DEVREVVKEIRKLVEDDKRRVDKVVEDDRRLAKRDLDLVEDVVRRIEDLVRRVLEEARK

SEQ ID NO: 19124 - protein, 59 aa, Artificial Sequence
  Synthetic
KSVLDELRKVVEEVKERSDRALEEVERSIRESEKESRRANEKLRKVVEEVRKKLEEAER

SEQ ID NO: 19125 - protein, 59 aa, Artificial Sequence
  Synthetic
SEVDKVVKDIRDLVRRDLKRVEDVVRTDRRLAEEDLRRVKEVVEKIEKDVKELDELARK

SEQ ID NO: 19126 - protein, 59 aa, Artificial Sequence
  Synthetic
ESVLKKLKDVVDEVERESREALRKVEESIKESKRRSEKALEELREVVKRVDRLLEEARR

SEQ ID NO: 19127 - protein, 59 aa, Artificial Sequence
  Synthetic
SEVDEVVKEVEDLVRRNEELVEEVVRRVEKVVTDDRRLVEEVVREIRKIVKDVEDLARK

SEQ ID NO: 19128 - protein, 59 aa, Artificial Sequence
  Synthetic
EKVLRKLEKVIREVRERSTRALRKVEEVIRRVREESERALRDLERVVKEVEKRMREAAR

SEQ ID NO: 19129 - protein, 60 aa, Artificial Sequence
  Synthetic
DEVDEIVRRIEKLVTDDLKRVEDLVREVKKLVDEDKRKVDEIVKEIRRLVEEIRKEAERD

SEQ ID NO: 19130 - protein, 59 aa, Artificial Sequence
  Synthetic
EKVKRKLRKVVEEVERRSKKANEELEKKVREVEELSKRVLEKLKKVADEVRKEVKDAKD

SEQ ID NO: 19131 - protein, 60 aa, Artificial Sequence
  Synthetic
DSVERLVETIREIARESLRRAKELVKSNKKLAEDSKRRVDKLVKELKDLVTRVKETLKRK

SEQ ID NO: 19132 - protein, 58 aa, Artificial Sequence
  Synthetic
EVLELIEEVVREVKEVNTTVSKEVEDVVEETRKVNEDVAKLIEKVVREVKRVVDEVRT

SEQ ID NO: 19133 - protein, 60 aa, Artificial Sequence
  Synthetic
SELERLVEEIRRLVREIEERSKKTTEDIKRLAEDIRRRSKEAVDENEDLARKIRKRAEER

SEQ ID NO: 19134 - protein, 55 aa, Artificial Sequence
  Synthetic
REIDKVIEEVRKRLKEVTDSDREVIKEIEEVLREVEERNRRSIEKIRKVLEDVTK

SEQ ID NO: 19135 - protein, 60 aa, Artificial Sequence
  Synthetic
SEVDELVEKIRTTVKRVLEKHKRNTDETRRLVEEILERHTRTSRRIERVVREATDKLRRR

SEQ ID NO: 19136 - protein, 58 aa, Artificial Sequence
  Synthetic
EMLEKLREVLERAAEVLKRAEESDRTVDEEVERRVREVARSDDEVLKEVKREVERVKT

SEQ ID NO: 19137 - protein, 60 aa, Artificial Sequence
  Synthetic
SEAEEVAKRVKEIAKENADLAREVAKDIKRLADENKKHADDVARDIERLAKELLEAARRG

SEQ ID NO: 19138 - protein, 59 aa, Artificial Sequence
  Synthetic
ERAEKLARDAAEEAKKAAEESNKLIREAAERLKEAARRADKLVEEAARRLEKAAEEARR

SEQ ID NO: 19139 - protein, 60 aa, Artificial Sequence
  Synthetic
DEVDEVVRRDERLAEENLKRNTESSKRDRDLARENLKDAKRVVERIRKLMEDLKKLFDRG

SEQ ID NO: 19140 - protein, 59 aa, Artificial Sequence
  Synthetic
EKLTRRVEESLKRSEEVLRRVNESDKRSLEETRKVLEESNKEIEKVVRDLEELLKEVRR

SEQ ID NO: 19141 - protein, 60 aa, Artificial Sequence
  Synthetic
SEADKVVKEVDDIVARNTEENDKSSKRVEDIIRENDKHAEEVVRDIRRLAEELRELRERG

SEQ ID NO: 19142 - protein, 59 aa, Artificial Sequence
  Synthetic
EELEKRLRDVVRRAEERLRDVNRSDEEVVRRAEELLKRVDDRVKTVVEELKKTLDDERR

SEQ ID NO: 19143 - protein, 60 aa, Artificial Sequence
  Synthetic
EEVDRVVKRDDDLARKNLEENERSSREDDRLVKENEDHAKKVVDDIRKLMEELRELARRG

SEQ ID NO: 19144 - protein, 59 aa, Artificial Sequence
  Synthetic
EELEKRLRESLRRSREVLKRVNESDRDSLERTKKRLEDVDREVRKVVEELRKVIRDEEK

SEQ ID NO: 19145 - protein, 60 aa, Artificial Sequence
  Synthetic
SEAEEVARRVEKIAEDNARHAEKVAKDIEDLARENLELNERTSRRVERLARELLKAARRG

SEQ ID NO: 19146 - protein, 59 aa, Artificial Sequence
  Synthetic
EEARKLARKAAEDARRAAERANELVKRAADELRRAAEEANKSDEDAAREARRAAEEAER

SEQ ID NO: 19147 - protein, 60 aa, Artificial Sequence
  Synthetic
KDVEDVVREDEELAKTNKKHADDVVRRIKELIDRNRRLNEETSKRIEDLVRRLLELARRG

SEQ ID NO: 19148 - protein, 59 aa, Artificial Sequence
  Synthetic
ERVRKEVERSLRKSDEVLRRVNDKVRRVLEELRKVLEDVNRSDEKVLRELEELLERVRT

SEQ ID NO: 19149 - protein, 58 aa, Artificial Sequence
  Synthetic
SEDEKVRKVVEEAKEVNRRAEEAIKDVSERLERVNREVTKRSRDVSEEVRKMLERDAS

SEQ ID NO: 19150 - protein, 56 aa, Artificial Sequence
  Synthetic
VDEVVKRIKELVDRSLELAERIVERNERLVEKSERDVRKIVEDNKRLADEVAKRAT

SEQ ID NO: 19151 - protein, 58 aa, Artificial Sequence
  Synthetic
REDELVDKVLRELEELLRRVKKRLEDVSRDLERVNREVRDELRRVSKKVEDMARRDVG

SEQ ID NO: 19152 - protein, 56 aa, Artificial Sequence
  Synthetic
AETVVRDIRRLAEELLRTVDKIVKDNERLARESRERVRRIVERNEELARDLARKAR

SEQ ID NO: 19153 - protein, 58 aa, Artificial Sequence
  Synthetic
DDEKKVEDVVRKVKKVAEDVRRRLEKVSREVKKVLDEVRRRVEEVSREVEEILRRAAS

SEQ ID NO: 19154 - protein, 56 aa, Artificial Sequence
  Synthetic
ADEVVKRIEDLVRDLERRVDEIVKRNKELVKRVEEEADKIVEDNKRLAEEVLRKAT

SEQ ID NO: 19155 - protein, 57 aa, Artificial Sequence
  Synthetic
DSRRKVKEVIKELEEVLRRVKEEVEKVSRDLERLLKEVKEKLERVSRKVEEEIREKA

SEQ ID NO: 19156 - protein, 56 aa, Artificial Sequence
  Synthetic
ADTVVKRIKELMKDVERIVEEIVRENRKLVTDLLREVDRIVEENERLAEELAERAR

SEQ ID NO: 19157 - protein, 58 aa, Artificial Sequence
  Synthetic
SSKEKVERVVERLRRVNEEVIRLIEKVSRELEEVNKEVRERIERSVKETEDILRTAAS

SEQ ID NO: 19158 - protein, 56 aa, Artificial Sequence
  Synthetic
VDTVVREIEKLMDDSKKKADRIVDENRELVKRSEEAVEELVRRDKKLAEDVFRKAE

SEQ ID NO: 19159 - protein, 58 aa, Artificial Sequence
  Synthetic
DDERKVKKVVKEVRKVDEEVARRLDKVSKELRDVNREVKKKMEDSVKKTEDLAKKDAS

SEQ ID NO: 19160 - protein, 56 aa, Artificial Sequence
  Synthetic
ADTVVKRIKELAEESEKRVDKIVKRNKELVDKSKKDVDELVKRDEELMKDLVEKAR

SEQ ID NO: 19161 - protein, 58 aa, Artificial Sequence
  Synthetic
SAEEKVRKVLKELREVNERVERELKRVSDESERVDDEVNTRAKKVVRDVERVLEERAG

SEQ ID NO: 19162 - protein, 56 aa, Artificial Sequence
  Synthetic
VDEVVERIERLARESKKRVERIVRENEKSARESEKRADEIVKTIEELAERVARRAT

SEQ ID NO: 19163 - protein, 58 aa, Artificial Sequence
  Synthetic
KDEERVKEVVKKLRKVNEDVRRLIERVSRESKRLDEEVNRELDESAKDTERALRERLG

SEQ ID NO: 19164 - protein, 56 aa, Artificial Sequence
  Synthetic
ADEVVKEIEKLAKTSEELARRIVRENEESARESLERARKLVEDDRRLVKEVVERAE

SEQ ID NO: 19165 - protein, 60 aa, Artificial Sequence
  Synthetic
DLEERLATVVRKVEEDLKKLRRDNEKVIREVEKLNEDLNRRNKKLIDEVRKLLEKAKREG

SEQ ID NO: 19166 - protein, 59 aa, Artificial Sequence
  Synthetic
EKRVRELLEKIKRLLEEVDRRVKESIKEIEDSLRRSKEKADRSIEEIKKLLDDLRERAR

SEQ ID NO: 19167 - protein, 59 aa, Artificial Sequence
  Synthetic
SVEDLLRRVVEEVRKELERLKRKNEKVVKEVRKKNKEVNDRNEEVIRRVEKRLKKLKED

SEQ ID NO: 19168 - protein, 59 aa, Artificial Sequence
  Synthetic
EEEVRRLVRRIEKIVDEVRKRVDKSVEEIKRSLKRSKELADESLERIRRLLEEIDERVR

SEQ ID NO: 19169 - protein, 60 aa, Artificial Sequence
  Synthetic
SSDEELKKVLEDMKRVLEKVREDMKRVNDELKEAVERVKKESDDVDRELRRVIEEVVRED

SEQ ID NO: 19170 - protein, 56 aa, Artificial Sequence
  Synthetic
VKDLVRTVERLVEEIKDLVRKDVERVKKIVRRIEDLAKKDVEVSEKLVKEIKDRAK

SEQ ID NO: 19171 - protein, 60 aa, Artificial Sequence
  Synthetic
SAKELLDDVAKKLEEVVERVARKLDEVDERLREMIERVRKELEDVNRRLRDLVRRVVDKD

SEQ ID NO: 19172 - protein, 56 aa, Artificial Sequence
  Synthetic
VEEVVRDVERIVDEIEKRAEKVVRDSEKLVRDIEELVRRDVREVERIAEEIEKEAT

SEQ ID NO: 19173 - protein, 60 aa, Artificial Sequence
  Synthetic
SADEELERVLRELDKVIKDVVEESRDVDRKLERVVREVERLLDDVDRRLKEVIERVVREV

SEQ ID NO: 19174 - protein, 56 aa, Artificial Sequence
  Synthetic
VKDVVTEVKKLVETVKRLVEENVKRVEKIAEEIRRLVEKVVRESDELVERIERRVR

SEQ ID NO: 19175 - protein, 59 aa, Artificial Sequence
  Synthetic
SAEELIRKAAEDARRANKEAEDLIREAAKEARRANEEAERLIREAAKRAEDALRDADRK

SEQ ID NO: 19176 - protein, 59 aa, Artificial Sequence
  Synthetic
EEEAKKLADDIREAAKRSLDRARELAKRIREAARRSLEEAKKLAEEIKKAAEKALRDAT

SEQ ID NO: 19177 - protein, 60 aa, Artificial Sequence
  Synthetic
SAVERVVREVKKTVDESRKRAEKEKREVEDVVRRIREKVKRVVDDNRRVVETIKELSKER

SEQ ID NO: 19178 - protein, 59 aa, Artificial Sequence
  Synthetic
EEAREKLDRVRKELDDANRRVEEELRRVARELEKVLREVEELLRKVDEDIRRVLDEERR

SEQ ID NO: 19179 - protein, 60 aa, Artificial Sequence
  Synthetic
KDVEEVARKVKRVAERSEELVAELVKKNKKVVDESREKVDDVVRRNKELVDTIRDLARRR

SEQ ID NO: 19180 - protein, 59 aa, Artificial Sequence
  Synthetic
EEIRKLAEDVKRELERVNKKVKELSDRAAEELKRVNEEVRKKLEEVDREIRKVLEEVRK

SEQ ID NO: 19181 - protein, 60 aa, Artificial Sequence
  Synthetic
SLMEEVKKEVDKVVREIKELVRKVEEDVKKVVKESRDKVDKVVKENKKVVEKIRDLARRR

SEQ ID NO: 19182 - protein, 59 aa, Artificial Sequence
  Synthetic
DEIRKLIKEALDKLKEVLDEARDRLKKVKEELETVNREVEKLLRDVDREIEKVLKEVEK

SEQ ID NO: 19183 - protein, 60 aa, Artificial Sequence
  Synthetic
SEAEKIVREVERVVEESRRVAKENEKEVDKVVDTIRKLIEDLARRVEDILKKIEEERRKG

SEQ ID NO: 19184 - protein, 60 aa, Artificial Sequence
  Synthetic
VKRIEDLLREVEERLRRVSEEVKKRLKELHERVEEVLRELRKRLRDLERKARKVLEEAKK

SEQ ID NO: 19185 - protein, 57 aa, Artificial Sequence
  Synthetic
DVKEVLDEARKVVEDSIRRSKELIDEVRKRVEESVEESKRLAETVAEEVREVIERAR

SEQ ID NO: 19186 - protein, 56 aa, Artificial Sequence
  Synthetic
IETVLREVKRLVRENVKRIAELVKTIEDLVRENSERVRRVVREIRELVKELEKKAR

SEQ ID NO: 19187 - protein, 57 aa, Artificial Sequence
  Synthetic
DVDELLKRVEDEVRRSKEESEKLRKEVRKEVEDSAKTSKDLIDDARRTVEEVIKKVK

SEQ ID NO: 19188 - protein, 56 aa, Artificial Sequence
  Synthetic
VDTVVERIRKLVKENSDRVREVVDTIKKLVEENVREVRRLVEEIKRLVEEVKRREE

SEQ ID NO: 19189 - protein, 57 aa, Artificial Sequence
  Synthetic
DVKEVLKRAEEEVRRSIKRTREVLERVEKMVRDSSRTTTDLIRKVRREVKRVIDEVN

SEQ ID NO: 19190 - protein, 56 aa, Artificial Sequence
  Synthetic
IDTVLEDVKRLVKENSEKIDEVVREIRELVETNRKLVEDLVREIKELVEKALRDAK

SEQ ID NO: 19191 - protein, 57 aa, Artificial Sequence
  Synthetic
DVKEVLKRAKDEVRRSSDRTRRLIEKVRDESERVVEEVKKLNEDVNREVERVIREVK

SEQ ID NO: 19192 - protein, 56 aa, Artificial Sequence
  Synthetic
IDTVLREVEKLVRDNERLVEKLVKEVEDSVRETKKRVEESVDTVRRIVEELKRRAT

SEQ ID NO: 19193 - protein, 60 aa, Artificial Sequence
  Synthetic
SEAEEVLREVKEVVDRSRELAERVLRAVRELVKRDEDLARKILEDVARVVKTIDDLARER

SEQ ID NO: 19194 - protein, 56 aa, Artificial Sequence
  Synthetic
KEVVDRADRALREVNKRLDEVVREVEKLLRESLDRSRRVIEEVAKRLEEVLKKLED

SEQ ID NO: 19195 - protein, 60 aa, Artificial Sequence
  Synthetic
DEMDEVRREVERVVREDEKLARDLKRRVEKVVEDIKRSADEVLKEVKKLVEEIRELMKKR

SEQ ID NO: 19196 - protein, 56 aa, Artificial Sequence
  Synthetic
REVVRRVEEELERSLRKSREVVKRVEKELEDVLREHRKVLEEVTDLLRRVLEELRR

SEQ ID NO: 19197 - protein, 60 aa, Artificial Sequence
  Synthetic
REAEEILKKVAEVVKEDKKLADDLRKKNKETVDDIRRKAEELLKRVKKVVEELKRRMEEG

SEQ ID NO: 19198 - protein, 59 aa, Artificial Sequence
  Synthetic
DELRKIAEEVRKRLEDSVRTTRDIIRRVKRENEEVIKELERVMRKVREDLKRVKEEIER

SEQ ID NO: 19199 - protein, 59 aa, Artificial Sequence
  Synthetic
SREEVAKEVRELIARSEKETRDIIREVEDRMRRSKEETEEVIKEVKRLLEEVKKRLEEK

SEQ ID NO: 19200 - protein, 56 aa, Artificial Sequence
  Synthetic
AEEILRTVKKVVDRDRELAKRLLDEARELVRTNRELVKRVLETVTRLVKKIDDEAR

SEQ ID NO: 19201 - protein, 60 aa, Artificial Sequence
  Synthetic
DEEEVEKRVKDLLRESTERTKEVNERVRRLAEESRKRTEEIIREVRRLAEEVEERLRRRG

SEQ ID NO: 19202 - protein, 56 aa, Artificial Sequence
  Synthetic
VRELLETVKKLVKDDVDIVRRNLEEVKKLVETNVRLAEEVLKEVDRLVKKVEEDAR

SEQ ID NO: 19203 - protein, 57 aa, Artificial Sequence
  Synthetic
DELDEIRKRVEELIKRSEEDSREVRRRLEEIIERNRKISRDVEREIEKLIKDVRDSN

SEQ ID NO: 19204 - protein, 62 aa, Artificial Sequence
  Synthetic
GEELRRVEEVVKRVRELVERSKEETDKIAEDVRRLLKESNDDTERIKRKVEEMLKELEERIK

SEQ ID NO: 19205 - protein, 57 aa, Artificial Sequence
  Synthetic
RELDEVVKTVRKLVDESKKESDDVAREARELLEKLERESEEVVRRVRELVKELKKKR

SEQ ID NO: 19206 - protein, 56 aa, Artificial Sequence
  Synthetic
VDEVLRKAKELIDDSRRLIEDVKRRLKELIDRDRRLIERVLEEAERLIRELDEEAR

SEQ ID NO: 19207 - protein, 60 aa, Artificial Sequence
  Synthetic
KEIEELDKMVEDIVRELDELVRAHTETVDRLIRDLERSNEELRKLIKKIVDELEDLVRRG

SEQ ID NO: 19208 - protein, 62 aa, Artificial Sequence
  Synthetic
EEVVRRLKDVERKVKKLAEDVKEKLRRSVERVTKLLKEVEDNSREVEKEAEERVDRVLKKVK

SEQ ID NO: 19209 - protein, 56 aa, Artificial Sequence
  Synthetic
REVEELVERIERSSRRALERLEDLDRTIKKSSEDARRRLKEMDDRLEELVKRARDN

SEQ ID NO: 19210 - protein, 56 aa, Artificial Sequence
  Synthetic
EEEIKKVLEEDRKLVEKLERDNKRVLDEDKELVRRNEERNREVLERIRELIERART

SEQ ID NO: 19211 - protein, 56 aa, Artificial Sequence
  Synthetic
DEVEKLIKDIRDIIRRVEEAVARLVEENNKLVKEVDDRLRELSKENRDIVRKVREG

SEQ ID NO: 19212 - protein, 60 aa, Artificial Sequence
  Synthetic
KRTLLEEAKRVLEDIEKEARDLLRRLEEIIRRTRKLVKDILDRSRDILRRTRELVDRVRR

SEQ ID NO: 19213 - protein, 57 aa, Artificial Sequence
  Synthetic
KEAEDLLRRIEDLIRKVKKEVEDLVRENNRLVEKVVRELEKLSDELRKLIKRIKDAG

SEQ ID NO: 19214 - protein, 60 aa, Artificial Sequence
  Synthetic
KETLLRDIERIRREIEKLIEELLRRAEEIIRDTERLVEKILRESKELLKEIRELAEREKQ

SEQ ID NO: 19215 - protein, 59 aa, Artificial Sequence
  Synthetic
DLERVVEESSRLVERVVRRNKKVVEDIRRRVREVERKNEEVTKEIKKILDEVRRRLERD

SEQ ID NO: 19216 - protein, 59 aa, Artificial Sequence
  Synthetic
REELKKLLERSREMLEKSERTVDTSREEAKRVLEESEELVERTLREVEEIIRRVIERVR

SEQ ID NO: 19217 - protein, 60 aa, Artificial Sequence
  Synthetic
SLEEVLRAVRKLAEDVKRKNKEVLDRIRDSSRRSEEKLEDSLRKIEELVRKLEEELKRDG

SEQ ID NO: 19218 - protein, 59 aa, Artificial Sequence
  Synthetic
DEDLKRLLEEIKRVLEESEEKVERSLREMEEVDKETEKRSRKLNREVREVVKDVADKVR

SEQ ID NO: 19219 - protein, 60 aa, Artificial Sequence
  Synthetic
SRLEDLLRKVKKVLDEIRRTIEKSLEDVRELIKRIERTIEKLLERSRDVVRRVLEDAERR

SEQ ID NO: 19220 - protein, 59 aa, Artificial Sequence
  Synthetic
EKAKEVLKEVKDRVDEVAKELTDVNRDIRRIVDELRRRAEKVVRESRELSRELREELEK

SEQ ID NO: 19221 - protein, 60 aa, Artificial Sequence
  Synthetic
SELERLLEEVEKELRKIERTITELLRRSRELLEEIERAIKESLRDSERLLREIEDTVRKR

SEQ ID NO: 19222 - protein, 59 aa, Artificial Sequence
  Synthetic
SKVREVLREVRERVKEVVERLKRVVEESRKRSEEVKKKLEEVNRRSEEESKRVKEELKK

SEQ ID NO: 19223 - protein, 60 aa, Artificial Sequence
  Synthetic
KLEEVLRTVRKLVEDLREELERVVRTSRELTRRLEEELKEVVKRSEDLSRRLEEILKRDA

SEQ ID NO: 19224 - protein, 55 aa, Artificial Sequence
  Synthetic
TEALKEVKRLVDEIRKTIEEALRDSKRLVDEIRETIKRSLEEVEKEVRKAEERIR

SEQ ID NO: 19225 - protein, 59 aa, Artificial Sequence
  Synthetic
SIEDVLRAVEKLLRDLKRRSEEVVKHSETELRRLLEEVRRVLEHSREALERLEERIKDV

SEQ ID NO: 19226 - protein, 59 aa, Artificial Sequence
  Synthetic
DEVIKEILERVKKLIEEIDERNKELNERTKELIKRIKDRLKELNDKTEKAIDKIRKEVE

SEQ ID NO: 19227 - protein, 59 aa, Artificial Sequence
  Synthetic
SIEEVLREVEELLKELEKRARDVLRHSEELLRDVIRRSEEVVKHSEDLLRKLKEAAKDV

SEQ ID NO: 19228 - protein, 59 aa, Artificial Sequence
  Synthetic
DEELKKILDEVRKVIKELEDKLRKLNKKTEDVIRELIERNDRLNKDTKRVIDELKEKVR

SEQ ID NO: 19229 - protein, 59 aa, Artificial Sequence
  Synthetic
SIEEVVEEVKELLERLIRRSEDVLRHSKKLLEELERKSERVVEHSEDLLRKLEEKIKDV

SEQ ID NO: 19230 - protein, 59 aa, Artificial Sequence
  Synthetic
DETLKRILEEVREVIKKLIKSSEDVNRETEELIRRLEDRNRKLNEKTEKVIREIEEEVK

SEQ ID NO: 19231 - protein, 59 aa, Artificial Sequence
  Synthetic
TVEDVLRELRERLKESEKRDRDSVRKAEELLRRSEKRTDDVVKHSERLLEELEEAVRRI

SEQ ID NO: 19232 - protein, 59 aa, Artificial Sequence
  Synthetic
EDVVRRLLEEVEELLRRNVKKSEELLKEIRERLEDNIRKVEKVNRDNKREIEEILRRVK

SEQ ID NO: 19233 - protein, 59 aa, Artificial Sequence
  Synthetic
TVEEVLKEAEDLLKESKERSEDSARRAEEILRRSEERTRKVVEHSREMARRLMEKVKEK

SEQ ID NO: 19234 - protein, 59 aa, Artificial Sequence
  Synthetic
EKVVEDVLREVEKLVRDNIEHSKRLLDEIRRRVEENIRRVDEVNKRNEELIREVEERVR

SEQ ID NO: 19235 - protein, 60 aa, Artificial Sequence
  Synthetic
SKVEEILERVKRLIEENIKRSEEILEEVRRLIRENTEVSKKLLEEVKREITELEKEVRED

SEQ ID NO: 19236 - protein, 59 aa, Artificial Sequence
  Synthetic
ERVKDVLRRLKKIVDESKRRSDKVNKEIEDRVRESEKKSRKVNEDIKRLVKRVADEVER

SEQ ID NO: 19237 - protein, 60 aa, Artificial Sequence
  Synthetic
SDIEDLLKKVEDLIRRNIETSRRLLEEVRKLIEENIRLAERILEEVRRLIEELARLTRED

SEQ ID NO: 19238 - protein, 59 aa, Artificial Sequence
  Synthetic
EKVKDALRRLRDLIRRSKEDSERVNEEIKDIVRKSRETSEDVVRRARELLDKVRREVEK

SEQ ID NO: 19239 - protein, 60 aa, Artificial Sequence
  Synthetic
SELEELLKEVAKLIKRNKDRVRKILDEVRKLIKRNEDVSRRLLEDVERLIKELEREVRED

SEQ ID NO: 19240 - protein, 59 aa, Artificial Sequence
  Synthetic
KKVEDILRTLEELIRESERTSEEVLRELREEAEESKRKSKRVNDRIRELVEKVDREVDK

SEQ ID NO: 19241 - protein, 60 aa, Artificial Sequence
  Synthetic
SKLERLLEEVEKLIRRNKRIVREILREVRELIERNIRVSEEINRRNRRLIEEIRRLVEED

SEQ ID NO: 19242 - protein, 59 aa, Artificial Sequence
  Synthetic
ERVKRILKEIERLVEESKRESERVLEEIKELVKDSKRRSKEVNDHSKKLVDEVREAVKK

SEQ ID NO: 19243 - protein, 59 aa, Artificial Sequence
  Synthetic
SRIDELLKEIRKVTEKTRRDVERLLEEIRKVTDKSRKDSERSLDEARKVLDTIRKLLED

SEQ ID NO: 19244 - protein, 55 aa, Artificial Sequence
  Synthetic
EALERIKRSSEELAEEVKRVLDEVRRSSEELEKRARDSLRELRELVKRVEEEARK

SEQ ID NO: 19245 - protein, 59 aa, Artificial Sequence
  Synthetic
SRIEKLLDEIRKVSKKSIDEVRKILEEVEKVTRDSIRKLRKLLREIEKVLEEIERLLKN

SEQ ID NO: 19246 - protein, 55 aa, Artificial Sequence
  Synthetic
EALKRIKELSDEVREEVKKVLRKIEESSERLEEEAKKVLDTVRELVERVARRAKE

SEQ ID NO: 19247 - protein, 60 aa, Artificial Sequence
  Synthetic
REAEEALRRVEEVVRRSKTELKKLLEDVRRLIEESERELRDLLRRVEEVIRRIREELRER

SEQ ID NO: 19248 - protein, 56 aa, Artificial Sequence
  Synthetic
KEMLRTVDELLKDSERDSERVLREIEELLERSKRKSEEVLREIERLLEKIEREVRK

SEQ ID NO: 19249 - protein, 57 aa, Artificial Sequence
  Synthetic
SEVEEVAREVDELVKESRDESRRIVEEAKRLLKESNKSVKDIERDARRLVKEVEDAV

SEQ ID NO: 19250 - protein, 56 aa, Artificial Sequence
  Synthetic
VKKVLDEVRELAERSKDLNRRLLERIRELVRRSKERNKELLKRLRDLVERVKREIK

SEQ ID NO: 19251 - protein, 57 aa, Artificial Sequence
  Synthetic
DEVEEVKKDAERLNKELHESLRRSNEEAKRLLKESKDASREVVKDARRLTKELRETM

SEQ ID NO: 19252 - protein, 56 aa, Artificial Sequence
  Synthetic
VEKVLRDLRRLTEETKRRNRETLEEIRRLIERSKEEIKRLLEELRELTKRTKDRIR

SEQ ID NO: 19253 - protein, 57 aa, Artificial Sequence
  Synthetic
DEVKEVKDRARKLVEEVKRAVDEVRKRADELNKEVHESLRRSNREAERLVKEVEDTV

SEQ ID NO: 19254 - protein, 56 aa, Artificial Sequence
  Synthetic
VETVLREITELAKKILRDIEELLREITKITEESKRENEKSLRELEDLARRVKEKTR

SEQ ID NO: 19255 - protein, 57 aa, Artificial Sequence
  Synthetic
DEVERLVEELERLLREVRDSVRRSNTEAKELNKEVHEAIRRVVEEARRLLEEVRRTA

SEQ ID NO: 19256 - protein, 56 aa, Artificial Sequence
  Synthetic
VETVLRRVEEVARRVKKLNEDTLRTLRRITEDSLRKIEKLLRDIEKLVREVVERLR

SEQ ID NO: 19257 - protein, 60 aa, Artificial Sequence
  Synthetic
SEIEDLERRIKEVVDDLRRLVEENSKKIDDLLRRLKDLIRKVEEMNRKLIREAEELVREE

SEQ ID NO: 19258 - protein, 58 aa, Artificial Sequence
  Synthetic
EELRKVEESVRRLAEEIKKELEDSRRRVEELVREIEKELEDVNRDARRLVDKVREELR

SEQ ID NO: 19259 - protein, 57 aa, Artificial Sequence
  Synthetic
REVEELKKTLDRLVEESKRESDKVREDAERTVRESEDKSRRVKDEARRSLEEVEEDV

SEQ ID NO: 19260 - protein, 59 aa, Artificial Sequence
  Synthetic
KDEIKKILEEAEEVVRDSKKKIEDLLRHNKKRVDDSLRKIEEILKHNRDEIERVREEIR

SEQ ID NO: 19261 - protein, 57 aa, Artificial Sequence
  Synthetic
DEVETVREEAKRLVEESRKESRRVEEELKKLLRRVEEEARKVKEELEKSVDEVRKAV

SEQ ID NO: 19262 - protein, 59 aa, Artificial Sequence
  Synthetic
REEIKKILERVREVVKRSKDEIREILKEVRKMIDKVRKEIKEILDHNKEVVRKIKEETK

SEQ ID NO: 19263 - protein, 57 aa, Artificial Sequence
  Synthetic
SEVEEVKERAERLVRESEELSDRVRREAEKTIEAVRELVERIRKRLKESVEEVERRV

SEQ ID NO: 19264 - protein, 59 aa, Artificial Sequence
  Synthetic
REEIKKLLEEVKRVVDKSKRDIDELLKHNRRKIDEVLRELEEILRHNETRIKEVLDRAR

SEQ ID NO: 19265 - protein, 60 aa, Artificial Sequence
  Synthetic
SEVEKLLREAEEDVERILKRLEDSMDSNRELVERILETLKRSLDEVEKEIRKIIEELKRR

SEQ ID NO: 19266 - protein, 55 aa, Artificial Sequence
  Synthetic
DKVIKRLEDLLRKVEKVVRDTNRTIKDSIRRVKEVVDTTNREAEKLLRRVEDTVR

SEQ ID NO: 19267 - protein, 60 aa, Artificial Sequence
  Synthetic
SRVEKLLDEVRRLAEDILRDLERSMRSNEELVRKILEKLKESLESNRRLVKRILERLREE

SEQ ID NO: 19268 - protein, 55 aa, Artificial Sequence
  Synthetic
EKVIREVERLIEEVKRVVDDTNRRAEESIKEVRDLVRRTNEEIEKTIEEVDREVK

SEQ ID NO: 19269 - protein, 57 aa, Artificial Sequence
  Synthetic
REAEEIKKALDKLAEELRELLERSRDTVRKLIKELRDLVRESRRRVKELIDDIRRRV

SEQ ID NO: 19270 - protein, 59 aa, Artificial Sequence
  Synthetic
REELKRLLEEVERLIERLKERIKRLTEESEKLVRELLKLIEKSTKESEEDVKRLVDEAK

SEQ ID NO: 19271 - protein, 58 aa, Artificial Sequence
  Synthetic
SEIEDLLRRVRRLIEESEEVIKRVADEVKEIIDRSREKIKRVTEESREIIKRLKKDGK

SEQ ID NO: 19272 - protein, 58 aa, Artificial Sequence
  Synthetic
RRVEDVERDIRRLVRKLREDNKRIAKTIEDLVRELRELNKRSEDETRKLVKELRDAAK

SEQ ID NO: 19273 - protein, 61 aa, Artificial Sequence
  Synthetic
SEVERIKKAVEDLVRKLRKVSKETLDESRELVKELKERDKESEKDSRRLAERLRKLLEEKN

SEQ ID NO: 19274 - protein, 59 aa, Artificial Sequence
  Synthetic
RKVVKDILDEVKKLIDDIEEHSKRVADRNRRLIEKIKKDTEDVIKRNRDLVTEIEKRIR

SEQ ID NO: 19275 - protein, 61 aa, Artificial Sequence
  Synthetic
SEVEKIEERVKRLVEELKKSLKESEEETERLARELRDVDRRSKEESRRLAEELEDLLRRRN

SEQ ID NO: 19276 - protein, 59 aa, Artificial Sequence
  Synthetic
DKVVEELLKEIEEEIRKILETNDKVVKENRRLAREILEDTKRVVDRNRELIKRIAERIK

SEQ ID NO: 19277 - protein, 61 aa, Artificial Sequence
  Synthetic
DEVETIAKEVKELADKLRREVEESRKDSEDLVRKLRESLKESRKRSKDLVDELRKLLERKN

SEQ ID NO: 19278 - protein, 59 aa, Artificial Sequence
  Synthetic
KKVVDDLRKRVEKLIKEIEEDIERVIRRSRKLIEDILRDNERVVKENEDLIREIEERIR

SEQ ID NO: 19279 - protein, 61 aa, Artificial Sequence
  Synthetic
SDVERVEEELRKLLKEIEDSVRESERRLEKLLEDLKRSTEKTKKELKELIDRLEERVRERG

SEQ ID NO: 19280 - protein, 59 aa, Artificial Sequence
  Synthetic
SERVKEILERVRKLVEDVLRRNKRLVEEVERLIEEILRVDERIVREVRELIKRIEERIE

SEQ ID NO: 19281 - protein, 61 aa, Artificial Sequence
  Synthetic
SSVEEVKKTLEDLLRESDKSVRESERRLRELLRESDESVERSRKTLEDLIRELEDLVRKRG

SEQ ID NO: 19282 - protein, 59 aa, Artificial Sequence
  Synthetic
DREVEKILREVTKLIEESLRRDREITEEVRDLIKKSKEKDKEIVDTVRRLIREIKERIR

SEQ ID NO: 19283 - protein, 61 aa, Artificial Sequence
  Synthetic
RSVEEVVKTLEDLLEKLERSVRESEERLKKLLAESDDSVRKSAEELRRLIEELKDLVRREA

SEQ ID NO: 19284 - protein, 59 aa, Artificial Sequence
  Synthetic
EREVKRLLDEVERLIDEIRERDKDIVREVDKLIKDSKREDKRIVDDVRRLIEEIKRRIK

SEQ ID NO: 19285 - protein, 61 aa, Artificial Sequence
  Synthetic
SSVEEVKRELEKLLEDSDRSVEESKKTLRRLLEESNKELRRVAERLKDLIRELKKRVKERG

SEQ ID NO: 19286 - protein, 59 aa, Artificial Sequence
  Synthetic
DREVEEILRRVRKLIEESKTMDKKIVDDVRKLIEESLRDIERIVEDVERLIKEIKERIT

SEQ ID NO: 19287 - protein, 61 aa, Artificial Sequence
  Synthetic
SSVETVEKELRRLIKELRDSVKKSEDDLRRLLEESNRLVREVERRLRELLEKLRKLVEERA

SEQ ID NO: 19288 - protein, 59 aa, Artificial Sequence
  Synthetic
DREVKRILDEVKDRIRRILREDEEIVKEVRRRIKRSEEAIREIAREVDREIEDIERRIR

SEQ ID NO: 19289 - protein, 58 aa, Artificial Sequence
  Synthetic
SEVEELEERARKLLEDVERLTREVEERAKELVKRVKDSSKRSEDEIRRLLRKLLETSG

SEQ ID NO: 19290 - protein, 56 aa, Artificial Sequence
  Synthetic
VEKVIRTLEEEVRRDEEKIREVLERVEDLIREDLRRDEELVKELEKLIREVDEKER

SEQ ID NO: 19291 - protein, 58 aa, Artificial Sequence
  Synthetic
KEVEDLEEELKKLLKEVKTRTEKVVRDAEKSVRDLEKSSRDSDRTLKDLLRRLMETTG

SEQ ID NO: 19292 - protein, 56 aa, Artificial Sequence
  Synthetic
VKKVLDEVRRLVEEDKKRIEEVLKENRESVKRDKELDDRLLERVRELIERALERAR

SEQ ID NO: 19293 - protein, 58 aa, Artificial Sequence
  Synthetic
SEVERLEEEAKRLLEELKRLVERVVREAERSVEKVRDSVRRSEEEARRLLEEITKDDG

SEQ ID NO: 19294 - protein, 56 aa, Artificial Sequence
  Synthetic
VDKVVEDLKDDIRKVKKRIEEVLDENRKSVRKLDEDDRRLVDELRRLVKEVKDKVR

SEQ ID NO: 19295 - protein, 56 aa, Artificial Sequence
  Synthetic
KEVEDLKEELKKLVEELERLVEKNVREARELVKRSEEESRRVAETARRLVDEIRRA

SEQ ID NO: 19296 - protein, 59 aa, Artificial Sequence
  Synthetic
RRTITELLKEVEELVKRVLDAIRKSNREVEKLVRESLRRIEKLLREVEKLVKELLERRK

SEQ ID NO: 19297 - protein, 56 aa, Artificial Sequence
  Synthetic
DEVERLEEELKRLVKEIEDSVRESKKEAEETLRESRKLSREVEERARRLVEELKRK

SEQ ID NO: 19298 - protein, 59 aa, Artificial Sequence
  Synthetic
EREIRELLEEVRKVVEEIKRRDDELVKENRRSIEESKRRIEELLKEVKELVERVTDTER

SEQ ID NO: 19299 - protein, 56 aa, Artificial Sequence
  Synthetic
RDVEEVKKEAEELVKKSEESVRRSKEELERTLKRSREESERVKETAKKLVEKIERD

SEQ ID NO: 19300 - protein, 59 aa, Artificial Sequence
  Synthetic
KETIKRLLDEVRKLVEDSLRHDEELVERNKKSIKDSLDEIERLLREIEELVRKVEEDER

SEQ ID NO: 19301 - protein, 56 aa, Artificial Sequence
  Synthetic
SDVDRVKEDAKRLVEESKRSVDESAKDMRRTLKRSRDESRRVKEELKRLVDRVKES

SEQ ID NO: 19302 - protein, 59 aa, Artificial Sequence
  Synthetic
KDEIRELLERVKKLVDESRRHDKRLVEENRRSARDSLREIERLLREVRKLVEKVLRDRK

SEQ ID NO: 19303 - protein, 60 aa, Artificial Sequence
  Synthetic
DEVETALEEVKELLERVLRKIEDDLRRVRDLLEKLKRTNEELLRKVREEVRRLADLIRKR

SEQ ID NO: 19304 - protein, 55 aa, Artificial Sequence
  Synthetic
ETVKREIEKARETLERLLKRSEEEVDRVKKEVEEISRRVKKEVKKLVDEIRERLR

SEQ ID NO: 19305 - protein, 60 aa, Artificial Sequence
  Synthetic
RRVEEVAKELKRIAEKLKRDIEELLRDDKRLADELRETNKELLRKDKEILDRLAEEIKRR

SEQ ID NO: 19306 - protein, 55 aa, Artificial Sequence
  Synthetic
ETVDRKIDELAERIRRLLEKVKRHVEETKRDVRRVSEEVRKHVEETKRDVRRRLK

SEQ ID NO: 19307 - protein, 60 aa, Artificial Sequence
  Synthetic
SRVEDLVRRIRELVRRDLKRIKDLEEEIKRLAEEIERHSKKVVDELKELADRLRKMLEEG

SEQ ID NO: 19308 - protein, 59 aa, Artificial Sequence
  Synthetic
KEKVDDIRREVKRVVRESEEANKRVRKLVEDIVKRAEDSNRRVEELVRELVEDLKRAAK

SEQ ID NO: 19309 - protein, 60 aa, Artificial Sequence
  Synthetic
SEVDELLKTIEKLARDDVKKIREVVEENKREVRRLEEHSKEVVKEIKDRIKEVLELLRRG

SEQ ID NO: 19310 - protein, 59 aa, Artificial Sequence
  Synthetic
ERVLERVERLVRRLAEESRRANEKSKEDTKRLEDRLKKSNDDLEKLVRDVVTRVREEAD

SEQ ID NO: 19311 - protein, 60 aa, Artificial Sequence
  Synthetic
DEVKELEKRIRKLVREIEEHSKEVVKENRRLVEEDLETIKEVLREIKRRIKKLLELLERG

SEQ ID NO: 19312 - protein, 59 aa, Artificial Sequence
  Synthetic
KDVLKTIKDTVEELVERLKRSNERSREETKKLVKRSREANKRVEDLVRKVVKELREAEK

SEQ ID NO: 19313 - protein, 60 aa, Artificial Sequence
  Synthetic
EEVERIVKEIRDLAEKDKEHSKRVEEEIRRLVEEVERHSRRVEEEIRRLAEELKRLLDRG

SEQ ID NO: 19314 - protein, 59 aa, Artificial Sequence
  Synthetic
EEKLEDLERKVRKLADESREVNDRLRELVERVVRRLEEVNERLERLVEELRRRLEEAKR

SEQ ID NO: 19315 - protein, 60 aa, Artificial Sequence
  Synthetic
DEVEELVERIKRLVERDEREIKRVEDEIERLVRRVDEHSKRVEEEIRRLVTELMELLDRG

SEQ ID NO: 19316 - protein, 59 aa, Artificial Sequence
  Synthetic
ERVVEKVRRLVDKLAERSRDLLRKLRDLVRRVVKRLEDVNRRLEELVRKLAEELKEKSR

SEQ ID NO: 19317 - protein, 60 aa, Artificial Sequence
  Synthetic
SEIEKILDDIRREAEKDLRLSEKIVEDIKRLAERDIKRLREIVEEIEKLLREVSDELRKR

SEQ ID NO: 19318 - protein, 62 aa, Artificial Sequence
  Synthetic
EDAERLIREVEKLVRDLVRESEKSNEEVRKLVEDLVRESDKVLKDVKRLVDEVVRRAREEVK

SEQ ID NO: 19319 - protein, 60 aa, Artificial Sequence
  Synthetic
SRIDEIVKRIEELARRDEEVSREIVKEIRDLAKRDEDTSKRIVEEIKELVKKIKEELERS

SEQ ID NO: 19320 - protein, 62 aa, Artificial Sequence
  Synthetic
EDAKRLLDKVRKTVEDLVRRSRKSNEDVRREVEKLVDRSRKSNTTVERLVRKVVRELRETVR

SEQ ID NO: 19321 - protein, 60 aa, Artificial Sequence
  Synthetic
SRAEEIVERIKKLAEDDKRESDRIVEEIKKLARDIEEAIRRIVKEIRDLVKEVRDVLERE

SEQ ID NO: 19322 - protein, 62 aa, Artificial Sequence
  Synthetic
ERAKELVEEVERLVRELVKDSDRSNKEVRRTVKEIVERAEKLVRDVEEDVERLVRDLKRKVK

SEQ ID NO: 19323 - protein, 60 aa, Artificial Sequence
  Synthetic
SEIEKILKEIEDLARRDEEVSKKIVEDIRRLAKEVEDTSRDIVRKIEELAKRVLDRLRKD

SEQ ID NO: 19324 - protein, 62 aa, Artificial Sequence
  Synthetic
EDAERLVREVEDLVRRLVRRSEKSNEEVKRTVEELVRRMEESNDRVRDLVRRLVEELKRAVD

SEQ ID NO: 19325 - protein, 60 aa, Artificial Sequence
  Synthetic
SEIEKLRKTVERIKEEVKRLSDEHKKRTRELERTSERLVEEHRERTEELRRRIEEIVRKK

SEQ ID NO: 19326 - protein, 56 aa, Artificial Sequence
  Synthetic
IDTLVEEIKELMKEDSERIKKSVKEVDDLAKEDSDRIRDSVRTVKELADEAIRRAK

SEQ ID NO: 19327 - protein, 60 aa, Artificial Sequence
  Synthetic
SEIERLEDRIRRLIRDSRELVKTLKKELKEIIERLEELSERLRREIERVVREVEDVVRKR

SEQ ID NO: 19328 - protein, 56 aa, Artificial Sequence
  Synthetic
IDELLKKLDEIATRDREKIERLREEIRKIARKDEEDIRKLVKEIRDEVRKLKEDAR

SEQ ID NO: 19329 - protein, 55 aa, Artificial Sequence
  Synthetic
SEVEELRELVKRLIERIKRVVETNERDLEELIKRVKDAVKKNKEDLERLIEEIDR

SEQ ID NO: 19330 - protein, 55 aa, Artificial Sequence
  Synthetic
KELLDELKRLIDEVEKKLRESNERVRRLAEEVLRRSKESNDRVRDEARKVKETAR

SEQ ID NO: 19331 - protein, 55 aa, Artificial Sequence
  Synthetic
DEVEALKRTVEELIKRIRKAVEDNERDLERLLKESRDVVKKNEEDLKRLIEEIER

SEQ ID NO: 19332 - protein, 56 aa, Artificial Sequence
  Synthetic
IEKLLRELERVIEEIVRRLEDSNRRVRDIARRDKERSKRSNDRVRRLAEEVKERAK

SEQ ID NO: 19333 - protein, 56 aa, Artificial Sequence
  Synthetic
SEVEELKKLVEELRREIRRLVRENEEDLKKLLEESKRMVERLKELVKKLIEDIRRT

SEQ ID NO: 19334 - protein, 55 aa, Artificial Sequence
  Synthetic
KELVDELKRVADEIVRRIRESNRKVRKIAEEDKTRIKRLLEELERLIADVERRAT

SEQ ID NO: 19335 - protein, 60 aa, Artificial Sequence
  Synthetic
SEVERLLRELERSVTEVKERVRRLVEELERIVREVKKRVDEHKERNKRALEDVKRKVRDR

SEQ ID NO: 19336 - protein, 55 aa, Artificial Sequence
  Synthetic
EEVEKRARKTTEDIKRMADKVTKVAEEVLRRVEKVVEEVREVSRRVVEDIERDTR

SEQ ID NO: 19337 - protein, 56 aa, Artificial Sequence
  Synthetic
KDVEKVIEDIERILTEVRRHSKEILDRIKRILETIREIVKEVKKRNEDLLREARES

SEQ ID NO: 19338 - protein, 58 aa, Artificial Sequence
  Synthetic
KSVEDARRAVERVVREARRSNEEVKRAVEEVAKELERLVKESEDESRRIVEELKKTVD

SEQ ID NO: 19339 - protein, 57 aa, Artificial Sequence
  Synthetic
DEVEEVIKRIRDILRRVEEHSEKILREIEKLLRDATRHSEEVKRRNEKILRDAENSR

SEQ ID NO: 19340 - protein, 58 aa, Artificial Sequence
  Synthetic
EDVKRVRDEVKKVVERVRRSNKKVEDMVREVERRLRESNKESREDSKRIVEEMDRRVK

SEQ ID NO: 19341 - protein, 59 aa, Artificial Sequence
  Synthetic
SEVEKIIDELRKVAEEHKRRVKELVDTNRKVLKEVKDRVRDLVRRVREILKDVSDKARR

SEQ ID NO: 19342 - protein, 54 aa, Artificial Sequence
  Synthetic
EIKEVLKESEEEVRRMLEELEKELRRSRKTVEELLRRLDKTLREVEEAVKRERD

SEQ ID NO: 19343 - protein, 60 aa, Artificial Sequence
  Synthetic
DRVEELLKRVREILERVEREARRLVEEVEDVMRRHKEKLEELVRHNREVLREVSREARRT

SEQ ID NO: 19344 - protein, 55 aa, Artificial Sequence
  Synthetic
EEVKKVLKEVEDTVRELVRRLEKKLKESIDTVERLLEELERVLRESNKTVEDETR

SEQ ID NO: 19345 - protein, 59 aa, Artificial Sequence
  Synthetic
DEVRKILRELREALKRHVEEVKRLLEHNERVLKKVKEDVERLMEEVKRALEDVKRDVDR

SEQ ID NO: 19346 - protein, 55 aa, Artificial Sequence
  Synthetic
KEVRKVLRESEKLIDDLLRELKRVLEETNRRVEDLLRRLEEVLRRVEKTVRDRAK

SEQ ID NO: 19347 - protein, 57 aa, Artificial Sequence
  Synthetic
SLKERLEKVVEESLRRVEEVIKKLERRVEESERRVEELVKTLRDVLRKILRELEKEG

SEQ ID NO: 19348 - protein, 59 aa, Artificial Sequence
  Synthetic
RETVERLLEEIRELLERSRKNVEDLERRIDKLLEDSERNARELLERIRKELRDISEKRK

SEQ ID NO: 19349 - protein, 57 aa, Artificial Sequence
  Synthetic
SMKEEIDRVVREVAENVRDMIRRLKRVLEESLRRVDELVKEIKKVLDDVRRRIEEDG

SEQ ID NO: 19350 - protein, 59 aa, Artificial Sequence
  Synthetic
EETVKRLVEKIRELNERSLDNVKKLLDRIRELLEESERNVKDIVRRIRDLLRRIKEKAT

SEQ ID NO: 19351 - protein, 60 aa, Artificial Sequence
  Synthetic
DEVERVLEEIERMLREVEEHTRRVVEEVRRVLEEVKRHSERVVREIRRLLEELRKLVERG

SEQ ID NO: 19352 - protein, 59 aa, Artificial Sequence
  Synthetic
KDLVRKVEEEVRRVKRELERLNKELEDEVRRIEEAAKRSNEELKKVVDEVKRELEKASK

SEQ ID NO: 19353 - protein, 60 aa, Artificial Sequence
  Synthetic
DEVDEVLKEIRKVLEDVRKHSEEVLREIERVVREVKKHSRKVVEEIKEVVKRLEDLARRG

SEQ ID NO: 19354 - protein, 59 aa, Artificial Sequence
  Synthetic
KRLVDKVRKVVEEVERELKKSVDDVRRVVEEVERRLREVNKEVEDVVREVEERVRRAAT

SEQ ID NO: 19355 - protein, 57 aa, Artificial Sequence
  Synthetic
DEEKEVEKVVRDVEDKLRRLLEENRDVSRKIKRELEELLKELKRSVDDSKEKLERKL

SEQ ID NO: 19356 - protein, 56 aa, Artificial Sequence
  Synthetic
IKTVLEEIKKLAKEAEEEIKRTLERVKKLLEEVRRVVEELLRRNRTLLREIVRKAK

SEQ ID NO: 19357 - protein, 57 aa, Artificial Sequence
  Synthetic
DEERELEEVVKDIERRSKKVVEDNRRVSEEIKRRLEKLLEENRKSAEDSKEMLRREL

SEQ ID NO: 19358 - protein, 56 aa, Artificial Sequence
  Synthetic
VKTIVTEVRDVVRRDKKKAEDTVRTVKELLDRARKKVEKTIRDNRKVLEEVVRKAR

SEQ ID NO: 19359 - protein, 57 aa, Artificial Sequence
  Synthetic
SELERVEKVVREVKKALEDLLRRNKESVDRSRTEARRLLEELRESVRRSEEMVRRKL

SEQ ID NO: 19360 - protein, 56 aa, Artificial Sequence
  Synthetic
VEKVLKEIRDLLREAAERVERSIRRNKKVLDDLKEVVERLLKENERLLREIVEDAR

SEQ ID NO: 19361 - protein, 57 aa, Artificial Sequence
  Synthetic
SAREKLRKVVEEIRRELKRLLEENKKVSDDIRRKLDELLKELEKSVKESIDTLRRDL

SEQ ID NO: 19362 - protein, 56 aa, Artificial Sequence
  Synthetic
VDTIVKELRELLKRAEEEVKKTSDRVADLVRRAEEVVKKLLRENEELLRRIVETAR

SEQ ID NO: 19363 - protein, 57 aa, Artificial Sequence
  Synthetic
SEKEKVEKVVDEVRRRLEDLLRRNRESVRRSDEELKRLLKRNKEVSDEIRKRLRREL

SEQ ID NO: 19364 - protein, 56 aa, Artificial Sequence
  Synthetic
VKTVLREIRELLKEAEERVKKSIKENEDLLDDVRRKVEESTERVERELERVSREAT

SEQ ID NO: 19365 - protein, 57 aa, Artificial Sequence
  Synthetic
DEDREVEEVVKEVEERLRRLLKKNEDVSREIEKRLKELLEKNKRSVEKSEEMLRRKL

SEQ ID NO: 19366 - protein, 56 aa, Artificial Sequence
  Synthetic
VDRVLEEIRELLKRVKEEVERTSRDVKEVLRRAEEEAKRTDDENRKLLEEVVEKAR

SEQ ID NO: 19367 - protein, 60 aa, Artificial Sequence
  Synthetic
DRSKEVVDRLEEELRKVKEDSKESVDRLRRLLEEVERRAEKSLRDSKEVLRRVKEEAERD

SEQ ID NO: 19368 - protein, 55 aa, Artificial Sequence
  Synthetic
RELEKVVRDIIDRVRKMLETSEEVIREVLERVRKVLEENRRVNKDIIDKVEERVR

SEQ ID NO: 19369 - protein, 60 aa, Artificial Sequence
  Synthetic
DEIERLIEEIKTVLDEIRKEAKRMIDENKRLLDEIRELSERVVEENRRLLEEIRDRAEKR

SEQ ID NO: 19370 - protein, 59 aa, Artificial Sequence
  Synthetic
KELADELRKVLKDVRREIEKLVRDAEKSNEDSRREVERLVKRNRESLEEIRKRVEDLVK

SEQ ID NO: 19371 - protein, 57 aa, Artificial Sequence
  Synthetic
SSKETLRKEVERLEKELKKLVDESRRVLEEVEREVRRAVRELEESVKKSAKRLRDRV

SEQ ID NO: 19372 - protein, 56 aa, Artificial Sequence
  Synthetic
VEKLIRRVEELLERVRELVKKNIREIEELLERLRRLVEKVIEDDKRMLKEVEEEAN

SEQ ID NO: 19373 - protein, 61 aa, Artificial Sequence
  Synthetic
REVEELIKRIERLLDEAREHSKEVIRRDEELLRRVRKIIEEIIREIERLLREAEDIARKRG

SEQ ID NO: 19374 - protein, 59 aa, Artificial Sequence
  Synthetic
EELLKRIEDVVRRVVEDLKRLNEEIRRSSEETEKELRRLLEEIRKVVEDVERRVRELVK

SEQ ID NO: 19375 - protein, 61 aa, Artificial Sequence
  Synthetic
DEVREVIKAIRKMLEEAEKHSRDVIRADKELLDKIARHSEEVIKEIRRLLRELEKIAKDKG

SEQ ID NO: 19376 - protein, 59 aa, Artificial Sequence
  Synthetic
EDLLRRIEEEVRRVVEALEKLNRDIEESSRRTEDTARKLNERIREVVEEVMRRVRKLVE

SEQ ID NO: 19377 - protein, 61 aa, Artificial Sequence
  Synthetic
SEVERVIEEIRKLLEDAKRHSDEVIKTDEDILRKVKKHSEEVIREIEKLLEEIEELARRRG

SEQ ID NO: 19378 - protein, 59 aa, Artificial Sequence
  Synthetic
EELLRRLEKLVEDVMRTLKKLNDEIRKSVDETEKTLEELNRRIRKTVEEVRKTAEDLVR

SEQ ID NO: 19379 - protein, 61 aa, Artificial Sequence
  Synthetic
DEVREVIRRIEKLLEDVKRHSERVIREDRKLLRDAERRAKEVIDEIRRVLEEAKEIVRREG

SEQ ID NO: 19380 - protein, 59 aa, Artificial Sequence
  Synthetic
EELLKTITDVVRKVEETLKKLNDEIRKSVEDTMRALKKLVDDLRRVVKEVEDRVREEAR

SEQ ID NO: 19381 - protein, 61 aa, Artificial Sequence
  Synthetic
DVVREVIKTIKKILDEVRDHTRRSIERNEKLLRDIRKIVEDSIRRNRKLLDDAKKVAERDL

SEQ ID NO: 19382 - protein, 59 aa, Artificial Sequence
  Synthetic
EEMVKTLKKVVEDVERELRRLNKEDEDTVREIAEAAERLVRDDERTVREIEEALKELVR

SEQ ID NO: 19383 - protein, 61 aa, Artificial Sequence
  Synthetic
DVIRDVEKKIRDILERVREHTKKSIKENRDILDDVRRHTEKSIKENEDILDEVRRVAERDL

SEQ ID NO: 19384 - protein, 59 aa, Artificial Sequence
  Synthetic
EEMVKRAKDVVDDVARRLEELNREDKKTVEEIVETAKELNERDKETVERIRKKLEDLVK

SEQ ID NO: 19385 - protein, 61 aa, Artificial Sequence
  Synthetic
DAVRKVIEDIKRALEEVRRHTKESIKRNEDILREVEKIARDIIREIRRILERVREVVERDL

SEQ ID NO: 19386 - protein, 59 aa, Artificial Sequence
  Synthetic
EEAVETLKRVVDDVAKKAKELNREDEETVRKIVEELKRLLDELRREVERVADEARRAVK

SEQ ID NO: 19387 - protein, 61 aa, Artificial Sequence
  Synthetic
SVAEEVIRRIEEILKRVEEHTRESIERNKKLLEEVRKHTEDVIRRIRELLERLERVVRRDL

SEQ ID NO: 19388 - protein, 59 aa, Artificial Sequence
  Synthetic
EEMVKRVKDVVDDVVRRLKDLNETDRRTVDEIVKEARRLNDELRKVVEEVEEKARRDVK

SEQ ID NO: 19389 - protein, 59 aa, Artificial Sequence
  Synthetic
DEVREIIERIKKLLDDIRKVAEESIRRNEKLLEEVRKRVRESIEELKRIKEEVEKLARE

SEQ ID NO: 19390 - protein, 59 aa, Artificial Sequence
  Synthetic
EDVVRTIEEVVRRVEKELRRLLEENERVIREIERELKKLVDDNKRVSDEIKDRAERLVD

SEQ ID NO: 19391 - protein, 59 aa, Artificial Sequence
  Synthetic
SEVEDIIRKIEESARRSEKVVRDSIRENRRLLEEVKREVDRSIERLEDIIRKVEEVARR

SEQ ID NO: 19392 - protein, 59 aa, Artificial Sequence
  Synthetic
ERAVDTIRRVVEKSKTVSKKVLDENREVVREVDERVRELVRKNEDVSRKIEERARRLLK

SEQ ID NO: 19393 - protein, 59 aa, Artificial Sequence
  Synthetic
DEEEEVERVVKEAEETIRELLERDKRVVKRLREEADRVLDEVREEVKRSEETAEDLRRK

SEQ ID NO: 19394 - protein, 56 aa, Artificial Sequence
  Synthetic
GEKLIKELEDVLRELEERSRKTLEELKDVLRKVKETIDELIRTNRRELEKLERDTR

SEQ ID NO: 19395 - protein, 59 aa, Artificial Sequence
  Synthetic
SEEEEVAKVVEDVRRRLEELKRAVEEVIRRTDEEAKRLLEADRRVVERVREEVKRLVEA

SEQ ID NO: 19396 - protein, 56 aa, Artificial Sequence
  Synthetic
GKELIKRLRDELKRLEDDARRILERNKKILEDVERESRRTLKELKDVLKELEERAR

SEQ ID NO: 19397 - protein, 60 aa, Artificial Sequence
  Synthetic
SLVEELERVVKDVEREARKLNEHNRENSKRVEDRLRELNEHLRKNTEEVKRRLEELIRKK

SEQ ID NO: 19398 - protein, 59 aa, Artificial Sequence
  Synthetic
EDAIREVLRRIERLLEEVKKKNEETSKRSKELLEENAKRNKEVSDRSKRLLEEIKRRAD

SEQ ID NO: 19399 - protein, 60 aa, Artificial Sequence
  Synthetic
SLTERLREVVRRVEEELKELIRHLRENSERVRKTLEELNRHLKENVEDVKRKLEDLIRKK

SEQ ID NO: 19400 - protein, 59 aa, Artificial Sequence
  Synthetic
KDAVERVIEEIERLLDEVKKTVEELSKTSKKLLDENKKENEDVSRKSEELLKKIADEVK

SEQ ID NO: 19401 - protein, 60 aa, Artificial Sequence
  Synthetic
SLKERLEEVVRRVRKELKKLIEHLERNVEEVRKTLEELNRHLDENVKRVKDTLTRLIEEK

SEQ ID NO: 19402 - protein, 59 aa, Artificial Sequence
  Synthetic
KDEFERVLKRIKEVLDEVKREVEELSKESEDLLRKNEERNKRASDRSEDLLKKIAEEVK

SEQ ID NO: 19403 - protein, 60 aa, Artificial Sequence
  Synthetic
SLLEELEKVVEEVKRSLDEVNKRNKKNTDDVAKTLTDLNEHLERNVRKVEEDAKDLVRKK

SEQ ID NO: 19404 - protein, 59 aa, Artificial Sequence
  Synthetic
EKLAKDVLREIRRVLEEVKRDNDRTSKESKDLLDENKKRNEEVSEESERLLRDIARKVD

SEQ ID NO: 19405 - protein, 60 aa, Artificial Sequence
  Synthetic
DLLEELKDVVDKVRRTLERLNEENRKNVEDVKRRLDDLNRKLEDNVRRVEERARELIKRK

SEQ ID NO: 19406 - protein, 59 aa, Artificial Sequence
  Synthetic
EKAVRDVLKEIEELLRKVTKENKDTSDESRRLVKTNEDLNREASKRSEDLLARVEEKVR

SEQ ID NO: 19407 - protein, 60 aa, Artificial Sequence
  Synthetic
SLTERLAEVVKRAEDLLRKLNEENKKNVEDVERTLRKLNKDLKDSVDRSRREAEKLIRRK

SEQ ID NO: 19408 - protein, 59 aa, Artificial Sequence
  Synthetic
KDAIEKVLEDIERVLREVEKRNRETSRDSERLLRRNEEENRKALERDEKVLKEVADEVE

SEQ ID NO: 19409 - protein, 60 aa, Artificial Sequence
  Synthetic
SLEEALEKIVREVKETLERLNKENRDSVRETADTLRKLNEELRRNVKRVEEALRDLIREK

SEQ ID NO: 19410 - protein, 59 aa, Artificial Sequence
  Synthetic
EEEAKRVLRKIEEDLKRVADINRKTIERDKKLLEDNERKNRKVSEESRELLEKIAKDVK

SEQ ID NO: 19411 - protein, 60 aa, Artificial Sequence
  Synthetic
KEVEEIIEEIKDRLRRLEETVERLLRENREMLRRTREEVKEIIKRIRDLLRELKKIAEKD

SEQ ID NO: 19412 - protein, 59 aa, Artificial Sequence
  Synthetic
KKLVEDVDKVVKEVEDRVRRLIEALKKVSEDLHRENKKLIEELEEVVKEVKERARELTR

SEQ ID NO: 19413 - protein, 60 aa, Artificial Sequence
  Synthetic
DEVKEIIKRIEDLLEDLKRKVERILREDERSLEESRKKVEEILKEIEDVLRKLKKDVEED

SEQ ID NO: 19414 - protein, 59 aa, Artificial Sequence
  Synthetic
ESAIKELRDVVREVKKRAKELIERLRESVERSRETNERLIRELEDVVRRVEETVRRLIK

SEQ ID NO: 19415 - protein, 60 aa, Artificial Sequence
  Synthetic
KKEEKIKRSVERSKEENERLIEELERSIRDTARRAEKLIERLEKVVREVDKRLRELREEG

SEQ ID NO: 19416 - protein, 56 aa, Artificial Sequence
  Synthetic
VETVLREDEDTLRRSEEKVDKLIKDDRRLLEELEDKVRELLRTVKELLKRTEERVT

SEQ ID NO: 19417 - protein, 60 aa, Artificial Sequence
  Synthetic
SSEERLKESIDRSKKRNKEAIEELEKSIRETEKTLEELIKTTRKSIEDVRKRLEDLERKG

SEQ ID NO: 19418 - protein, 56 aa, Artificial Sequence
  Synthetic
IDTLIEEDKETLRRSDEEVRRLIDEDRRLLEEVEKRARESNKEIRDLLRRVEEEAR

SEQ ID NO: 19419 - protein, 60 aa, Artificial Sequence
  Synthetic
SEEDELRESVKDSERRLRRLIEEDKRVVEEVEEENKRLIDKVREVIKRIEDRLDELRRRG

SEQ ID NO: 19420 - protein, 56 aa, Artificial Sequence
  Synthetic
VKEAIRRDRELLKRAEEESRRTLEEMRTSLEESKRRVEELIKTLKRLLDEAEKEAK

SEQ ID NO: 19421 - protein, 60 aa, Artificial Sequence
  Synthetic
SSEEKVEESIRRSKKRLEELIRDVERVVRKVEEDNRRLEEKLRKSIEDTRRKLEELKRRG

SEQ ID NO: 19422 - protein, 56 aa, Artificial Sequence
  Synthetic
FETLIRDDKRLLRKVEEDAKRLIKEIRDSLRESEKRVEELIDRDRRLAKEVEDRAR

SEQ ID NO: 19423 - protein, 59 aa, Artificial Sequence
  Synthetic
SSEERLRESIKRSKKRLEELIREVRKRIEEIRRKNEELIREVEEVIRRIREELKRLRDE

SEQ ID NO: 19424 - protein, 56 aa, Artificial Sequence
  Synthetic
IDELIKEDERLLREVEKKVKEIIKRLDDSLRDSERRAKELIRELEELLREAEERAK

SEQ ID NO: 19425 - protein, 59 aa, Artificial Sequence
  Synthetic
SSEDRLRKSIEDSRKRNEELTRALETVIREIRKRNARLIEEVKKVVEEVKRELERLREE

SEQ ID NO: 19426 - protein, 56 aa, Artificial Sequence
  Synthetic
IDTLIKRDRETLKESEDRVRKLLEDLRRSLRESEKEARRLIEEIRTLLEKVAREAT

SEQ ID NO: 19427 - protein, 56 aa, Artificial Sequence
  Synthetic
SEVEDVLRRIRELLEEVRELVERNLKEIKRLADEIERLAKENLERSRRLAEELRDG

SEQ ID NO: 19428 - protein, 59 aa, Artificial Sequence
  Synthetic
EDAVERVERILRDADEKIKELARESERLNRELDELIKRLVDESRELNRELEEIVRERAR

SEQ ID NO: 19429 - protein, 56 aa, Artificial Sequence
  Synthetic
REVEEVLKKIEDLARELTKKVRKNLEDIKKLAEEIRELAERVLRTSRELIKELRDG

SEQ ID NO: 19430 - protein, 59 aa, Artificial Sequence
  Synthetic
RELLEEVRKILEEMRRRVDELVRRSEELNRKLRELVERLVKELEDLNDEAKKIVDDRAR

SEQ ID NO: 19431 - protein, 56 aa, Artificial Sequence
  Synthetic
REVEEILKKIRTLLEEVKRRVEKNLEDIRKLLKELEDRVRRDLDEIRRLAEELRDG

SEQ ID NO: 19432 - protein, 59 aa, Artificial Sequence
  Synthetic
EKLLAEVRKVLKEAEDKIRELVERSKTINTEVKKEVDRLVEESKKLNKELEDEVDRRAK

SEQ ID NO: 19433 - protein, 56 aa, Artificial Sequence
  Synthetic
REVEEVLKKIRELIETLEELVRDDLRRIEELLRRIEDKVRENLRRIREVIKELRDG

SEQ ID NO: 19434 - protein, 59 aa, Artificial Sequence
  Synthetic
EDLLKRVKELLDDIRRKVDELIDRSRRLLEDLRRRVKELAEESKKLNEEAEKIVEDRAR

SEQ ID NO: 19435 - protein, 56 aa, Artificial Sequence
  Synthetic
KEVEEVLKEIKDIAEEIRELAERDLKRDKELVDEAEDLVRRNLEDIRRVIEELRDG

SEQ ID NO: 19436 - protein, 59 aa, Artificial Sequence
  Synthetic
EELLRRVEKLLEDLKRTVDEMVKRSEDSLRRSEETVRELEERSRRLNDEIRRIVDERAR

SEQ ID NO: 19437 - protein, 58 aa, Artificial Sequence
  Synthetic
SEVDKVVKEIKEKLDEIRKEVEKVVREDERLLEEIERLARKVVRENKELLKDIRREGR

SEQ ID NO: 19438 - protein, 59 aa, Artificial Sequence
  Synthetic
ETVARKLEEVVREVEEEVRRLEEKLKRSVEETEREIRRVVKELEDSVRETEREVRRLSK

SEQ ID NO: 19439 - protein, 60 aa, Artificial Sequence
  Synthetic
DDVEKLVRDIERLVEKVTRDNKKTVDDDKTLVDEARKENEETVERIKRELEELEKRVRKD

SEQ ID NO: 19440 - protein, 60 aa, Artificial Sequence
  Synthetic
SEEATRKLEKVLRDLEEELKRVDRENEKSLRESRKIVEDLDRTNKRVVDELRRIVEELRK

SEQ ID NO: 19441 - protein, 60 aa, Artificial Sequence
  Synthetic
DEIDDVLRKIEDLVRKLRELVKKVLEDSKRLLEEIKRLAKEALERSEELVRRVEELARRG

SEQ ID NO: 19442 - protein, 59 aa, Artificial Sequence
  Synthetic
EEVIRKLEEAVKRAEELVKRIEEELRKVDEEVERLVREIEKELREVNDRLRRLIEEIAR

SEQ ID NO: 19443 - protein, 61 aa, Artificial Sequence
  Synthetic
REIEEALKEIEKIIEDLRKIVEEVLKRLEEIDRELRKRNEDSNREIEKIIEDLKDMVRKKG

SEQ ID NO: 19444 - protein, 60 aa, Artificial Sequence
  Synthetic
SEEAERRAETVLRKLERVVDKVIKDIRKVLKDNERVVREVRKSAEELLDKLRKVVEEVRR

SEQ ID NO: 19445 - protein, 61 aa, Artificial Sequence
  Synthetic
REIEDVLRRIEEIIRELEERNKKSNKEIAEIDKELRDRNRKSNEEIEKIIEDLKEAVERKG

SEQ ID NO: 19446 - protein, 60 aa, Artificial Sequence
  Synthetic
SEEAEKRIRDVLDKLREVVERVIRSIEDMLRRNEKVVREVKESIERALKRLEETVKRVRD

SEQ ID NO: 19447 - protein, 61 aa, Artificial Sequence
  Synthetic
DEIEKMLRDIEEIIKRLRKIVEEVRDTLRRIDEDLRRRNEESNRRLEKIIEDLERVARRDG

SEQ ID NO: 19448 - protein, 60 aa, Artificial Sequence
  Synthetic
DKKAEDEIRKALRKLKEVVKKVLKEIAEMVERNDRELRRLEKSIRESLDKLRETVKRLED

SEQ ID NO: 19449 - protein, 57 aa, Artificial Sequence
  Synthetic
DLVEEIRKTIEKIVREIRKVLDEVRKHTEDVIRDIRRVLKEVERHSREVVKRIRDER

SEQ ID NO: 19450 - protein, 56 aa, Artificial Sequence
  Synthetic
KDELRKLVETLEKVVREVEEELRRLNEELEKVVREVEKRARESNDRLEKVVREVER

SEQ ID NO: 19451 - protein, 60 aa, Artificial Sequence
  Synthetic
SEVDEVVKEIRKLVEDDEREVEKAIRDIRRSNEELRERVERLLEELERLIKEVEETVRRM

SEQ ID NO: 19452 - protein, 58 aa, Artificial Sequence
  Synthetic
EAVEKARKILEEVEKVVTDTEKKLDDIRKHVKEVVDRLRKEIEDVLKRVRDVAERERR

SEQ ID NO: 19453 - protein, 60 aa, Artificial Sequence
  Synthetic
KVEELLKELLDRVKEVVDRIRRELEKALEESRRVVREVEERVKTANREVRKVVDDVRKRS

SEQ ID NO: 19454 - protein, 59 aa, Artificial Sequence
  Synthetic
EEDVRRVLEEIARLVRELEKMVRDVVKTSRDTVRKLREDVKKVVDENRKLAEKLKRDAD

SEQ ID NO: 19455 - protein, 60 aa, Artificial Sequence
  Synthetic
RIRETLTKLLEDVKEVVRETDELLKRLNRRVREVVRETEERLEDLNREVRKVVRDIERET

SEQ ID NO: 19456 - protein, 59 aa, Artificial Sequence
  Synthetic
EETVKDIVRKVKRLLEENRKLAEKITRDNEELLKENKEMLDEVRRRNTELLKRLREEAK

SEQ ID NO: 19457 - protein, 60 aa, Artificial Sequence
  Synthetic
RIEEDATRLIKEVKDVVKETEERARKVNKEVRDVVRDVERRLKELNEEVERVIRDVKRRS

SEQ ID NO: 19458 - protein, 59 aa, Artificial Sequence
  Synthetic
EKIADDVAKEIEDLVRRNREVVTEIEKKNRELVRRLRDMVRKVEEDNKRLLEELKKATD

SEQ ID NO: 19459 - protein, 60 aa, Artificial Sequence
  Synthetic
SVRELVEEARKHSRKVAEESRKLVEDLTEESKRVIDESREKVERLREEIERVLREVKKEG

SEQ ID NO: 19460 - protein, 56 aa, Artificial Sequence
  Synthetic
IERVLEEVEESDKRDEERVRKLEREIRESNKRDKEIVDRLLDELRRIVEELRERAR

SEQ ID NO: 19461 - protein, 59 aa, Artificial Sequence
  Synthetic
SVDEAVDELLKNSEEVIKDTERKARELLRHSREVNKRSERESERLKEEIERVLRKLKRD

SEQ ID NO: 19462 - protein, 56 aa, Artificial Sequence
  Synthetic
IEELVERIKDSNRRDKEIIKDLERKIRESDKRHKERVDDLARRVEEIVKELEEAAR

SEQ ID NO: 19463 - protein, 57 aa, Artificial Sequence
  Synthetic
SEVKKVEKEAEDISRRSRELLEKIREEVERLSRRSEELLKDVERKVRKVIKEIEDKR

SEQ ID NO: 19464 - protein, 56 aa, Artificial Sequence
  Synthetic
EETVRELIRDLRRNTKRVKEEADEMIRHLRENTERVEKRLRELREELKKVVERVRK

SEQ ID NO: 19465 - protein, 57 aa, Artificial Sequence
  Synthetic
EMVDRATEKVRTLSDESRRLLKKVRDENRKTSERSKRLLDEIERRVKEVLKRIRTER

SEQ ID NO: 19466 - protein, 56 aa, Artificial Sequence
  Synthetic
KDRVKRLIEELKENTERVEKSLRDLDRHNRRNTEEVKRSADELIEELKRVVDEVKK

SEQ ID NO: 19467 - protein, 57 aa, Artificial Sequence
  Synthetic
DKADEIEETVRRVSETSERLVEEVRKDNERTSKRSDDLLKDIEDKVRKVLERMRRER

SEQ ID NO: 19468 - protein, 56 aa, Artificial Sequence
  Synthetic
EEKVRRLIKELRDNTKKVAEELKKLDDHNERNVEEVKKRLEELIRRLEKVVEDVKR

SEQ ID NO: 19469 - protein, 57 aa, Artificial Sequence
  Synthetic
DFVKKAKDDVKEVSKESEKLLREIEEEVRRVSKRSRELLETVRRRVEKVLRDMERER

SEQ ID NO: 19470 - protein, 56 aa, Artificial Sequence
  Synthetic
EDRVRELIKELEENTRRVEEKLRKLIEDLKRNVREVEERARRLIEELREVVERVKT

SEQ ID NO: 19471 - protein, 60 aa, Artificial Sequence
  Synthetic
SDLERLKREAEELIERDKRLLRRVEEESRRTLEEDRRSLKESEDRARELIRRIEELAKKI

SEQ ID NO: 19472 - protein, 59 aa, Artificial Sequence
  Synthetic
DEMRDAARRLIEEITRSVEESERELKRLIEEDKRSVERSKKENDKLIEEVRRVVERVTK

SEQ ID NO: 19473 - protein, 60 aa, Artificial Sequence
  Synthetic
DVEEVLRKLKKEVEEVIRRTEAEVAKVLKEVEKVVTETREEVRRVLEEVKRVVDDVRRRN

SEQ ID NO: 19474 - protein, 56 aa, Artificial Sequence
  Synthetic
VEEVRKTVEKLIDDNRRMLEEVVKRAKELIEHNRRVVDKVLKEAKKIVRDLEETVR

SEQ ID NO: 19475 - protein, 60 aa, Artificial Sequence
  Synthetic
SVEEVLKKLLEEVRRVAEETRRRAEKLLDDDRKVAEESKKRAEELLKEVKDRVDDVRRRN

SEQ ID NO: 19476 - protein, 56 aa, Artificial Sequence
  Synthetic
MEKVARTIKKLIKENRKFLEEVEKRSRETLKTNKKVLRDLEKRAKKIIEDLERTLR

SEQ ID NO: 19477 - protein, 57 aa, Artificial Sequence
  Synthetic
KIEELMKRLEDEAKRSLDESEKKLEELRRDSERSVREVEELLKELLDRARRVLEKLG

SEQ ID NO: 19478 - protein, 59 aa, Artificial Sequence
  Synthetic
EEEVKRVAREVEELIERNRRHSDRIAEEVKETLERNREKVRRVLEKLKKELEDVLEKRK

SEQ ID NO: 19479 - protein, 56 aa, Artificial Sequence
  Synthetic
DIEELARRLEEAVKDSLRRVEEKLRRLEDESRRSVEDSDRKLKELIDRVRKVLKDL

SEQ ID NO: 19480 - protein, 59 aa, Artificial Sequence
  Synthetic
DEVVRRVARRIEELLKENDDLVRRVAEEIKRTLKENNEHSDDLRRRIEELIKEITERRR

SEQ ID NO: 19481 - protein, 56 aa, Artificial Sequence
  Synthetic
DIEELLERLRRRVEKSLEDSDRLLRKLEEDSKESVKRVKRLLEELIKRVKEVLKKA

SEQ ID NO: 19482 - protein, 59 aa, Artificial Sequence
  Synthetic
KELVKRALEEIEKRLKDNRDHSRRLAETVKDTLDKNDKKVEEVRREIEELLRRLDEKRN

SEQ ID NO: 19483 - protein, 56 aa, Artificial Sequence
  Synthetic
DIEDLLRELRKRVEDSLKKSEDRLRRLEEKVKRSLDEVEKELKRLLDEAKKVVDKA

SEQ ID NO: 19484 - protein, 59 aa, Artificial Sequence
  Synthetic
DEEVRRVLERIDRLIKRNDDHSRKLEKEIEDLLRRNNREAEEVAKEVEKLLEDLERRRK

SEQ ID NO: 19485 - protein, 60 aa, Artificial Sequence
  Synthetic
REIEEVVKELDDLLRRNDERVKRILDELEELIKKHDRRSDEVTKEIRELLRKLEREVERD

SEQ ID NO: 19486 - protein, 59 aa, Artificial Sequence
  Synthetic
KEARELAEELKKRAKESVDRSKKALEELKKRAREAVRRSREKLKKLKREVEKVVREVRR

SEQ ID NO: 19487 - protein, 60 aa, Artificial Sequence
  Synthetic
DELREILERVRRVLERSKELSEELLRRVEEVLRRLRKHSRDLEEKVRRILTEIEKRARER

SEQ ID NO: 19488 - protein, 59 aa, Artificial Sequence
  Synthetic
KDLREKLDKLRRDLEEVLRRNEEIVREATRRIRKVLDENRKKVEELKRRAERVLEELRR

SEQ ID NO: 19489 - protein, 60 aa, Artificial Sequence
  Synthetic
DDLRRIAKEVEKVLKTSEDLSEELKKEVKRVVDESREDSKRLREEVRKVLEEVKRLADRN

SEQ ID NO: 19490 - protein, 59 aa, Artificial Sequence
  Synthetic
RELKEILKELKKELERVLEDNRRKVKELEDELREVLKRNEKIARELEKELRRVLEEVRR

SEQ ID NO: 19491 - protein, 60 aa, Artificial Sequence
  Synthetic
DELRELEERAKKVVDESRENSDRLAKKVKEVLKRSRELSDELRKEVERVLREIKERARRK

SEQ ID NO: 19492 - protein, 59 aa, Artificial Sequence
  Synthetic
ERLRDILDKIAREVERVLEENRRIVTELKKELEKVLDENRKIVEELERRARKVLKELRD

SEQ ID NO: 19493 - protein, 60 aa, Artificial Sequence
  Synthetic
DELRELLEEVRRMLRESRENSRKLAEEVERVLRESEEDSKKLKRDVEKILEDVRRKLERN

SEQ ID NO: 19494 - protein, 59 aa, Artificial Sequence
  Synthetic
DELRRILDELRRRAKKVLDDNRKIVRDLERELRRVLEENRKIVEELEKLLEKVLEELRR

SEQ ID NO: 19495 - protein, 60 aa, Artificial Sequence
  Synthetic
KELEELAKTVEDLLRENDRLAEEVLRTVDDLLRKNDEISKRLLDTARKLLKELKDLKREN

SEQ ID NO: 19496 - protein, 59 aa, Artificial Sequence
  Synthetic
EDVKRILEKLIRDVEKSLKDVDDRLRELIRRVEESLRRNEEILKEVERRAEEVVEEVRR

SEQ ID NO: 19497 - protein, 60 aa, Artificial Sequence
  Synthetic
DDAERLLEDVRRLLEENDRISEEVLKTVKRIVDENDRLAEELLRTVDELVKRLKELRERN

SEQ ID NO: 19498 - protein, 59 aa, Artificial Sequence
  Synthetic
ERIRKILEKVIKEVEDSLRRNSEIVERAVDRARESVKRVKEIVETVERKIRKVVDEVRK

SEQ ID NO: 19499 - protein, 60 aa, Artificial Sequence
  Synthetic
SEVEEVKDRVTKLLKENDDISKELEERVRRLLEENDRHSREVEKTVRKLLEDLKRLAEEN

SEQ ID NO: 19500 - protein, 59 aa, Artificial Sequence
  Synthetic
KRVKDILRRLVEEAEESLRRNEKKLRELEKRVRESLKRSHKINKELEERVKEVLDRVRD

SEQ ID NO: 19501 - protein, 60 aa, Artificial Sequence
  Synthetic
DEVERVLEEAKKLLDTNDDLLRKLDDTVRKLVEDNNRISEEVRERVERLLRRLEELVRKN

SEQ ID NO: 19502 - protein, 59 aa, Artificial Sequence
  Synthetic
ERVKRILDRVIKEVTDSLKRVEDRLRELIRRVEESLKRNREELRRLEERVKDVLDKARR

SEQ ID NO: 19503 - protein, 60 aa, Artificial Sequence
  Synthetic
DRLEDLLRDVKRLLEENDKHSKEVEERIRKLVEDNNEISRTVARDVEEKLKRLRERTEEK

SEQ ID NO: 19504 - protein, 59 aa, Artificial Sequence
  Synthetic
ERVRRTLEELTRRVEESLKRSHEINRKVIREIEKSMDENKKELERLIDRARRVLEDVRK

SEQ ID NO: 19505 - protein, 60 aa, Artificial Sequence
  Synthetic
SEAEEVLKRAEEILRENNKISRDLEEEVRRLLKENDDLLREVEETVERLLEELKELAKRN

SEQ ID NO: 19506 - protein, 59 aa, Artificial Sequence
  Synthetic
ERVKKILERVIRELEKSLKDNERKLRELEERVRDSLRRVEESLRRLERRVEEVLERVRK

SEQ ID NO: 19507 - protein, 60 aa, Artificial Sequence
  Synthetic
DEMEKLRKDVKKLLEDNNKISRDVEKTVEELLRRNDEHSKEVLKRVEDLLRELKKLKDDK

SEQ ID NO: 19508 - protein, 59 aa, Artificial Sequence
  Synthetic
EDVKRILEELKKRAEDSLRENEKRLRELIREVEKSLRRSHEINRDAERKVRKVLDDVRR

SEQ ID NO: 19509 - protein, 58 aa, Artificial Sequence
  Synthetic
SEIEELLERVKELLKRNRELVERVKRTVEELNKDNDRVVKEIEDEARRLLDELEKIMR

SEQ ID NO: 19510 - protein, 59 aa, Artificial Sequence
  Synthetic
DRMRRIAKKAIDDVRKSVEDSKRILDELRKSTEESVKRTRDILKRVLDEAKKVVEDLRR

SEQ ID NO: 19511 - protein, 60 aa, Artificial Sequence
  Synthetic
DELEELRTRVEKLLKENNDLVREVLKTVKKLNDENRKLVERILREVERLLRELREIAKTT

SEQ ID NO: 19512 - protein, 59 aa, Artificial Sequence
  Synthetic
EEMRKKAEELRKRVDESVKDTRKKLEELRKSTEKSVRDTDRILKDLERRAREVVDELEK

SEQ ID NO: 19513 - protein, 60 aa, Artificial Sequence
  Synthetic
DVEEAVRELRETLDKSVERSERTVRELVKKLETSVEETREEVERVVEELDRVVEEAKKDV

SEQ ID NO: 19514 - protein, 55 aa, Artificial Sequence
  Synthetic
KEVRKEVKELVERDEDLVRKIREKVEKVVKDNKDLLRRIREAAKRVVREIRERLR

SEQ ID NO: 19515 - protein, 60 aa, Artificial Sequence
  Synthetic
STMDEIRRIVEKVLKEDKDLAETADRLNRDSVRRDEELAERNKRTNERVVREIEDRLKKE

SEQ ID NO: 19516 - protein, 59 aa, Artificial Sequence
  Synthetic
KRLEDIVREVKKRLEDSLRDTERIVREVDERNKESLRRSKEIVERVNKLLRDVLERART

SEQ ID NO: 19517 - protein, 61 aa, Artificial Sequence
  Synthetic
SSKEVADELRKKAEKVLDELRKIIRELERKNEDSLRRTEEIVRRLEEEAERVLRDLVRTRG

SEQ ID NO: 19518 - protein, 56 aa, Artificial Sequence
  Synthetic
IEDLRRTVDKLVEEIKDLARKLAKSSDDTVREDEKLVEELRKDVKRIVRKIKKDLE

SEQ ID NO: 19519 - protein, 56 aa, Artificial Sequence
  Synthetic
SAEEVVRELDKELKKVLEDSRDLVRRLEEELRKVLEDNEEVVKEIERSSDDVLRKL

SEQ ID NO: 19520 - protein, 55 aa, Artificial Sequence
  Synthetic
DELLRRVKELVERARRHSERLLEEVKRLVDEIRERSKELLERARRLNEEMKERTR

SEQ ID NO: 19521 - protein, 60 aa, Artificial Sequence
  Synthetic
SDLEELFREVKELVDDNLRKSDKLRRDVEKRVRDNERRSEKVHEDNRRLIEKIERLVRRG

SEQ ID NO: 19522 - protein, 59 aa, Artificial Sequence
  Synthetic
DRVRTLVKELRERAKKSLDDNRRMVEELRKRLEESLRRNKRVVEESEKIAKEVLDKVRT

SEQ ID NO: 19523 - protein, 60 aa, Artificial Sequence
  Synthetic
KDAEDLERRVRELVEENNRVSKRLAEEVTRLVKENEDKVRELEKEVRDRAKELLDMKRRG

SEQ ID NO: 19524 - protein, 59 aa, Artificial Sequence
  Synthetic
ERLKKLVDELRETLERSLRENEKVADELRKRAEKSLEDVKRVVDELRKIVDDVLKRVED

SEQ ID NO: 19525 - protein, 60 aa, Artificial Sequence
  Synthetic
DDLEELFERVKRLLERNNEVSKKLEDDVRKLIEDNERRVERVHRENEKELRRIEDLKRRG

SEQ ID NO: 19526 - protein, 59 aa, Artificial Sequence
  Synthetic
ERVRRLVEELRKLLEDSLEKNKRLVDELRKRAERSLREVRKLVERSKREAERVLEEVRK

SEQ ID NO: 19527 - protein, 60 aa, Artificial Sequence
  Synthetic
SRVEEMFERIERLVRRNNEVSRRVHERNRELIKRNREKVKKVHDDNKKLIDDLRELKRRG

SEQ ID NO: 19528 - protein, 59 aa, Artificial Sequence
  Synthetic
ERVRRLVEEARRLLKKSKDDNRRVVKRSREEVTRSLREVEKLVDESRREAEKVLEEVKK

SEQ ID NO: 19529 - protein, 60 aa, Artificial Sequence
  Synthetic
KELEEAFDRVRRLLEENKRKAEEVHRTNEELVRRNNEKSERVHRENEKEIERLDRAKKRG

SEQ ID NO: 19530 - protein, 59 aa, Artificial Sequence
  Synthetic
ERVKTLLKELRDRLKESRETVKELVDRSREEVKKSKKRNKKVVTDSRRRIKDVLDKVRK

SEQ ID NO: 19531 - protein, 60 aa, Artificial Sequence
  Synthetic
KEAEDMLRKVRKLIKENEKHSREVADEVRKLVEDNDRKVDEVHERNRKLITDLRRLAEEG

SEQ ID NO: 19532 - protein, 59 aa, Artificial Sequence
  Synthetic
ERLKTVVTELEKRARDSLEKSKEINKRLREELKRSEERVERLVRKSEEEAKKVLDDVRR

SEQ ID NO: 19533 - protein, 60 aa, Artificial Sequence
  Synthetic
SEIEKLVEDVRKLVEDNLRHSEEVHRRNRRLIEENERKIDELEKRVRKLVEELRELAERG

SEQ ID NO: 19534 - protein, 59 aa, Artificial Sequence
  Synthetic
ERVRTLVDRLREELKRSLDESEKLNRESRKRVTRSLEKVDDLVRELEKLARKVLEEVKT

SEQ ID NO: 19535 - protein, 60 aa, Artificial Sequence
  Synthetic
SEVEEIFKRVTDLLKRNRDLVREILERSRRLVERNDREAKKILDDARRLIEELEDAVRKE

SEQ ID NO: 19536 - protein, 59 aa, Artificial Sequence
  Synthetic
ERVKKLLDELRERVKRSVEESRRVLDDSRRKSEDSLRRSEELLKRVEEIVERVAREVER

SEQ ID NO: 19537 - protein, 60 aa, Artificial Sequence
  Synthetic
SEVEEIARRVDKLLKDNKRTVDEILKESRRLVKENNELVDKILREVEELLRRLEDEVRKE

SEQ ID NO: 19538 - protein, 59 aa, Artificial Sequence
  Synthetic
ERVEKLLRELEKRVKESVDTSREVLKRSREDSKRSEDRTEKVLREARKRVEDVADKVRK

SEQ ID NO: 19539 - protein, 60 aa, Artificial Sequence
  Synthetic
REVEEIVKEVERLVRENDKVAKEIVDESKRLVEENRKRVEEIRREVEELIRRLEDAVRKE

SEQ ID NO: 19540 - protein, 59 aa, Artificial Sequence
  Synthetic
KRVKDLLEELRKRVKDSRKKSEELLEESERRSKKSLDDTRRVLKDARDIVEKVADEVRK

SEQ ID NO: 19541 - protein, 60 aa, Artificial Sequence
  Synthetic
SDVEEIKKRVKELLEENKRLVETIEREVRRLIEENRRLAKRILDEVRRLLEELKDRVDKD

SEQ ID NO: 19542 - protein, 59 aa, Artificial Sequence
  Synthetic
ERVKKLLTDARKEVERSLRESKKALDELRRIVEKSLRDTERLLRTAEKEVEDVLREVER

SEQ ID NO: 19543 - protein, 60 aa, Artificial Sequence
  Synthetic
SEVEKIFRDVEDLLRRNEETAKEILKTSEELVRRNEELVRRILEEVRDLIRKLREVVERS

SEQ ID NO: 19544 - protein, 59 aa, Artificial Sequence
  Synthetic
RRVEELLRRLAEAVKESLERSERLLRRSEEESRRSLKKTEDILREAREIVRKVAEEVKK

SEQ ID NO: 19545 - protein, 60 aa, Artificial Sequence
  Synthetic
REVEEIVKEVRRRLERNDEVAERIVRESERLVEENNRLVEEILRRVRKLIEELLDLVRKS

SEQ ID NO: 19546 - protein, 59 aa, Artificial Sequence
  Synthetic
ERVEKLLRDLEREVDESRKKSRKLLERSREESDRSLKTTEDILREAERIVEKVEEDVRR

SEQ ID NO: 19547 - protein, 60 aa, Artificial Sequence
  Synthetic
SDVEEIVRRAEKLVEDNDRVAEKIHEDNRRSNKRTLDEVRKILEEVRKLIKDLEDEVRRD

SEQ ID NO: 19548 - protein, 59 aa, Artificial Sequence
  Synthetic
ERVKRLLRRVEKSVRDSKRRSEKLLEDSERSSEKVEKDVRDVLKEAREIVRDVAEKVEK

SEQ ID NO: 19549 - protein, 60 aa, Artificial Sequence
  Synthetic
EEVERIVEDVRRLLEENRELVKRILDEVRKLIKENNRLAREILETVRTELEKLRDLVRKL

SEQ ID NO: 19550 - protein, 59 aa, Artificial Sequence
  Synthetic
ERVEKLLEELERRVEESVEESERVLREAEKIVRDSRKTTEELLEEAKRRVDEVAKEVKK

SEQ ID NO: 19551 - protein, 60 aa, Artificial Sequence
  Synthetic
SSVDEILKDVRRSNKENLDLVEKILRESKKLVEENRRLVKEILDRVRKLIKELLRLVRED

SEQ ID NO: 19552 - protein, 59 aa, Artificial Sequence
  Synthetic
EKVEDVLRRLKRTSERSLEESKKLLEESEKDSDRSRKESEEVLREAEEIVKRVLKEVER

SEQ ID NO: 19553 - protein, 60 aa, Artificial Sequence
  Synthetic
DDVETIVERVRELLEENNRLAREIVERVEKLLKDNDDLVKEILEEVDRRIRKLEEAVKRD

SEQ ID NO: 19554 - protein, 59 aa, Artificial Sequence
  Synthetic
RRVEELLRKLEEDVKRSLEDTKRLLDELKKKVDESRKRSKDVLDKAREIVDRVRRSVEK

SEQ ID NO: 19555 - protein, 60 aa, Artificial Sequence
  Synthetic
SEVEKIVRDVEESNKKTKKKVEDIEEEVKDLVRKNNELVKRILEEVKRLLEELKRVKKDD

SEQ ID NO: 19556 - protein, 59 aa, Artificial Sequence
  Synthetic
ERVKRLLDRLRRTSEEVLERVEEVLKKAEEIVRKSFEDSKRVLRKAEEDVKRVARDVEK

SEQ ID NO: 19557 - protein, 57 aa, Artificial Sequence
  Synthetic
SVDEAAKEAEEIVETVERESRKLLEDSRRIVEEVKKRSEEILEEVRRRVEEVVKESK

SEQ ID NO: 19558 - protein, 56 aa, Artificial Sequence
  Synthetic
LERLLEALRRVIDEDRKRSKKLHEENKRVIERDKEISDKLLDDLRKLVADLRRRAK

SEQ ID NO: 19559 - protein, 56 aa, Artificial Sequence
  Synthetic
REAEELEKEVKKVVDDSKKRLDELDEENRRVDETIKKISEDLTREVKDVIRRIRDG

SEQ ID NO: 19560 - protein, 59 aa, Artificial Sequence
  Synthetic
EELRELVERLRRRLETVNRELERRVRELKRSNDESHRENREVIEELIKELKKVLDDVRK

SEQ ID NO: 19561 - protein, 56 aa, Artificial Sequence
  Synthetic
DELREILRKVEKVVEDIERTSDKLRREVDKVVDDSRRKLEELEKEVKKVIEDIRDG

SEQ ID NO: 19562 - protein, 59 aa, Artificial Sequence
  Synthetic
DRLKEAVKELAKRLKDVHERNKRLIDTLREKLKRINDELERSVRELKKELEEVIDRVRK

SEQ ID NO: 19563 - protein, 56 aa, Artificial Sequence
  Synthetic
DEVEELKRRVDRLVEEIRKLSEELLKRNRDVDREIKKRVKDLEDKVRKVIRDIEEG

SEQ ID NO: 19564 - protein, 59 aa, Artificial Sequence
  Synthetic
RELDEVIKEIRRRLEKVHRDNRRVIDEVRRSNRDSERDIAEAVERLTRLLETVLEKVKT

SEQ ID NO: 19565 - protein, 61 aa, Artificial Sequence
  Synthetic
DELEELRTTVTKLLEDLKKISDDLREEVRRLLEEVEEISKRLEETVRRIIKRVEDIVRRDG

SEQ ID NO: 19566 - protein, 59 aa, Artificial Sequence
  Synthetic
KDVKEVVKKLRDELRRVLERNKEVIDRLREKAREVLEKDRKLVDDLREEAREVLERVKT

SEQ ID NO: 19567 - protein, 61 aa, Artificial Sequence
  Synthetic
DELEEIKKEVEELVKTNERIVDKLREDNKRLVEEVKRISEELEREVRRIIREVREIVKRDG

SEQ ID NO: 19568 - protein, 59 aa, Artificial Sequence
  Synthetic
KDVEKLLRELEEEAKRSLKRNRDVIEKLREENKRLLDDDRRVVEELRKEAKDVLDEVEK

SEQ ID NO: 19569 - protein, 61 aa, Artificial Sequence
  Synthetic
REVDELKKTAEKLIRDDERLVEEVLRTSKKLVREDEDMVRKLRKTIEDLIRRLTDVAREEL

SEQ ID NO: 19570 - protein, 59 aa, Artificial Sequence
  Synthetic
RDVKRVLDEVEKLVEDSKRETERVLRESEERSRRSLEETEKALKDLAKLAEDIKREVEK

SEQ ID NO: 19571 - protein, 61 aa, Artificial Sequence
  Synthetic
REVDELRKRIEDLVRRDEEVARKVLEDVRRLVRRNREKARELLERVEKLVRDLKRVADRDL

SEQ ID NO: 19572 - protein, 59 aa, Artificial Sequence
  Synthetic
EEVKRVLDELRKLVKDSERKTKEVVEKVREDVKDSLRRSEEVLKRVKELVDRVADEVRK

SEQ ID NO: 19573 - protein, 61 aa, Artificial Sequence
  Synthetic
SDLEKLKERVDELIRRDDELVKRVLEESRRLVDRNKKKVDELRRRARKLIEDLKRVADRDL

SEQ ID NO: 19574 - protein, 59 aa, Artificial Sequence
  Synthetic
ERVKELLDRLRKKVEDSREKTERVLKESRELSDRSLERSEEVLERVRREVREVVERLKK

SEQ ID NO: 19575 - protein, 61 aa, Artificial Sequence
  Synthetic
DSLREVEKRIRELIRENEELVKEVLERSKRLVDEDRETAERLRKTVEELLKRLREVADKEL

SEQ ID NO: 19576 - protein, 59 aa, Artificial Sequence
  Synthetic
DEVRKALEDLKRTVDESERRTEEVLKESEDLSRRSLKETEDLLRELEKRVKEVADRVED

SEQ ID NO: 19577 - protein, 61 aa, Artificial Sequence
  Synthetic
SDLDEVRKEVKRLIDENRTLVDEIRRRIEKLIRENKKKVEELRKRAEELIRRLKEVADRDL

SEQ ID NO: 19578 - protein, 59 aa, Artificial Sequence
  Synthetic
RDVKRLLDDLKRLVKESLDETERVLRELRKEVKDSLRDSERALREVEDLVRRIKKRVEK

SEQ ID NO: 19579 - protein, 61 aa, Artificial Sequence
  Synthetic
DEVKKLEEDVRRLIEENEELVRRVKKTSDDLVKRNKEKVEELRKRVEDLIRRLREVERRDL

SEQ ID NO: 19580 - protein, 59 aa, Artificial Sequence
  Synthetic
DEVRKALERLRDEVRRSVTDTDRVLKESEDRSRKSLEDSERVLRELEELVKRILDDLAR

SEQ ID NO: 19581 - protein, 61 aa, Artificial Sequence
  Synthetic
SEVDRLRETIKRLLEENKELVERLRERVRKLIRENEKKVEELRDRAKKLIDRLREVRTRDL

SEQ ID NO: 19582 - protein, 59 aa, Artificial Sequence
  Synthetic
RDVERALKELRDRIEESLRRSEEVLKELEERVKESRDESRRVLEEVRRLVEEIKRRAEK

SEQ ID NO: 19583 - protein, 61 aa, Artificial Sequence
  Synthetic
KDVEDLEREIDRLLDEDRKVVEDLERKIKKLIDDNKRLVDKLREDVERLIRRLREVTEKEL

SEQ ID NO: 19584 - protein, 59 aa, Artificial Sequence
  Synthetic
KKVKEVLDELRKRVDRSLEEAEKALRRLEKLVRDSLRRSEEALERLKRLVDDVKKKVED

SEQ ID NO: 19585 - protein, 61 aa, Artificial Sequence
  Synthetic
SELDEVKRRAKELVDRDKKLVKEVLDTSRELVRRNEELVRRILEEVRKLIEDLAEVTKRDL

SEQ ID NO: 19586 - protein, 59 aa, Artificial Sequence
  Synthetic
KEVKELLDEVRRLAEESRREVERVLRESEKRSRESLKKSEDALERAKKLVEDIKDEVER

SEQ ID NO: 19587 - protein, 60 aa, Artificial Sequence
  Synthetic
SEEDKIREIVDRVLKESEKLIEEIERRVDKVLKRIKELTDEIKKRAEDVIREIEDIVRKE

SEQ ID NO: 19588 - protein, 59 aa, Artificial Sequence
  Synthetic
DELRKVVEEIKRELEKIDKKLEEVVRRIEKKLEDILKENSKAVREIRELLKKVKRELEK

SEQ ID NO: 19589 - protein, 60 aa, Artificial Sequence
  Synthetic
DEVEELKRRVEKLLEEIERLTKTHEDRSRRLIEDIRDSNRKLKEDAERLIKEIEELKRKV

SEQ ID NO: 19590 - protein, 59 aa, Artificial Sequence
  Synthetic
EELKKVVDDLRREAERILRRDEEAVKRSEKLLRDILEHVKRVVDEIREELKRILDRVRE

SEQ ID NO: 19591 - protein, 60 aa, Artificial Sequence
  Synthetic
DEVREIEKRVRDLIREIEKSNRDLEREAKRLIDEIDDLSRKLKEDADKLIEEIKELKKKV

SEQ ID NO: 19592 - protein, 59 aa, Artificial Sequence
  Synthetic
EEVRRVVEKLRRLLKTITEHVKEVLDRLRREAEDALRRDKEVADRIREEARRILEDVKK

SEQ ID NO: 19593 - protein, 60 aa, Artificial Sequence
  Synthetic
DDVKRIEKEVRRLLREIERLTREHEKESRELVREIEELSRRLEEEIKRLIEEIEELRKRV

SEQ ID NO: 19594 - protein, 59 aa, Artificial Sequence
  Synthetic
KEVRDVVKRLEEEIREVLAKDEEVARRSVEALADILRRDKDVVDRIRKLLKEILDRVRK

SEQ ID NO: 19595 - protein, 56 aa, Artificial Sequence
  Synthetic
DREEVVKEIKKRLEDLNRRVREVVKKIDRELEKLLEESKRVVDDLRRRLEELKKRI

SEQ ID NO: 19596 - protein, 56 aa, Artificial Sequence
  Synthetic
ERELERLVKEVEKTNERLLDELRKAAEEVAKRSEDTLRELRDIIKKVEERATDIAR

SEQ ID NO: 19597 - protein, 56 aa, Artificial Sequence
  Synthetic
SKEDVVREIEKTLKDLLDDSRRVVRESEERLKELNRRLREVVKESKRRLDEALRRI

SEQ ID NO: 19598 - protein, 56 aa, Artificial Sequence
  Synthetic
TEELRRLVDKVREDSERTLERDRRLAKEVSDRNKRLVEENRKIVEEVLKTIEELRR

SEQ ID NO: 19599 - protein, 56 aa, Artificial Sequence
  Synthetic
EREKVVKKIKEDLDRLNEEVKRVVDESRKLLKRLNERVEEVIREIRKTLEELTRRI

SEQ ID NO: 19600 - protein, 56 aa, Artificial Sequence
  Synthetic
ERELERLVAEVAERNKKLLKDDKDLARKVAEDNEDLLRRLRDEVEKVRRTADEIRR

SEQ ID NO: 19601 - protein, 56 aa, Artificial Sequence
  Synthetic
SREEVVDELRKRLEELNKEVREVVRESERKAERALEEVEEMVKRVREELEKLKRDI

SEQ ID NO: 19602 - protein, 56 aa, Artificial Sequence
  Synthetic
KDDLRRLLKEVAERNRKLLEDDEELAERVLREVRRLLEELRRRLKEIKERLDEIRR

SEQ ID NO: 19603 - protein, 56 aa, Artificial Sequence
  Synthetic
SREEVVRRADKLLKDLNKRVKEVIERSERKLRELNERVRDVVRKIEKRLEELERRI

SEQ ID NO: 19604 - protein, 56 aa, Artificial Sequence
  Synthetic
EEELKRVITKVLRDNEELLKTDEELAEDVARKNKKLLDDLEKTVKEVMDRAEELRR

SEQ ID NO: 19605 - protein, 56 aa, Artificial Sequence
  Synthetic
SREEVVRDIERRLRELNKRVADVADESRRRLEELNEKLRRVVEESRRRLEELRKEI

SEQ ID NO: 19606 - protein, 56 aa, Artificial Sequence
  Synthetic
DDTLRREVKKVERENERLLEEDRRLVREVTRRNEKLVKDNREIVKEVLERAKELTR

SEQ ID NO: 19607 - protein, 56 aa, Artificial Sequence
  Synthetic
SREEVVKEIKDRLKKLNDDVKRVIKESEDLLRKLNEEVRDVVRKIEETLEELLRRI

SEQ ID NO: 19608 - protein, 56 aa, Artificial Sequence
  Synthetic
EERLKEVVAKVAKENKDLLRRDEELARRVAERNKKLVEDLRRLVEEVRRRAEELRR

SEQ ID NO: 19609 - protein, 56 aa, Artificial Sequence
  Synthetic
SESERVEELLKEVAKRVKEVSDRSKRLLEEIERRVKEVSDESEELLRRIIDEAKKV

SEQ ID NO: 19610 - protein, 56 aa, Artificial Sequence
  Synthetic
ERVVDRVRRELEKLIKDLEENSREVERSLRELIEHLKKNVEDVEREAKRVIDELKT

SEQ ID NO: 19611 - protein, 60 aa, Artificial Sequence
  Synthetic
SLEEKLRRVLDELRKTIETLLKTNKDVLKKLEEDVKRIIRRNEEVLRDLERKVRDLKKKG

SEQ ID NO: 19612 - protein, 59 aa, Artificial Sequence
  Synthetic
ERLKRVVDELRKRAKKLLEDVERVIRKSEEEARRLLREVEKVVRELDREAEKLVEEVRR

SEQ ID NO: 19613 - protein, 60 aa, Artificial Sequence
  Synthetic
SSEETLRDILKKVEERSEETLRHNERVLEEVRKEVERILRRNEEVLRRLEKEAKELKKRG

SEQ ID NO: 19614 - protein, 59 aa, Artificial Sequence
  Synthetic
ERLKRVVDDLERRIRELLERDERVIRRTEEEARRLLDDVRRVVEELDKRAEDVVKEVKD

SEQ ID NO: 19615 - protein, 60 aa, Artificial Sequence
  Synthetic
DEEETLKKILDDVRKVSRDTMEENKTFLEELSKVADKIIRDNEKVLDDHRKAAEELKKRG

SEQ ID NO: 19616 - protein, 59 aa, Artificial Sequence
  Synthetic
ERLKRVVDDIRRSLEELLKRDEEVVEESRKEVKRLEEEVREVVTRSDKLMDELLKKVKR

SEQ ID NO: 19617 - protein, 61 aa, Artificial Sequence
  Synthetic
SEKEEVLREAREEAKDIERRLERLLERDKEVIDRVEKDLERLLRENKKLIDDVRRRVEEEG

SEQ ID NO: 19618 - protein, 55 aa, Artificial Sequence
  Synthetic
EVMDEIRRLAERVERRLREVLERSKKLVDDLRERLKEVLKRIEDLYRRLEEEADR

SEQ ID NO: 19619 - protein, 60 aa, Artificial Sequence
  Synthetic
TAKEVLDEIRKVHEDLNRKIEEVLKHSEDVLREVEERNERSVRHSEDMLRRLEERIDRKG

SEQ ID NO: 19620 - protein, 59 aa, Artificial Sequence
  Synthetic
EEVLRKLLEENKKEIRRLEEELKRLNEEVKKRIKELEDSSRKENDRVRERIRELDERVK

SEQ ID NO: 19621 - protein, 60 aa, Artificial Sequence
  Synthetic
TLDEAARTIEELLREVEERARRVLRHSEKVLDKVRKENEDSLRHSDEVLRRVEREAEKKG

SEQ ID NO: 19622 - protein, 59 aa, Artificial Sequence
  Synthetic
EEVIEKTLRDVERRLRDLEDKLRKLNEEVEKTIRDLRRSSEALNKKVKDLIKKLLDEVK

SEQ ID NO: 19623 - protein, 60 aa, Artificial Sequence
  Synthetic
TLDEVAKEIEELLRRVEEENRKSLEHSERVLDEVRERNERSARHSEEVLRRLREEVRRKG

SEQ ID NO: 19624 - protein, 59 aa, Artificial Sequence
  Synthetic
EKVIKETLDRVRETIKRLIKSSRDLNEEVKRRIRELIESSRKKNEDVKKTIEELLRRVK

SEQ ID NO: 19625 - protein, 60 aa, Artificial Sequence
  Synthetic
TADEVLKEIEDVHRRVNTENRKSIEHSKKVLEEVRRTNEKSIEDIERLLREVEKRIRDKG

SEQ ID NO: 19626 - protein, 59 aa, Artificial Sequence
  Synthetic
EDVLRKALEENERLIRELEESSRRLNERVKELIRELEKSSKRLLDEVKKLIDELREEVR

SEQ ID NO: 19627 - protein, 60 aa, Artificial Sequence
  Synthetic
TLEEVVEEIRRRHEEVNRRNRESVENSREVLERVEEDNKDSLRRIRELLERVARKLDERG

SEQ ID NO: 19628 - protein, 59 aa, Artificial Sequence
  Synthetic
EDAIRDMLRRNEERLRRLIESSEKLNRESRDVIRKLIESSRDLLRKVKETIEKLEEEVR

SEQ ID NO: 19629 - protein, 60 aa, Artificial Sequence
  Synthetic
TLEEVVRDIERVHEEVNESLKRVNETTTDMHRRLNEEAKRVLEEIEKLLKDVEKKIRDKG

SEQ ID NO: 19630 - protein, 59 aa, Artificial Sequence
  Synthetic
EDAVKRELDRNREEIKKLEKRIRDVLKKNKDLIDKVREELKRLLDEVKKRIDKLAEEVK

SEQ ID NO: 19631 - protein, 59 aa, Artificial Sequence
  Synthetic
SLDEAAKEIEELLRRSHEELKRVVKEIRDLLRRSHEELRRALEEIERLLDEVRRKLEER

SEQ ID NO: 19632 - protein, 59 aa, Artificial Sequence
  Synthetic
DETVKELLRRVRKLVRESIEEVKTLLREAEEKVRRNERKVEEILRRVRETIRRLEERIK

SEQ ID NO: 19633 - protein, 59 aa, Artificial Sequence
  Synthetic
SLDEALERIRRMLKRSHDENRRVAEDIKRLLEESHRENERVVKEIRDVLDKLREDAERN

SEQ ID NO: 19634 - protein, 59 aa, Artificial Sequence
  Synthetic
DEDVKRLLDDVRRTVEENIRRSETELRDVKRRVTETIRESERLLEEVKRIIDKLREEAK

SEQ ID NO: 19635 - protein, 59 aa, Artificial Sequence
  Synthetic
GLDEVLKEIRELLKESHDRLRRVLEEIEKLLEDSHRRNEEVVRRIRKVLEEVREKAERD

SEQ ID NO: 19636 - protein, 59 aa, Artificial Sequence
  Synthetic
ERLVKELLDRARDKIRRNIEELERKLRAVEEKVRRTIRESEELLDRVRKIIEDLEREAT

SEQ ID NO: 19637 - protein, 59 aa, Artificial Sequence
  Synthetic
DLDEALKEIERLLEEVERRNKEVLERIRRLLKRSHEELKRVLEEIEKLLRDLKKRVDDG

SEQ ID NO: 19638 - protein, 59 aa, Artificial Sequence
  Synthetic
RDSVRDLLRRAKERLDELIKTSKELLDRARKKVKENEEELRELLKDVRRIIKKLTEEVR

SEQ ID NO: 19639 - protein, 60 aa, Artificial Sequence
  Synthetic
SELEDLLREVKELIDRLIDDSRRLVKTAEELIREAIKRSEDLLEEVKRLIDRVTEMVERG

SEQ ID NO: 19640 - protein, 59 aa, Artificial Sequence
  Synthetic
ERVREVLERIKRLLEELKKRDEDSVREIERLLEELKRRNDRVVDEIRKLLKELAERVKK

SEQ ID NO: 19641 - protein, 59 aa, Artificial Sequence
  Synthetic
DLDEVIRELEKLLKESHEAVKRVIKKSEDLLRDSHKKVKDVIRRSEDLLRKLEEEVRKN

SEQ ID NO: 19642 - protein, 59 aa, Artificial Sequence
  Synthetic
RTLLEELRRRIEELLKENRELLKRHEDKSKKLLEDNERLLREHAKKSDEIRRELRERVR

SEQ ID NO: 19643 - protein, 59 aa, Artificial Sequence
  Synthetic
DEVERAKDVLDELRRRVEEELRRWKETSERLREESERALEKSEARLREAAEKLERVKRN

SEQ ID NO: 19644 - protein, 56 aa, Artificial Sequence
  Synthetic
EEVLRDIREKLRELAERLKRLLDDDKRVLDEVRKANEDLLRKIKEDIEELRKELEK

SEQ ID NO: 19645 - protein, 60 aa, Artificial Sequence
  Synthetic
DEDEEVKRTIEELRKEVEKTLREIEKSLKESEDKSRKHLEEVKKSLKETEEEVDELKKRN

SEQ ID NO: 19646 - protein, 56 aa, Artificial Sequence
  Synthetic
EKVLRELEERVRRLKKELKRVLDDYKRKLEEAERRNRKVLKEYEDSLRELADRLRR

SEQ ID NO: 19647 - protein, 59 aa, Artificial Sequence
  Synthetic
DEDREVRKTIEKLKRDSERHLEEMKRSAEESRKEVDKLLKKIKDSLRRTEERVRRLKKN

SEQ ID NO: 19648 - protein, 56 aa, Artificial Sequence
  Synthetic
EEVLRELRKIVEELRKRNEDVLEEYERILRELKERLDRVLKEYEDRLRELEKELRD

SEQ ID NO: 19649 - protein, 59 aa, Artificial Sequence
  Synthetic
SEAEKAKETIDRLADRVRKLLEEIKRSLDDSRRKSKETVEENEKTLDRMRKEVDAAKER

SEQ ID NO: 19650 - protein, 56 aa, Artificial Sequence
  Synthetic
EEVLRTLEEIIRRLTKELEDVLREYERELRRLEEENKRVIDKTEEEIRRLADRLRR

SEQ ID NO: 19651 - protein, 59 aa, Artificial Sequence
  Synthetic
EEDERADETLKRIKRESDETVKKNERTITELLKRVKRLVDEIRKSLEETARRVDSAKKR

SEQ ID NO: 19652 - protein, 56 aa, Artificial Sequence
  Synthetic
EEVLRKFRKILEEAAELNKEVIDRSRKIIEDASRLLREVLEDYETKLRELKDKLDT

SEQ ID NO: 19653 - protein, 56 aa, Artificial Sequence
  Synthetic
SLKEVIDDLERIIRELEKRNREVIKRVRKIVREAEEKNEDVIRKLKETIERLEREL

SEQ ID NO: 19654 - protein, 56 aa, Artificial Sequence
  Synthetic
SRELRDEIRKIKKKNDEHLKRLEDELRKLLEKSDRHVKELEDRIRKAAKEVKDAKD

SEQ ID NO: 19655 - protein, 56 aa, Artificial Sequence
  Synthetic
SLEDVIRDLARIIEEAERRNKTVLDELRKTIKELVEENEKVLDEDDKKSRELEKRL

SEQ ID NO: 19656 - protein, 56 aa, Artificial Sequence
  Synthetic
SRRLREEIKRLLRESEKHVEDLRREIERIKRENEEHLKKWRRDSERLEKEVEDAKR

SEQ ID NO: 19657 - protein, 56 aa, Artificial Sequence
  Synthetic
DELEKLRDDARRIEEKHRRTVEKDKDVVRRMDKEVKDHVRRLKELAKKLEDDVRKR

SEQ ID NO: 19658 - protein, 60 aa, Artificial Sequence
  Synthetic
KRSVDEVLREITEIVERVMELNDKSVEETRRIVERLKEEIDTVNDEIAKIVRKVIEEIKR

SEQ ID NO: 19659 - protein, 56 aa, Artificial Sequence
  Synthetic
DELERLKEAAKRLADEVKEHVDRSRENAKRLKEEVEEHVKRLEDVARTMDEEVKRR

SEQ ID NO: 19660 - protein, 60 aa, Artificial Sequence
  Synthetic
KESVDRVLKEIEDIVRRLEERLDESNKELKEIVDDVTEKLERVNRKIAEIVKRLSDEIRK

SEQ ID NO: 19661 - protein, 56 aa, Artificial Sequence
  Synthetic
DELEELRRAAEEMEKEVREHVKRSEKNAKDLEKEVREHVKKLREVLRRLTEKVKRR

SEQ ID NO: 19662 - protein, 60 aa, Artificial Sequence
  Synthetic
KEKVDRVLEEITREVERLKKELDESNERLERIVRKVIEELRKVDEDAEERVRRLEEEIRR

SEQ ID NO: 19663 - protein, 56 aa, Artificial Sequence
  Synthetic
DDLDRLREAAERMAREVEDHVRKLKDLIRRVRERVERHVKKLEDDLKRVKEEVDRR

SEQ ID NO: 19664 - protein, 60 aa, Artificial Sequence
  Synthetic
KDKVRKVLEDIKRIVDRLEERIREVDKDLERIVRELMKRLDEVNKRLEDTVRRLSEEIRR

SEQ ID NO: 19665 - protein, 60 aa, Artificial Sequence
  Synthetic
DLIEEIKKLAEDHHRRVKEVLDRNREVAERLKKRVRRIVEENKRLAEDVTRKIKELKRRV

SEQ ID NO: 19666 - protein, 59 aa, Artificial Sequence
  Synthetic
EDLRRVLEELREIVTRNEKEIRDTIRELEEIVKRLKEDNDRSVRELERILEELREELER

SEQ ID NO: 19667 - protein, 57 aa, Artificial Sequence
  Synthetic
DSDEEVRRVLEKVEEDVRRLAKDIRDSVRRSEERIDELVKKLEKSIDESRRRVETTA

SEQ ID NO: 19668 - protein, 55 aa, Artificial Sequence
  Synthetic
ERLLEEIEKVVEDLRRKAEELIEKNERLLRRLEEVAKELDKRNKELLEELIRRNE

SEQ ID NO: 19669 - protein, 57 aa, Artificial Sequence
  Synthetic
SEADKVREVLKRVKEEIDRLVEEIEKVNRDSRREVEKLVEKLRKSLKESKDRIARDL

SEQ ID NO: 19670 - protein, 55 aa, Artificial Sequence
  Synthetic
EELLRKIEEVLRRLTEDAKRLIRRNREILKELRELAKRLDEENKELLDELIKKAR

SEQ ID NO: 19671 - protein, 57 aa, Artificial Sequence
  Synthetic
SMIEKVREVLKEVADRVRRLLEENKKSIDDSARALEELIKRIRESLRKSEEDLKREV

SEQ ID NO: 19672 - protein, 59 aa, Artificial Sequence
  Synthetic
SEFVKRILDEVDEILKRLERRVKEHSRKNREELEKIRKEAEEILRENEELLEKIVRDAR

SEQ ID NO: 19673 - protein, 57 aa, Artificial Sequence
  Synthetic
EMVERLEESIDRSRKELDRLIEENKKVLEEVEERVRRLIEKLKRSIEESEERLRRKV

SEQ ID NO: 19674 - protein, 59 aa, Artificial Sequence
  Synthetic
DEVVRRLNEENKKLLEDIRRRAKDHSRRVREILEDLEREVEKMNEENKDLLERIVRRAK

SEQ ID NO: 19675 - protein, 57 aa, Artificial Sequence
  Synthetic
SMIEALKENIRRSEEEIRRLIEEWRKVSEDIEREVKKLIKELEESIDESAKRLREKV

SEQ ID NO: 19676 - protein, 59 aa, Artificial Sequence
  Synthetic
SDFVRKLLEENNELLKEIKKRVEKVLEESKELLKELREKIRRLNEKNKKLLEEIVRRAK

SEQ ID NO: 19677 - protein, 56 aa, Artificial Sequence
  Synthetic
SEIEKVVKDLRERLKELRESVKRLDDKNRELLERLEREVEEMDRRNEKLLRDLKRQ

SEQ ID NO: 19678 - protein, 59 aa, Artificial Sequence
  Synthetic
EELLRTLEKVLREIAEELERLNRKVRESIRESARRLKRLIEKLERSIRRSAEELRKRAK

SEQ ID NO: 19679 - protein, 56 aa, Artificial Sequence
  Synthetic
DEIDKIVKKLRDILREIEKRAKEVNKRNKELLDELRERVKDLDRTNEELLRELKDS

SEQ ID NO: 19680 - protein, 59 aa, Artificial Sequence
  Synthetic
DKLLKKLKDVLDEIAERIKELIRELRESIKKSAEELKRLIDRVRRSIEESAKRLEDRAR

SEQ ID NO: 19681 - protein, 56 aa, Artificial Sequence
  Synthetic
SELEKILEKLRRIVEELAKSVRKLNEENKELLKRLADSVKKLDDDNKRLLTDLRRR

SEQ ID NO: 19682 - protein, 59 aa, Artificial Sequence
  Synthetic
EELLRTLEDVLRKIAEDLERMNRELKRSIKKSADDLKRLNEKVKRSIERSAEELRKRRT

SEQ ID NO: 19683 - protein, 56 aa, Artificial Sequence
  Synthetic
DEIKKIVEEIKKTLEEIDKSVRELIRRAREILRELEESVRELIRRNSKLLEDLRRQ

SEQ ID NO: 19684 - protein, 59 aa, Artificial Sequence
  Synthetic
DELLKELEDVLKEVAEEIKRLNERLKKVLEEIERTLRELNRRLEENIRRSARALEETRR

SEQ ID NO: 19685 - protein, 56 aa, Artificial Sequence
  Synthetic
SEVEDLLRRIEKILEDLRRSVEELLKRIEDALRRLEEEIRKVTEESKRLLEDLTRR

SEQ ID NO: 19686 - protein, 59 aa, Artificial Sequence
  Synthetic
RELIEEVEKVVKRVEEALKRLNDRVRETLDEVRKRLEDAIRRWREESERIARELEKRTT

SEQ ID NO: 19687 - protein, 56 aa, Artificial Sequence
  Synthetic
SEADEIVRRIEELLKELEREIRKVIRDSERLLKELEDSVRELLKKIRDVLDELTKS

SEQ ID NO: 19688 - protein, 59 aa, Artificial Sequence
  Synthetic
EELLRKLEAVLDKVKKDLKKMIDDWRRVSERIARELEKLNRRVKEELDRVKEALDERTR

SEQ ID NO: 19689 - protein, 57 aa, Artificial Sequence
  Synthetic
SEIDEVVERIKRTLEEAEKRVKKASEDHKRRLDELRKKVEKLIEDNERTLEAVARRK

SEQ ID NO: 19690 - protein, 59 aa, Artificial Sequence
  Synthetic
ERLLRKLRKVVKDVDDRLKELLEENRDVVRRIKEELEKLLEKVRRSIEESRRRMRETRR

SEQ ID NO: 19691 - protein, 57 aa, Artificial Sequence
  Synthetic
SEVDEVLKDIRRILEEARKRVEELDRENKRILDEVREKVKELNERNKEILRAAEERK

SEQ ID NO: 19692 - protein, 59 aa, Artificial Sequence
  Synthetic
EKLLRDAKRVVEEVSKALKDLLKEVEDSVRRSKREMEKLLEELRESVKRSEEELRRTSK

SEQ ID NO: 19693 - protein, 60 aa, Artificial Sequence
  Synthetic
DEVEDLLRRNEELLKRLLEEIKKLTDEHREELKRLAEDVKKVVEDVRRLLKELEEMVRRG

SEQ ID NO: 19694 - protein, 59 aa, Artificial Sequence
  Synthetic
EKLVRKLEESVRRSTEELEKALKRNNDVIRRIAEALDDLLRRLEKVIREIEKKLRDDTR

SEQ ID NO: 19695 - protein, 60 aa, Artificial Sequence
  Synthetic
DRVEEAVKDIERLLRELKRDVERLVRENEKILKDAKREVDELTKDHRRKVEELDEMVKRG

SEQ ID NO: 19696 - protein, 59 aa, Artificial Sequence
  Synthetic
EDLLRKLEKVVRDVEKKLRKLLEDLKRSIDRSTRELEKLNEKNNEVIRDIERRLDEAET

SEQ ID NO: 19697 - protein, 56 aa, Artificial Sequence
  Synthetic
SEIEKLIEEIRRVVKEIKREVERAIRENEKLLRESKRRNDELIKEIERVVEELKKR

SEQ ID NO: 19698 - protein, 58 aa, Artificial Sequence
  Synthetic
RLIEELEKVLRDVEKVARDVLRKLRRSIEESRRRSEELNKTVKKVLEDVARTATERSR

SEQ ID NO: 19699 - protein, 57 aa, Artificial Sequence
  Synthetic
REIEEAIKDVERVLRESEERNRRLIERIKRMLKKSEDENRKFIEDNKRLADDLRRRN

SEQ ID NO: 19700 - protein, 58 aa, Artificial Sequence
  Synthetic
EDVERLRKVIEEVKRRMKELNERLKEELREVAKRSRDLNKELRESIEESADRARRRRK

SEQ ID NO: 19701 - protein, 57 aa, Artificial Sequence
  Synthetic
DEIERLREDIKRVLEESTRRNKKLLDEIRKALDESRRKNEEAIRRNEEVVRDLKDRK

SEQ ID NO: 19702 - protein, 58 aa, Artificial Sequence
  Synthetic
DKVRTLRRELEEVARALEELNRRVEEELDEVRKESERLNKELEDSIRKSAEDAKRTTK

SEQ ID NO: 19703 - protein, 60 aa, Artificial Sequence
  Synthetic
DEKDKAIEDVRDLLRRNEEVARRMDKRLKDLLDTIRKKAEDLDRELKRLLEEAERLVREG

SEQ ID NO: 19704 - protein, 55 aa, Artificial Sequence
  Synthetic
KELEKVLEEIRRRSEELLKHHAEVIERIERDVERLRRHHEDTIRKIKEKVDRDRK

SEQ ID NO: 19705 - protein, 60 aa, Artificial Sequence
  Synthetic
DEDREAIKEVEKLLRDNERVARRLDEEVKELLDEMRRRSEEMDRELERLLEEAKRLADKG

SEQ ID NO: 19706 - protein, 55 aa, Artificial Sequence
  Synthetic
EELKEVLREVDKRSKELLKHHKRRIEEVRKRVRELNKHHEDVIRKIKKKVREDRK

SEQ ID NO: 19707 - protein, 60 aa, Artificial Sequence
  Synthetic
KEAEEAIKRVEDLLRRNKEVAERIIREIRRLLREADETSKRMDEDLRRLLREAEDLVRRG

SEQ ID NO: 19708 - protein, 55 aa, Artificial Sequence
  Synthetic
RELDKVLERVKRESDRLLKEIEKVVREVEERLRRLNEHHEKVIREIEKKLEDDRR

SEQ ID NO: 19709 - protein, 60 aa, Artificial Sequence
  Synthetic
DEDREAIERVRRLLDENRKVVEELDERLKELLRDAEEKSRRVIKTLRELLKEIEDLARRG

SEQ ID NO: 19710 - protein, 55 aa, Artificial Sequence
  Synthetic
DELRKVLEDVERASKELLDHHRDVIRRIEEELKRLNKELEKVIREIERAVEELER

SEQ ID NO: 19711 - protein, 60 aa, Artificial Sequence
  Synthetic
DEDRDAIRKVEDLLRRIEEIVRRLIEEVKRLLEDNRRKSKRFIERVDELLKEMEKLVREG

SEQ ID NO: 19712 - protein, 55 aa, Artificial Sequence
  Synthetic
KELEELLRRVEREVEKLLTDLRRLLREVKETSKRLNEELKRRADEVEKKADEDRK

SEQ ID NO: 19713 - protein, 61 aa, Artificial Sequence
  Synthetic
SSKDRIRKVLEEVRETLDRLAKRIEKSLRDSAKRVEDLAEENRTSLKETKERIDELIKRRK

SEQ ID NO: 19714 - protein, 55 aa, Artificial Sequence
  Synthetic
EELIRRIEEELKRIEDTVEKIIRKDEKLLEDIERESERHIREDKELLKELEKEER

SEQ ID NO: 19715 - protein, 61 aa, Artificial Sequence
  Synthetic
SSDKEIEDVLRKVKDELDKLARALDESLKRSEKDIDRLEEELKESHDRTREEIRKLIEERN

SEQ ID NO: 19716 - protein, 55 aa, Artificial Sequence
  Synthetic
DELIREIKKVLDRIREEIERLLREDEELLERLREDAKRILDKNKELLDELRRRVK

SEQ ID NO: 19717 - protein, 56 aa, Artificial Sequence
  Synthetic
SADRKLEEVLKKVEDDIRDLERRLKRSLDESKREVERLERENRRVLEEVEKKVRAD

SEQ ID NO: 19718 - protein, 59 aa, Artificial Sequence
  Synthetic
EETVKRIIEKIERILRKLKRDAERILDKDRKLLKKLEEESRKHIEDVKRLLEELERRTR

SEQ ID NO: 19719 - protein, 56 aa, Artificial Sequence
  Synthetic
ELEEKLKRSLEDSRRRVEELRRTNEEVLREVEEEIRRLIKENEDSLRESKKRVDDR

SEQ ID NO: 19720 - protein, 59 aa, Artificial Sequence
  Synthetic
KETVDKILEDDKELLRRLEEESKRHIDEVRKILEDLERRSRRHIEEDKKLITELEKETK

SEQ ID NO: 19721 - protein, 56 aa, Artificial Sequence
  Synthetic
DLDERLRRSLKRSKEEVERLRKENEEVLRRSKETTKELIKTNEKVLEDVERLVRES

SEQ ID NO: 19722 - protein, 59 aa, Artificial Sequence
  Synthetic
RETVEKIIKEDEDLLRKLKEESDRHIKDVERVARENERESKRHIEEVRKVLDELREETR

SEQ ID NO: 19723 - protein, 56 aa, Artificial Sequence
  Synthetic
SAEEKLEEVLKRVAERIEELIRRNRRVLDRVREEIKRLVEENRKSLDESERRVRER

SEQ ID NO: 19724 - protein, 59 aa, Artificial Sequence
  Synthetic
EETIERIIKKIEDILRKLEEESERHIRRVEEELKEMEKRSREHIEEDKRLLEELERRTK

SEQ ID NO: 19725 - protein, 56 aa, Artificial Sequence
  Synthetic
SAEDELRKVLEKVREDIDRLADENRKVLKRSKDETKRLIKENREVLERVEEIIRRD

SEQ ID NO: 19726 - protein, 59 aa, Artificial Sequence
  Synthetic
EEAIERIIRRIREILERLRKKSEEHIRRVEDVARRNEEESREHIKTVEKILEELKRKAD

SEQ ID NO: 19727 - protein, 56 aa, Artificial Sequence
  Synthetic
SEVEELIKRLKKVLKELVDKVRKVIEDTKELLERLKRRSEDHIRKLREVLKEAKDQ

SEQ ID NO: 19728 - protein, 59 aa, Artificial Sequence
  Synthetic
EELDRRIEKVLKEIEEKIREVIKEWERVHREVNELLKRLIDENRKVLDEIRKLLEEKSK

SEQ ID NO: 19729 - protein, 56 aa, Artificial Sequence
  Synthetic
SEAEDLIRRLKEVLDELKKKADDLIRDTKRLLDEIRKKSEDHIKRDKELLKDLKRR

SEQ ID NO: 19730 - protein, 59 aa, Artificial Sequence
  Synthetic
DRALREIEKVLKEIKELIEKVIRDWKRVHDEVNEELRRLIEKNRKSLKETADELDRKRK

SEQ ID NO: 19731 - protein, 56 aa, Artificial Sequence
  Synthetic
SEVEKLIKEDKELLERLKRDVERLIEELRRTLKELKKESEKHIEDDKRLLDDLRDR

SEQ ID NO: 19732 - protein, 59 aa, Artificial Sequence
  Synthetic
DKLITDIRRSLDETRRRIEKLIREIEKVLREIEETLRELEKRNRESLERTRETLERKSK

SEQ ID NO: 19733 - protein, 60 aa, Artificial Sequence
  Synthetic
SEVDELIERDKKLLRDVERDVRRLNKEVRDILDEIRKDVEDALKENKELLDRLREMVKRG

SEQ ID NO: 19734 - protein, 59 aa, Artificial Sequence
  Synthetic
REVLKRLEDSSKDTTDKLRELLRSHKKVIDEVREKLKELLDRYRKVSDEIREEIDRARK

SEQ ID NO: 19735 - protein, 60 aa, Artificial Sequence
  Synthetic
SEVEKLIEDDRKLLEDAEEEVRRNNREIERILDKAREDVKRIIKEIEDLLREADEAAKRG

SEQ ID NO: 19736 - protein, 59 aa, Artificial Sequence
  Synthetic
EEAKRRIKKSIDDSRRELKRLLESNRKVIEEVKKTLEELIRTLEEVVRRVEDRLKKLAD

SEQ ID NO: 19737 - protein, 61 aa, Artificial Sequence
  Synthetic
DSVEELLKRLRDLLEESKRRAERLIREIERLLRESEKRVRELNRRLEELLREAEDRVRKEG

SEQ ID NO: 19738 - protein, 59 aa, Artificial Sequence
  Synthetic
EDALRKLEKVIREIEREHRRLLEEIRRVLKEVDKRHDEVRKSHEDVIRRIEERLERLKK

SEQ ID NO: 19739 - protein, 61 aa, Artificial Sequence
  Synthetic
DSVERLIEEIRRLLKRSEEIARKLIRDAEKLLEEHRRRVEELNREIERKLEELDEKARRRG

SEQ ID NO: 19740 - protein, 59 aa, Artificial Sequence
  Synthetic
REALEKIRKVIKEVKDTHRDLLRRVRDVIRRIREASKETERSHREVIERVRKRLDELTK

SEQ ID NO: 19741 - protein, 61 aa, Artificial Sequence
  Synthetic
KSVDDIIREIRKLLEDHKRRVDELLERLKKLLEDHRRTVDKLIKDLERLLEELARRVKREG

SEQ ID NO: 19742 - protein, 59 aa, Artificial Sequence
  Synthetic
REALERIREEVRRVEEASERTLRELEKVVRRIERESEKLKRELEKVVEDAKRTLEKLIE

SEQ ID NO: 19743 - protein, 61 aa, Artificial Sequence
  Synthetic
SSIEKLLEELKELAKRHEDEVKKLIRELEDLARKHKERSEKLNEEIKKLLKELADRVRERG

SEQ ID NO: 19744 - protein, 59 aa, Artificial Sequence
  Synthetic
ERVRRRLRKVVEEIKERSDRTIREMEKVIREIKEESRRLNKSHEEVIRDVKRRADELRK

SEQ ID NO: 19745 - protein, 61 aa, Artificial Sequence
  Synthetic
SEVEDLLRDLERLLEEHRERVERLIKRLRELLERHKRTVEKLNRDVKEKLRKLKKEAEDKG

SEQ ID NO: 19746 - protein, 59 aa, Artificial Sequence
  Synthetic
EEALRRLKRVVEEIKRRSDRLIEKAEEVIRDIEEKSEETLKSHREVLERVKKILTDLRK

SEQ ID NO: 19747 - protein, 61 aa, Artificial Sequence
  Synthetic
DEIDRLLEDLRRLLEEAERRVTEIIKRIKKLLEEHERRVRELNKDLRRLLEEAEDVVRRKG

SEQ ID NO: 19748 - protein, 59 aa, Artificial Sequence
  Synthetic
EKARRDLERVVTEIDRELKRLEEDIRRVLEEVKRRSEDLRRSHRRVIEDIKRRLEELRR

SEQ ID NO: 19749 - protein, 61 aa, Artificial Sequence
  Synthetic
KEVEDIIREIRKLLEDHERKVKELIDEIRRLLEEHERTVRDLNRRIKKLLEEAKEFADRKG

SEQ ID NO: 19750 - protein, 59 aa, Artificial Sequence
  Synthetic
KEMIDRVRKVVEEVKKRSRETLERIRKVIEEVKARSKELIESHEEVIKRVEETLKRLKD

SEQ ID NO: 19751 - protein, 56 aa, Artificial Sequence
  Synthetic
SLEEEIKKLLKEVRDVNDRLKETIEDLAEKIERLAKRMIERIEEILREVDRLVKEV

SEQ ID NO: 19752 - protein, 59 aa, Artificial Sequence
  Synthetic
EDVIREILKEIRKHLRDSEEENKKTLDTLRKILEDLTKAAEDILEEIRRELDRLRKEAT

SEQ ID NO: 19753 - protein, 60 aa, Artificial Sequence
  Synthetic
SELEDILRRLREEVKRLREESRKLLEDNRRLVEEVKRESDKVLKRLKDKADRLKELAERG

SEQ ID NO: 19754 - protein, 55 aa, Artificial Sequence
  Synthetic
REIKTVIDELTRELERLNREHEDLTRKLREELKKLNKRIKDLIDTLKKLLEDLKK

SEQ ID NO: 19755 - protein, 56 aa, Artificial Sequence
  Synthetic
SEEEKLRELVKEVEKRTRELNENLRRSIEEVERDTEELDKNLEKSIREVKKVLDDL

SEQ ID NO: 19756 - protein, 56 aa, Artificial Sequence
  Synthetic
AEDVLRRIRELLERNEEVNRRLDEASKRLLEENRRKNKKLDDDSKELLKRLTERAK

SEQ ID NO: 19757 - protein, 56 aa, Artificial Sequence
  Synthetic
REKERLEKVIRELETKARELNKNLKKSIDDVRRETERLNENLKRSVDELRKRLKDL

SEQ ID NO: 19758 - protein, 56 aa, Artificial Sequence
  Synthetic
AEEVLKELRKLVEELERRNRELDKRSKDLLRENRELNKDLDRKSRELMERVERKTR

SEQ ID NO: 19759 - protein, 56 aa, Artificial Sequence
  Synthetic
SEEEKLERLIEDLERKLKELNDNLKESIDRVRKRTEELNRNLRESIKRVKEELERQ

SEQ ID NO: 19760 - protein, 56 aa, Artificial Sequence
  Synthetic
AEEVLRELEKLVEDLERENRRLDKESKDLLEENKKVNKDLDDESKRLLEEVSKEAK

SEQ ID NO: 19761 - protein, 61 aa, Artificial Sequence
  Synthetic
SDKEDVTRLLEEVSRASERSRKRWKDSSDEVKRTSEESIRRLRELLERLRERIERVIREKK

SEQ ID NO: 19762 - protein, 56 aa, Artificial Sequence
  Synthetic
VDELRKKIEEIVKRDEDLVRRLLEDSKRLAEEDRRLLEEVKREIDEIRKRIDEEVK

SEQ ID NO: 19763 - protein, 61 aa, Artificial Sequence
  Synthetic
DEIDELVRRIEELAERHHRRVDEIVKRNEEVLKELDERARRLVRENEEVLKRLEETVRREG

SEQ ID NO: 19764 - protein, 59 aa, Artificial Sequence
  Synthetic
ERAEKRLRDVLEKLRRDVERNREEIKKSAEDVRREVKRVTDELKESIERVRKRVKELKD

SEQ ID NO: 19765 - protein, 59 aa, Artificial Sequence
  Synthetic
EAERKVKTVVDELRRIVDELAKELEESLKRTDETIKRLARELERVDRELEEIIKELERK

SEQ ID NO: 19766 - protein, 55 aa, Artificial Sequence
  Synthetic
DEVVRKVEEEAERIKKRIKDLVRRDEKLVEDMRRRIKRLVEKNRKVAEKMRTDTD

SEQ ID NO: 19767 - protein, 60 aa, Artificial Sequence
  Synthetic
DLEELLRKVLEELRKIVEDARRENEKSLRESEKIVREVEELNKKVLEEVEKKIREVIEEK

SEQ ID NO: 19768 - protein, 59 aa, Artificial Sequence
  Synthetic
EETIKRIVDEIRKEAERLLRRHRKSVKEDKDLAKKIREDHKKSVEDIERTLEELEKRAK

SEQ ID NO: 19769 - protein, 56 aa, Artificial Sequence
  Synthetic
SEIEELVKEIKKVADEVRRRHEKSVREIERKLEELDKKVKDLVDEDKKLADELRRR

SEQ ID NO: 19770 - protein, 59 aa, Artificial Sequence
  Synthetic
DRVRRELERVLRDVERIIRDVKRTNKRVDDDVERRIRELRKELEDSLRRSKRIVDEVRR

SEQ ID NO: 19771 - protein, 57 aa, Artificial Sequence
  Synthetic
SEIERLVEEIEKLLRKMAEEHKRSVERDERLARKLKRENEEHIKTDEELVDRLRRRN

SEQ ID NO: 19772 - protein, 59 aa, Artificial Sequence
  Synthetic
DRVLRELKRVLDEVKKIIEDVAKENEDSDRRSKKIIEDVVRENKESLDRSREEIERVRK

SEQ ID NO: 19773 - protein, 56 aa, Artificial Sequence
  Synthetic
KEIEELVKRIEDEARRLKEEHKKSVREIEELLKRLTEEVRKLVERDKKLAEDLKDR

SEQ ID NO: 19774 - protein, 59 aa, Artificial Sequence
  Synthetic
DEMLRLLEKVLRDWEEIVRRVKEANDDVNRRVEETLRDLKRKLDRSLEDSERIIREVAT

SEQ ID NO: 19775 - protein, 59 aa, Artificial Sequence
  Synthetic
SVEDELRKVIKENEDVLREVEERVETVIKRNREVIEEVAREVERVIEETRRLLKEIEKA

SEQ ID NO: 19776 - protein, 59 aa, Artificial Sequence
  Synthetic
EESIKRLLEKIRKHSEEVKETIRRLLEKIEEHTERVKREIDKMLRSNEDLMRRIKEEAE

SEQ ID NO: 19777 - protein, 59 aa, Artificial Sequence
  Synthetic
SIKEKLDEAIERNERVLRRVEEEVRKSNEKNKEVLRRVSEEVRKVIEELEDLLRKIAEK

SEQ ID NO: 19778 - protein, 59 aa, Artificial Sequence
  Synthetic
DETAERLLRKIEKHSREVDETIRRMLEEDERHIKEVEDTIREMLERLKRLIDEAEKDAK

SEQ ID NO: 19779 - protein, 60 aa, Artificial Sequence
  Synthetic
DEVREVLKKIRELIKTNREHVTRLLRTIEELSRRSEEMIRRILEEIEKLIKDVRRLTEEG

SEQ ID NO: 19780 - protein, 59 aa, Artificial Sequence
  Synthetic
EEMEKLLEEAIKEAREDSRRSDREVEEVLRKHKKVNDRVREEIERVLRKLEELLKKDRT

SEQ ID NO: 19781 - protein, 59 aa, Artificial Sequence
  Synthetic
SEVDEIVRRLEELIRRNTEKVERLLERHERLIRELKERVKELLRKHEELAKEITELTKR

SEQ ID NO: 19782 - protein, 59 aa, Artificial Sequence
  Synthetic
KEARDRIRKVLEELKKKNKELEERIRKVSKELEKVLEDVKRESEKVSKELRERLERSKT

SEQ ID NO: 19783 - protein, 59 aa, Artificial Sequence
  Synthetic
SELERLEKEARDIVENLKRVLEELAKDVKRLLKESDELLKDLREKVREILERIEELARR

SEQ ID NO: 19784 - protein, 59 aa, Artificial Sequence
  Synthetic
ETAKRELERLVKELRDVHREVEKRLKELAKELREVNKRIKDDLDRLVEALEEVLDRVRR

SEQ ID NO: 19785 - protein, 59 aa, Artificial Sequence
  Synthetic
SELEELKRRIDELLKENEEILRELEERVRRLNKENRDLLRKLEEEAKRLVEEVRRVAEE

SEQ ID NO: 19786 - protein, 58 aa, Artificial Sequence
  Synthetic
EVKERIEKVLKDLERRNRESEKEVRRLLKELKESIDDSRRRVDELVKRLRKVLEDIRR

SEQ ID NO: 19787 - protein, 61 aa, Artificial Sequence
  Synthetic
SAEETLEKLIRDLEKSIRKSAEDLERLIRELEKSVRDSAKLLRDLIREVRDVVRDVVRAKG

SEQ ID NO: 19788 - protein, 55 aa, Artificial Sequence
  Synthetic
KDVAERVKELDKRNKDLLKRLEEEVRRLIKENERLLRELAKEVKELLERIKRAAG

SEQ ID NO: 19789 - protein, 61 aa, Artificial Sequence
  Synthetic
SAEDKLRELEKKLRKSIKESADRLRKLNEELRRSVRESAERLKELIREVEEVLRDVVRKRG

SEQ ID NO: 19790 - protein, 55 aa, Artificial Sequence
  Synthetic
EEVEDEVRRLDEENKKLLEDLKRSVDELIERNKRLLEELTKRVKELLDKIRKTAE

SEQ ID NO: 19791 - protein, 61 aa, Artificial Sequence
  Synthetic
SMEDSLRELIRKLRESVKRSAEELRRLNKRVEDSIRDSARKLRELIRRVEEVVKEVVETRG

SEQ ID NO: 19792 - protein, 55 aa, Artificial Sequence
  Synthetic
ERVEDDVRRIDDENRRLLEELKKSVDELDKRNEELLRRAEKEVRDLLREIREAMR

SEQ ID NO: 19793 - protein, 60 aa, Artificial Sequence
  Synthetic
DAEEELERLLRESERVSRDSARRLRELLKKLRRSVERSRREIDRLLKELEDVIREVIKRK

SEQ ID NO: 19794 - protein, 55 aa, Artificial Sequence
  Synthetic
KDLAREVEKVVKEDEDILRRAEEEVERLIETNRDLLRKVEREVKELVEKVEEDER

SEQ ID NO: 19795 - protein, 59 aa, Artificial Sequence
  Synthetic
SELEELKREVDELTEEHKELLKRLTERVKELSERHKELLERLRERSERLVRRIRELAKR

SEQ ID NO: 19796 - protein, 59 aa, Artificial Sequence
  Synthetic
DEVLRKAEELLRRNNRVIEEIEKRLRELLKENNDVIKEIRERLEKSNKELRDVAREVAK

SEQ ID NO: 19797 - protein, 59 aa, Artificial Sequence
  Synthetic
SELEELKKKVDDSIRENERLLRELTEDVKRLSKEHKDLLKRLEDKVEELIRRARELAKR

SEQ ID NO: 19798 - protein, 59 aa, Artificial Sequence
  Synthetic
DDMLEKAKKVHDEHRKSVEESTERLKELLRRNNEVIKDIARRLDELLRKLEKVVKEIAK

SEQ ID NO: 19799 - protein, 59 aa, Artificial Sequence
  Synthetic
DELRELEEEVRKSIETNRELLERARERVERLSEEHRKLLEKVKEDSDRLVEEVKDLERR

SEQ ID NO: 19800 - protein, 59 aa, Artificial Sequence
  Synthetic
DEVLRRARTLHDEHRRSVEESERRLKELLERNNEVIKDIERKLDKSNKELKDEAEKVKK

SEQ ID NO: 19801 - protein, 59 aa, Artificial Sequence
  Synthetic
SELEEIEKKVRELTKRHRELVERVRKTVKELIETNRRLLETLTERIKRVLEEVRDLERR

SEQ ID NO: 19802 - protein, 59 aa, Artificial Sequence
  Synthetic
DKALEEAKRVLRENNEVIKDIKRRLDELLKELEKSVRESEERLRRLLEEVKRVIEEVAT

SEQ ID NO: 19803 - protein, 59 aa, Artificial Sequence
  Synthetic
SSDREVEERVKRLTDRHRELLKRVEEEVKRSIKRNKDLLDELRKESEKLVKEARDLARK

SEQ ID NO: 19804 - protein, 59 aa, Artificial Sequence
  Synthetic
EDVLRLAEKLLKDNNKVIDEIRRRLDRLHEEHKKSVDDSREELKKSNKKLEEVVREIEK

SEQ ID NO: 19805 - protein, 59 aa, Artificial Sequence
  Synthetic
DDLREVEKEIRRIAEESKKLLEEIERAVEKILRDSRRVLEELARRAKRLLEELDKLKKN

SEQ ID NO: 19806 - protein, 59 aa, Artificial Sequence
  Synthetic
EDVRREVKRLVDELREVDRKIEEDLRELVRELEKVNREIRKRIEELVRRIKEVADEVRR

SEQ ID NO: 19807 - protein, 60 aa, Artificial Sequence
  Synthetic
DMEEKMRRITEEWRRVTEEIERRHREVIKKWRDVSREIAETHRRVIDELRRVLERIAERN

SEQ ID NO: 19808 - protein, 59 aa, Artificial Sequence
  Synthetic
KDIVDKELERLREEIRTSKKESDEVVKENEELIRDSKRKSEKVVRDNKRVIKEAEEKAK

SEQ ID NO: 19809 - protein, 59 aa, Artificial Sequence
  Synthetic
DEIEELLKEIKKLVDELRKRIEELAREHKRLADELRKKIKKLKDEHDRLVRELEKLAEK

SEQ ID NO: 19810 - protein, 59 aa, Artificial Sequence
  Synthetic
KEVKDKLDKLREELKRVADKLRDDLRELHKRLKEVADRLRKLLEDANRTLREVLKETKR

SEQ ID NO: 19811 - protein, 61 aa, Artificial Sequence
  Synthetic
SAEESAKRLKEELKKSLDRSREELDKLRKDNEKVLRDVEERLRRLIEELKKVLEDIKKDKG

SEQ ID NO: 19812 - protein, 55 aa, Artificial Sequence
  Synthetic
EELEKRVEKLLRDDKRRLDELRKESEDHIREIEDTLRRIEEEVKRLLKEMRDKLK

SEQ ID NO: 19813 - protein, 59 aa, Artificial Sequence
  Synthetic
SELETIARRVEKLNEDVERLLREAKKEADRLIKENEDLLREAERKVREIIERIRRLAER

SEQ ID NO: 19814 - protein, 59 aa, Artificial Sequence
  Synthetic
KEVKEKLTRLLKSHEDVIREVSRRLKELLDRYREVSDRIRKTLEELLKELRRVVEEVRK

SEQ ID NO: 19815 - protein, 59 aa, Artificial Sequence
  Synthetic
KDLEEIERKVRKLNEDDKKLLDDLRKEVEKALRRNEESLRKSREDAKKIIKEIEDLARR

SEQ ID NO: 19816 - protein, 59 aa, Artificial Sequence
  Synthetic
KEMKDALRELLRSHRKSSEDTKRELERLLREYEKVSRDVKRDHEKLLREIREVIEEVKK

SEQ ID NO: 19817 - protein, 59 aa, Artificial Sequence
  Synthetic
SELDEIRRRVEELIETDKDILRRIAEEVRKALEDNKKSLRESEEEVRRLLEEIKKLADR

SEQ ID NO: 19818 - protein, 59 aa, Artificial Sequence
  Synthetic
EEMKKLLEDLLRKSEDSTRETRKRLKELLDRYEEVSKKIKKRHKELIEELRKVIDDVRR

SEQ ID NO: 19819 - protein, 59 aa, Artificial Sequence
  Synthetic
RVEETLTRALKEIEEVIRRVDEESKRTIRSHREVIREVDEIHTRLLERLKKVIDDIRRR

SEQ ID NO: 19820 - protein, 59 aa, Artificial Sequence
  Synthetic
DRLLKEARDEVRKIIEEIRRLLEEHERTVKKLNEDIRKRLEESERTVEELLKRLRDRAR

SEQ ID NO: 19821 - protein, 59 aa, Artificial Sequence
  Synthetic
SMEEELKRLLESHEKVIREVRKTSEDTLRSHRKVIEEAKEEHKKLLEEIKRVVERVRKR

SEQ ID NO: 19822 - protein, 59 aa, Artificial Sequence
  Synthetic
ETVLREARKEVEKLNEDIRRLLEEHKRVVDELNKELRRLLEESRRRVKELIRRIEEEAR

SEQ ID NO: 19823 - protein, 59 aa, Artificial Sequence
  Synthetic
SVEERLRELIESHRRVIEKVERDSRRTIRSHEEVIKEVKKISEDTLREIRKVIEEAKKR

SEQ ID NO: 19824 - protein, 59 aa, Artificial Sequence
  Synthetic
ETLLRDAERRVEELNEEIRRLLEKHVRDVDRLNKEIRDLAREHKERAEEIIKRIEEKAR

SEQ ID NO: 19825 - protein, 59 aa, Artificial Sequence
  Synthetic
SEMERLERRARELLRRNEELMDDLRRKAEELLKRNDRLVKEIEKKVREVLRRIEELKRR

SEQ ID NO: 19826 - protein, 59 aa, Artificial Sequence
  Synthetic
KRLEELLRRLNEEHKRISDELRKLLDEALERHRELSRRLEEELERLLREIERLVEEVTR

SEQ ID NO: 19827 - protein, 60 aa, Artificial Sequence
  Synthetic
DDMERLEEEIKEILDRLRRLLERNRRVNKEIDERSKELVKRLEEKARRLLEELRRLKDRV

SEQ ID NO: 19828 - protein, 59 aa, Artificial Sequence
  Synthetic
KELEKKAEDVLREVKKVIDEVRTDSKRLNENLRESIKDVKREAERVLREVEEAIREVER

SEQ ID NO: 19829 - protein, 60 aa, Artificial Sequence
  Synthetic
REAEELKKEVDRILEELKKLLKENEDLNRDLDRKSKELLKENREKVERLRKELRELKDKV

SEQ ID NO: 19830 - protein, 59 aa, Artificial Sequence
  Synthetic
KELEDEAKRLKDEVEKLIEEIKRKSDELNKNLRDSIRRVEETTRDLLRKIKKLIDEIKK

SEQ ID NO: 19831 - protein, 57 aa, Artificial Sequence
  Synthetic
SIEEALEDLARRIKKILDDLRREAERLLREVEELLKRVEEANRRLRRTIEEALKRLA

SEQ ID NO: 19832 - protein, 56 aa, Artificial Sequence
  Synthetic
VETAEREIRRILEEIRRLAEEARRRIEEVLKRIKKHLEESKRRNEESLERIEREAR

SEQ ID NO: 19833 - protein, 60 aa, Artificial Sequence
  Synthetic
SVEETVDELKKRIEKILREIKRVNEELAKRNEDVNEEWRREVDKMIKDIERILRDVLRKE

SEQ ID NO: 19834 - protein, 56 aa, Artificial Sequence
  Synthetic
IEKLKRDAERILEEIKRAVDTSREESERTLKELRDMVKESRKDAEEVLERIDRDKR

SEQ ID NO: 19835 - protein, 60 aa, Artificial Sequence
  Synthetic
SVKETLEDLIKKIRDLLKRVRDENKRLAEDNERLNREVEKRNRELIKRIEDELEEVRKRE

SEQ ID NO: 19836 - protein, 56 aa, Artificial Sequence
  Synthetic
IRDLKREIEKILREIKKALEDSRRKSKETLDRIREVLKTSEEDIKRILKEIREAAR

SEQ ID NO: 19837 - protein, 61 aa, Artificial Sequence
  Synthetic
SREEVVKEIEKRVEELNRRLEETVRRVIEEMKRLNKESKEVSKKIVDEVRKLLDDVRREKG

SEQ ID NO: 19838 - protein, 56 aa, Artificial Sequence
  Synthetic
EDELRRLLERIEKTVRELKREIEKILEDATRTVEDLKRKNEELLRRLKKLADDVKK

SEQ ID NO: 19839 - protein, 59 aa, Artificial Sequence
  Synthetic
RVEEILRKASKENKEVIDRDRRLAEEATELNKRVVEEDRKVMKEVTKELEDVLRRAREE

SEQ ID NO: 19840 - protein, 59 aa, Artificial Sequence
  Synthetic
DKLLRELEERSKKVLEESKKTSEDLLRESEKHVRDWREKSRKLEEKVKRLVKKVKDTTD

SEQ ID NO: 19841 - protein, 60 aa, Artificial Sequence
  Synthetic
RAEDIIRELKRRNEEVLERDRELMERAARELREVLERLKDIAREASKELKRVLDELRKRG

SEQ ID NO: 19842 - protein, 59 aa, Artificial Sequence
  Synthetic
DEVVERLARESERVLRESEETSKDLKRKVDEELRRIEDTIRRLLKRVKDLVKKIEDTSR

SEQ ID NO: 19843 - protein, 60 aa, Artificial Sequence
  Synthetic
RLREIIEKLRRDNEKVIEEDRRVAEEVRKALEKVLREDRKMADEVTKELERALKELEDRG

SEQ ID NO: 19844 - protein, 59 aa, Artificial Sequence
  Synthetic
DEVIKELEKRSKDVLDESRDESRKLLERVERLLKKIREDSERLLERVEELLREAEETAR

SEQ ID NO: 19845 - protein, 60 aa, Artificial Sequence
  Synthetic
SVEEIIRKLEEDNRDVLRRDREVAKKVEDENRKVAEEDDRIVRRVAEELKRVLKELEDKG

SEQ ID NO: 19846 - protein, 59 aa, Artificial Sequence
  Synthetic
EKVIEELKDESRKHLEELEKDSKRLEDESKKHLDDWRRTSEKLLEDVERRVREIEEESR

SEQ ID NO: 19847 - protein, 60 aa, Artificial Sequence
  Synthetic
SSEEVVRELDKEIRKSIEDLKRIVRENEEENKRSVEDVREKAKRNEERLRKVLKEADERK

SEQ ID NO: 19848 - protein, 56 aa, Artificial Sequence
  Synthetic
IRELAKRVKRIVDENKRVAEEHHRKVERIVRENEKLLKEHHDRVEELVRRIKEEVE

SEQ ID NO: 19849 - protein, 57 aa, Artificial Sequence
  Synthetic
SEEEEVRRVLEELEKKVKRLTEEHRRRLDELRKKVKDHSRKNKELLERLREEIKRIK

SEQ ID NO: 19850 - protein, 59 aa, Artificial Sequence
  Synthetic
EEAKRVLEEVEKRVRELVKTNEDVLREIEEDVRRLVKENEDSIKESKDRLRELLERLKQ

SEQ ID NO: 19851 - protein, 59 aa, Artificial Sequence
  Synthetic
DEVEEIRKILEELAREAEKVVRETRKLLEDIRKEVEELNDRNRRLLEELERRVRDIKRR

SEQ ID NO: 19852 - protein, 59 aa, Artificial Sequence
  Synthetic
DEIRRVVEDVERRLRELLDRWRKVSEEVEKRLKELIDELRESIERSADRLRKLIEELKR

SEQ ID NO: 19853 - protein, 59 aa, Artificial Sequence
  Synthetic
REVEEIKKTLEDIRREAKELLDRTRELLDRLRKSVEELNRDNERLLREAKDEVEKVKRD

SEQ ID NO: 19854 - protein, 59 aa, Artificial Sequence
  Synthetic
EEIKKVVERVEREIEDLIRRWEEVSRDVEEKLKDLNKKVEESIRRSAKDLRELLREVEE

SEQ ID NO: 19855 - protein, 61 aa, Artificial Sequence
  Synthetic
SRAEKVLKRVTDLIRELLRTVTELVRRNREVIEELLRRVAKLHRDNRELNKKVLEDVRRDG

SEQ ID NO: 19856 - protein, 55 aa, Artificial Sequence
  Synthetic
EVVDELRRRIREVEKTLDRLLEESEERARRVLKELDRLLEESRKSSREVIEEAKR

SEQ ID NO: 19857 - protein, 56 aa, Artificial Sequence
  Synthetic
SVEELLKKLEKENRDVIREMKKLLDELEEENRRVIEEWRRITKELEDRNRRVREEI

SEQ ID NO: 19858 - protein, 59 aa, Artificial Sequence
  Synthetic
EEIIRRLVKHNKELVDEIRKTIERLREHNRKLVEKVREDVKRSTKHNRDLVKEVRDRAK

SEQ ID NO: 19859 - protein, 56 aa, Artificial Sequence
  Synthetic
SLEELLDRLRKLNETVIRDMERVLKELEERNRKVIKEDRDVLEELARRNEKVKRDI

SEQ ID NO: 19860 - protein, 59 aa, Artificial Sequence
  Synthetic
EEIAKELVKHNEKKVREIKKTIDDLRKHNEELVKEIRETSERLREHNERLLREALRRAK

SEQ ID NO: 19861 - protein, 60 aa, Artificial Sequence
  Synthetic
DLEEVVKDLERKLRDVARKDRKLVEDSRKILKDVVDKDRELVERSRRILEEVLERIRRRG

SEQ ID NO: 19862 - protein, 59 aa, Artificial Sequence
  Synthetic
RDTARKLLEDVADELRRWLEDSERLHKENKDTIEKWLRRSRKLHEENRKLIEDLLRTVT

SEQ ID NO: 19863 - protein, 59 aa, Artificial Sequence
  Synthetic
SLEDVLRELKERLERSHRKLRELVRRLEEDLKRVLRELEKIVDEVRKINEDVRREVERR

SEQ ID NO: 19864 - protein, 59 aa, Artificial Sequence
  Synthetic
EDIVRKLLEDVRKLVEELDRRAKELEERVKKVVDELLEKARRLLEKNRRTVEKILRDVK

SEQ ID NO: 19865 - protein, 60 aa, Artificial Sequence
  Synthetic
SEVEKLLREVEDRDRRILKKVKELLDEVRRLIEDHLRRSEDALRRVRKRIEELKELVERG

SEQ ID NO: 19866 - protein, 59 aa, Artificial Sequence
  Synthetic
ERLEEMLRRLKKSIEDSVREVRKVLKEAKDIARKVIEDTKRLLEELKRIMKKVLDELRK

SEQ ID NO: 19867 - protein, 60 aa, Artificial Sequence
  Synthetic
SEIEELVERVKARDEKHLRDSEKLLEEVKRRDRKLEEDSKKLLKDVKDLLRELEEVAKRG

SEQ ID NO: 19868 - protein, 59 aa, Artificial Sequence
  Synthetic
ERLRKLLDDLRKSIEESRKRSEEILREAEDTMRKSVETNERLLEELERELRRVVEELRR

SEQ ID NO: 19869 - protein, 60 aa, Artificial Sequence
  Synthetic
DEIERVLEEVERIDRELLKRSEDLLREVRERDKELEERSKRLLEKARRLIETLRDMARKG

SEQ ID NO: 19870 - protein, 59 aa, Artificial Sequence
  Synthetic
ERVKTIIDEARKSIDDSVRENKKVLDELKETIERSKKKNEDILREIEKILEEVREELRK

SEQ ID NO: 19871 - protein, 60 aa, Artificial Sequence
  Synthetic
KDVDELLERVKRRDEELERKVEKLLKRVRDLIREHDEKVKELEDEVRDRIKKLLEMAERG

SEQ ID NO: 19872 - protein, 59 aa, Artificial Sequence
  Synthetic
EELERVLRELKRSIETSTRRLRKILEELRRILEESERKVEEVLKELERIAREVEERLRT

SEQ ID NO: 19873 - protein, 60 aa, Artificial Sequence
  Synthetic
SDIEDVVRKVEEEVRDHNRRVEELLKRVERRDRRLEETVEELLKEIEDKLRRLKEMAERG

SEQ ID NO: 19874 - protein, 59 aa, Artificial Sequence
  Synthetic
ERLEKLLRELEETLRRSKERVKEVLEDLKRTITESKRRLKKILDEIRKRLEEVERDLKR

SEQ ID NO: 19875 - protein, 60 aa, Artificial Sequence
  Synthetic
SLEEVVDKLRRDSEESLKKNETVLRRVTKELTELLKRWREASERLKEELREVLERVRKKG

SEQ ID NO: 19876 - protein, 59 aa, Artificial Sequence
  Synthetic
EDTLRKLAEEVKRVVRDDEEKVKRLEEEVKEEVKKLEDDLRRSEERVERTIREIEKRAK

SEQ ID NO: 19877 - protein, 60 aa, Artificial Sequence
  Synthetic
SVEDLVREVERRLKTVLDEDEEVLKRVEDESRESIKENEEVLREVSERLDKVLKDVRRRG

SEQ ID NO: 19878 - protein, 59 aa, Artificial Sequence
  Synthetic
EEDLKRLEDRVEEEVRRAKRESDELLKRVRRTVEDDKRRLRELREEVKDLLERIREAEK

SEQ ID NO: 19879 - protein, 60 aa, Artificial Sequence
  Synthetic
SEVDEVRKRSEKVVEENERRIEESERRIAKLVKEVRDVIEDAKRRVEEILRRLEEEMRKG

SEQ ID NO: 19880 - protein, 56 aa, Artificial Sequence
  Synthetic
KDVLEEMRKTHERVIKEWERAHKEVNEKLEKIIRELEKVLEEVEDEAREVIRRLET

SEQ ID NO: 19881 - protein, 59 aa, Artificial Sequence
  Synthetic
SASEDLERVLRELAKEVEKLLRESEKLLKELEDLARELLERDRKLLKELEEKVKRLKER

SEQ ID NO: 19882 - protein, 56 aa, Artificial Sequence
  Synthetic
ERVLDDVRKRIEDLVRELKKVNEDIEKKVRELIERLRRSLEKSKEDIRRLVEELRR

SEQ ID NO: 19883 - protein, 60 aa, Artificial Sequence
  Synthetic
DMSEELEEILRRLEEESRRHLRTDEELLRELEEKIRRLLREIEEILERLKKRIDEVKTRN

SEQ ID NO: 19884 - protein, 56 aa, Artificial Sequence
  Synthetic
ERVLKRVKDRIDELIRRNEESLERTRDEIRKLIEELKKVLDRVKEEIEKLVEALKK

SEQ ID NO: 19885 - protein, 59 aa, Artificial Sequence
  Synthetic
EMTERLERVLEELKRKSDEHIKTDEELLRRLEKKSRDHLRELEEILRRLEREAREVKRN

SEQ ID NO: 19886 - protein, 56 aa, Artificial Sequence
  Synthetic
REALKKVEDAIDKLRRDNERSLERTKREIERLIRENKDVLDKIEKRIRELIEELER

SEQ ID NO: 19887 - protein, 59 aa, Artificial Sequence
  Synthetic
SADEKLDKILREMKKRSDDHIREVEKILRDLDREVKEILKKDEKLLRDLDRRVKDVKRR

SEQ ID NO: 19888 - protein, 56 aa, Artificial Sequence
  Synthetic
DEVLKRVEETVRRLVEENKKVLDRVREEIRKLIEELRDSLRRSEKRIRELADELRR

SEQ ID NO: 19889 - protein, 59 aa, Artificial Sequence
  Synthetic
DLEDILREIARLIERLIDENRKVLEEIARRLKELIEELKKSLKRSEELLRRLEKELKDS

SEQ ID NO: 19890 - protein, 59 aa, Artificial Sequence
  Synthetic
KDLLRTLEKVAEDLKRRSERHIRELRRTLEDLERDVRRLLREDEEKLKRAAEEVKEAIK

SEQ ID NO: 19891 - protein, 59 aa, Artificial Sequence
  Synthetic
DLEDVLRDIERLLRDLIRRNKEVLDRIRELIKKLIDENRKSLKRSKEELERLIRELAKS

SEQ ID NO: 19892 - protein, 59 aa, Artificial Sequence
  Synthetic
EELLRRLREVLERLKRESEKHLEELKKILEDLERESRRHIEEDKRLLKELKEEVDERIR

SEQ ID NO: 19893 - protein, 59 aa, Artificial Sequence
  Synthetic
SLEEVLKRIEDELRRLIEENKESLERSERLIRELKKRLEEVLRRIKKLLEELIRRLEES

SEQ ID NO: 19894 - protein, 59 aa, Artificial Sequence
  Synthetic
KKLLEDLKRTLDELRRESEEHIRRDERLAEELAREVEKLLKDMERILRELAKEVEDRIK

SEQ ID NO: 19895 - protein, 55 aa, Artificial Sequence
  Synthetic
DASRRVEEKLKEVEERVRKLLEEDRKRLKDSKRKVEELIERDKTELKKVKDRADG

SEQ ID NO: 19896 - protein, 56 aa, Artificial Sequence
  Synthetic
KKVIDTVRKRLKELLDELKKSVEDTHRENRRVLKELEESHKRTNERLDDLLRELER

SEQ ID NO: 19897 - protein, 59 aa, Artificial Sequence
  Synthetic
SLEDVVRRVREELERLLRTHEEVIRRVEEELRRLLEEYRKVSKEIEEDLRRLLKEVRDR

SEQ ID NO: 19898 - protein, 60 aa, Artificial Sequence
  Synthetic
VEDLLREIKKELEDVKRKVDKLNEEVERILKKAKDEVKEAIKENRDRLRRLRDEVRRLKK

SEQ ID NO: 19899 - protein, 59 aa, Artificial Sequence
  Synthetic
GLEDVVRRVEKRLEDLLRRYKKVSERLEREHRRVLDEYRKVSEEIDKILRDLLKEVRDS

SEQ ID NO: 19900 - protein, 60 aa, Artificial Sequence
  Synthetic
VEELLKEIEKLLKDIERTVEKALKENKDSIRRSKEKVDRMIKRNRELAKELEDKVRELKR

SEQ ID NO: 19901 - protein, 60 aa, Artificial Sequence
  Synthetic
SIEDILRELADTIRRLTEESEKILRKAEELLRRLTEEWRKSLKDLEDLIRKLIEEIRRRG

SEQ ID NO: 19902 - protein, 55 aa, Artificial Sequence
  Synthetic
EEIKKLMDEIRKKVEKHLREVEKVLREVEEEVKRELRKSEELARRIEEKIRREKK

SEQ ID NO: 19903 - protein, 61 aa, Artificial Sequence
  Synthetic
SEVEEALRRMEETIRRVREKLKKSLEDMRREIERIRRELEKSLEEFERDIERITRDIRRRG

SEQ ID NO: 19904 - protein, 56 aa, Artificial Sequence
  Synthetic
DDALRKIEELVKRLDRELREVNKEIEKVVRELKEELKRVDDEIERLVRELRKEAER

SEQ ID NO: 19905 - protein, 59 aa, Artificial Sequence
  Synthetic
DEIDEIRKVAERLEKEARELVKENEDDLKRHKERVDEIVKKIEEKVRRLEETARKLKEE

SEQ ID NO: 19906 - protein, 59 aa, Artificial Sequence
  Synthetic
EELKKVLEDLRRVLEKVHKLNREVLDKHREIVKRLSDKIKTVLRKLEEILKRAEEELRR

SEQ ID NO: 19907 - protein, 56 aa, Artificial Sequence
  Synthetic
SIEELLEEVERVVREVERRLDELLERNRRVIEEVRRRDDKLTKENEDVIRDVRRAG

SEQ ID NO: 19908 - protein, 60 aa, Artificial Sequence
  Synthetic
EEDLIREVEKRLEDIKDLLRRMKEEVERHSREVEDRLRRSEERWRDHSKKVKERLDRATT

SEQ ID NO: 19909 - protein, 59 aa, Artificial Sequence
  Synthetic
SLEEEVRRLLEEIKRLADENRDYVRRSLETNKKTNKDNRDEIRKALERIKRLAREIERI

SEQ ID NO: 19910 - protein, 56 aa, Artificial Sequence
  Synthetic
EKLLREVEELLRRVEEEHERLHRENRKLNDKDRETLERLIREVDDLLRKLEEEARR

SEQ ID NO: 19911 - protein, 57 aa, Artificial Sequence
  Synthetic
RVDELLEEVRKLVKDVHDTTEELLKEVERRLDEVKKRVDRSNEEVKELVKEAVKRSG

SEQ ID NO: 19912 - protein, 56 aa, Artificial Sequence
  Synthetic
DTKIEELLRRIEKYMRESKERIDRLLERIDEVLEKNERDVRKLLEDIRRMIEKDDT

SEQ ID NO: 19913 - protein, 59 aa, Artificial Sequence
  Synthetic
DTIERLLEDIKRILDKNRRDARRVLEEIKRSNEKNREDIKRIEEEIDRLLKEIKKKAEE

SEQ ID NO: 19914 - protein, 59 aa, Artificial Sequence
  Synthetic
KDVVKEVEELLKRVEETHRKLNKEVEELLERDERDLRRLIDDVRRLLEEVRKTLEDLRR

SEQ ID NO: 19915 - protein, 59 aa, Artificial Sequence
  Synthetic
RELEEARERIKELLEEIKDEVRRWREKIKRLLEDSRRKAERLKEDIKRLLEEIKKLSDD

SEQ ID NO: 19916 - protein, 59 aa, Artificial Sequence
  Synthetic
EDALRDIERLLREVDDAFRRLVEELRRLNEEVHRTTDELIREVEDMLRKVEEALKREKD

SEQ ID NO: 19917 - protein, 57 aa, Artificial Sequence
  Synthetic
EEIERVLEEIKRTADEIRKEIERVLEKSKKLLDDHHEEVKRMLERIRDKAKKVTDRG

SEQ ID NO: 19918 - protein, 58 aa, Artificial Sequence
  Synthetic
KVVEELRKILERLKDLVRDLERKLDELNKRVRDRVEENRKELEKLLREARDRIRELER

SEQ ID NO: 19919 - protein, 60 aa, Artificial Sequence
  Synthetic
SLEDRLREVLKRYEDRSRDLERELKRVLDEYDDSSRKVAEELKKVLDEIRETVERIKKDV

SEQ ID NO: 19920 - protein, 59 aa, Artificial Sequence
  Synthetic
EKEVADLVKKLEDDLRRTSDKVRRVVEEIKRRLEELERRYKALVKKLRDKLREIKEEVR

SEQ ID NO: 19921 - protein, 61 aa, Artificial Sequence
  Synthetic
DVEEELKKVDDKVEELVRKVIEDIRRALERVRELVERVRRKLEETNKKLKKLVEDIVRKKG

SEQ ID NO: 19922 - protein, 58 aa, Artificial Sequence
  Synthetic
EKVEELLRKSEELAKRIEDDVRRVLRKLEDTVRRIKEEIDRLLKDNERIIEEVKRRAD

SEQ ID NO: 19923 - protein, 61 aa, Artificial Sequence
  Synthetic
SVEEIIEDMLRKVRELVRRVRELLREVDEKLKKLVEDVRRRLEKTNKELKDLVEDIVRRSG

SEQ ID NO: 19924 - protein, 58 aa, Artificial Sequence
  Synthetic
EEAKRVLDKLRKTAEDIKRTIDELLKRSEETIKKIEDKIDKLVKKNKELVKRIEDEAR

SEQ ID NO: 19925 - protein, 60 aa, Artificial Sequence
  Synthetic
SLRELLDEVRRAVEESNRELERLLEEVDRSNRESHRELKRLLEKIKKLAEEVERELERKG

SEQ ID NO: 19926 - protein, 60 aa, Artificial Sequence
  Synthetic
EEEVKKAVEDLKRLVDTHKKRVEEVIDELRKHSEKHSEEVRRVITELARRLEELLDEIRR

SEQ ID NO: 19927 - protein, 59 aa, Artificial Sequence
  Synthetic
SAEEKVEDELRKHHEEVKRLLEEIEKTMRDHHREVEETLKDSRRELKRIEEEARKVKER

SEQ ID NO: 19928 - protein, 56 aa, Artificial Sequence
  Synthetic
EDILRKLEEEVRRNDKELRDLLEELKDLVRRNDEELRKLNEEVRKRVEELIEELRR

SEQ ID NO: 19929 - protein, 57 aa, Artificial Sequence
  Synthetic
SIEEMLKRVKEESKRSNDKIRDVLRKVEETSRRSKERIDKLLRDVERTVEEVIRDVK

SEQ ID NO: 19930 - protein, 60 aa, Artificial Sequence
  Synthetic
EKDVLDRLRRYVEENRRRVEKLIRDLEDAVRRNEDDARRVAKEIEDVVREIKDRVDKTRT

SEQ ID NO: 19931 - protein, 57 aa, Artificial Sequence
  Synthetic
SEVDKKLEDIRRRLEKLERETEESLDRVRKELEDLEKESRESLKRLREDLERVKKTK

SEQ ID NO: 19932 - protein, 59 aa, Artificial Sequence
  Synthetic
KKKADELRRVIEEIIRRLRELDEKHRRLVEEIIRRLEELNREHSKVVEEIARELKKTAK

SEQ ID NO: 19933 - protein, 56 aa, Artificial Sequence
  Synthetic
SLLEELKRSIEESIRTLKELLDRLEELIRRIAEEIRRLLEEHSRKTEEVIRRAEKA

SEQ ID NO: 19934 - protein, 59 aa, Artificial Sequence
  Synthetic
EKVIEELKRKLEEENKRLKKVVEEIAKTLKDLLDEVRRRIEDSLRKLEELLERVERKTR

SEQ ID NO: 19935 - protein, 57 aa, Artificial Sequence
  Synthetic
SLLEKLEKLIRDIKRTVDKLLEDNEETIRRIIRDIERLLKRHSDETREVVRTLKERG

SEQ ID NO: 19936 - protein, 59 aa, Artificial Sequence
  Synthetic
KDVIERIERELRELLKKLKEDADRHNEDAERKLRRLRDTIRRSLKKLEEDLRRLSKEAE

SEQ ID NO: 19937 - protein, 60 aa, Artificial Sequence
  Synthetic
SRVEETLKRLEDELKRIEEEVRKLLDELRRHLEENRRRTEKLLRELREELERVRERVEKG

SEQ ID NO: 19938 - protein, 59 aa, Artificial Sequence
  Synthetic
EKLLRRLERLVREIKRRLEELLKRLADLVRELKKEHERLNRELEELVRRIKERLKEAEK

SEQ ID NO: 19939 - protein, 56 aa, Artificial Sequence
  Synthetic
EEEERIKERLDRSVEELKKSADKMREEIERSEKKLKESADRVRKEIEDALRRIREE

SEQ ID NO: 19940 - protein, 59 aa, Artificial Sequence
  Synthetic
EDVVRRVEELLRRHEEVTKTINREIEELIKTHERSTRELNKEIKELIERLEETIKERTR

SEQ ID NO: 19941 - protein, 56 aa, Artificial Sequence
  Synthetic
KDAEELERRLRKSAEDLKRSAEEMKKRLDKSREDVKRKVEEAKKIVEDLEEDLKKR

SEQ ID NO: 19942 - protein, 59 aa, Artificial Sequence
  Synthetic
EEMVKRLRELLRTHEEITERINRKIEKLLREHEEETKRLLDDLRRLLEELRKKIEEEKR

SEQ ID NO: 19943 - protein, 56 aa, Artificial Sequence
  Synthetic
DEEERIEEELRKSTEKLKESLDRMRRDIEKSAEDLRKSVEDVERDMRRLLEDIEKR

SEQ ID NO: 19944 - protein, 59 aa, Artificial Sequence
  Synthetic
KDALERVRRLLERHERETRRINEEIERLIRRHVEETKRVNKRIKRLLDELKRRIEEKSK

SEQ ID NO: 19945 - protein, 56 aa, Artificial Sequence
  Synthetic
SEEEEIKKRIDDARKELEESTREVRERLRDSMRRLDESLKRVEEEIRKLADDIRRR

SEQ ID NO: 19946 - protein, 59 aa, Artificial Sequence
  Synthetic
EEVVRRVRELLKRLKEEVDRINDEIRKLLEDHKKRTEEVNETIKRLIDRLEEELRRRRE

SEQ ID NO: 19947 - protein, 60 aa, Artificial Sequence
  Synthetic
SEVEKIIEKIRREEDRNRREVEEKLKRIREHVRRNEEDTRRIIRELRELLKEALDRLRRG

SEQ ID NO: 19948 - protein, 59 aa, Artificial Sequence
  Synthetic
EKLLRELEELIRRVKKRHDELLKEVADLVKEVEDRHRKLNEELERVAREIEETLKRELD

SEQ ID NO: 19949 - protein, 57 aa, Artificial Sequence
  Synthetic
SEVETLLDKIRRDNEDLNRRVREELERIRKADEDVNREIEKVLRDIEEAIRKLKRDR

SEQ ID NO: 19950 - protein, 59 aa, Artificial Sequence
  Synthetic
DELVRRLEKILREHEENIKRIVEELERLLEEHKKNLEDLKRRLRDILRKVEEELDRTRK

SEQ ID NO: 19951 - protein, 57 aa, Artificial Sequence
  Synthetic
SETEELVKKIDKRDKEVKERAKRVVDEIKERDKRVNEEIEKVLRDIERTIKKVREDR

SEQ ID NO: 19952 - protein, 59 aa, Artificial Sequence
  Synthetic
KEMVDRLRELLERHEKTIRDLVRTLEELLERHRKNIEDLVRELRELLDRAREELKRTAD

SEQ ID NO: 19953 - protein, 57 aa, Artificial Sequence
  Synthetic
SDIEEALKKIKKMTRELREEIKKTEEESERRAKELEKEVRDYLRKVEEEAKRLKDTK

SEQ ID NO: 19954 - protein, 62 aa, Artificial Sequence
  Synthetic
EDIRRVLEELKKVLEENNRVIEELARRLDELNKKLRELLERIKKTLDDLNKRLEKLIRDTEK

SEQ ID NO: 19955 - protein, 57 aa, Artificial Sequence
  Synthetic
SKIEKMLRDIEKKTKELEDEIREALKRLREIAEKLKDEVEKYIRELRELLKRLAETK

SEQ ID NO: 19956 - protein, 62 aa, Artificial Sequence
  Synthetic
EKIREALERLRKILRENNEVIRELVERLRKVLEDLKRTVKTIEDRLRKVNEDLKRLIEELER

SEQ ID NO: 19957 - protein, 57 aa, Artificial Sequence
  Synthetic
SEAEKLIEDIKKLIEDHKKRTKELIDEIEEDIKKHREDVERLLRDIERLIEELEREN

SEQ ID NO: 19958 - protein, 59 aa, Artificial Sequence
  Synthetic
EEVERKVREAVKDVRRVLDESRRRLDTAIRKVEEDLRKSREDLERAVKKLRDVLEELKR

SEQ ID NO: 19959 - protein, 60 aa, Artificial Sequence
  Synthetic
SEVEKLERKTEKILKDLKDEVKRAEEETRRILEELKKMLEDMEKRTREILKRIRDLARDG

SEQ ID NO: 19960 - protein, 56 aa, Artificial Sequence
  Synthetic
EKKLRELNTELTRLIDEIRKRLEELNERLRKLVEEIEERLRRLNEELKRLVEEIRR

SEQ ID NO: 19961 - protein, 57 aa, Artificial Sequence
  Synthetic
KELEDTAEESKRELEKIRDEVRKEEEESEKLLRKIEKELREYAEKTRRILEKLRRDQ

SEQ ID NO: 19962 - protein, 59 aa, Artificial Sequence
  Synthetic
EEVARLLKKLNDELRRLIREIEERLRKLNDDLRELIERVEERLRRLNEELEKVIRELET

SEQ ID NO: 19963 - protein, 57 aa, Artificial Sequence
  Synthetic
DEVEDTERRSKKKLEELEEELRRTATESKRTLEELKRRLEDEERRSRDALRRLKEAN

SEQ ID NO: 19964 - protein, 59 aa, Artificial Sequence
  Synthetic
EEVKRRLERLNEEIEKLIRDIERTNRELNKELEDLIKEIEDRNRKLNEDLRRLIDELRK

SEQ ID NO: 19965 - protein, 61 aa, Artificial Sequence
  Synthetic
SELEEIAREVKETSKRHEEHVRRSEEEVKKTLKRLKEHVDKSSEDAERTLEELERRLRRDG

SEQ ID NO: 19966 - protein, 55 aa, Artificial Sequence
  Synthetic
DELRRLKEELKENIERAEESHKELADRLRELIKRIKERHEELLRRLRKLLEEIRK

SEQ ID NO: 19967 - protein, 60 aa, Artificial Sequence
  Synthetic
SAEEDLERLIRALKKVLDDHERLLRELLRRLEEVVRRHKELLKKLNRDLEEVLKDIKEKK

SEQ ID NO: 19968 - protein, 55 aa, Artificial Sequence
  Synthetic
DETDKEVRDTIRRIRKHSREVAEEVRKIIEELRRHSKKMADDSKRTIDELRERAK

SEQ ID NO: 19969 - protein, 60 aa, Artificial Sequence
  Synthetic
KVEEELDRLLKEIEKIIEEHRKKNKKLNDDIRRLIEEHERDLRELLKELEKLIRDLKKDL

SEQ ID NO: 19970 - protein, 59 aa, Artificial Sequence
  Synthetic
DRAVEEVRKRIEEILKRIRDNSKRVEEETRELLERIRRNSERLRRDVERLARELEEKKR

SEQ ID NO: 19971 - protein, 57 aa, Artificial Sequence
  Synthetic
SDEERLEEKLRRVEREVEKKLKRLKEELEEYARRVKEMSDRHREEVERFEEEVRRRG

SEQ ID NO: 19972 - protein, 59 aa, Artificial Sequence
  Synthetic
DTLRKLMEKIKRALEELLKRLEDLVRRIEEELRRLNEELRKNIREAEERLRKLKEDAER

SEQ ID NO: 19973 - protein, 60 aa, Artificial Sequence
  Synthetic
SADEILKEIEDTIRKLIEDNKRTLEEHERRTRKLIRELRELLKRHKTESRRLAEELKKDG

SEQ ID NO: 19974 - protein, 56 aa, Artificial Sequence
  Synthetic
GEEVRKRLEELKKKVERENRRHREHLKKVAKEVKRTLDEIRRHLEEVKERVKRARD

SEQ ID NO: 19975 - protein, 56 aa, Artificial Sequence
  Synthetic
SEEEELKRRVDEVRKRTKEIIEELKRHVDRNERTVREIIKRLEEEVRRVAEKVKRG

SEQ ID NO: 19976 - protein, 56 aa, Artificial Sequence
  Synthetic
SKVVEDVRRTLKRLNDELRKVVKDARELHERLLRDLKRVIDRIRERLKRLLDEAEK

SEQ ID NO: 19977 - protein, 57 aa, Artificial Sequence
  Synthetic
DEVETLAREVKKSNDDDRRKTKKTADDVEKKLEDLKRRDEEVRERVEEDLKRLREKV

SEQ ID NO: 19978 - protein, 59 aa, Artificial Sequence
  Synthetic
KEVLDRVADEIRRLNKETNDVDRDVRRRIDKLVEDVKRVTEEVSKEIKRLAEEVDRRIT

SEQ ID NO: 19979 - protein, 57 aa, Artificial Sequence
  Synthetic
DEVEELKRKVRESNKRDEDETRRTEERVEREVRRLEEEVKDVKRKVERELERIAREI

SEQ ID NO: 19980 - protein, 59 aa, Artificial Sequence
  Synthetic
REVVKEVEDRIRKLNRETNEVDKEVRKRVDDLIRDLERVLREVKEEVDRLVRKVEEDAK

SEQ ID NO: 19981 - protein, 61 aa, Artificial Sequence
  Synthetic
DEVEELVKRAEDILERLKREVDRLIKESEDLNRRIRKHVEDTIKEVRKRLEELRKEVEDRA

SEQ ID NO: 19982 - protein, 60 aa, Artificial Sequence
  Synthetic
AKDLLKEVVERVTRVAKAVKEKLDEVVRESREVIKRVEEKNRRVLEEVERVARELKKAID

SEQ ID NO: 19983 - protein, 61 aa, Artificial Sequence
  Synthetic
DEVEELVRRAEEELKRLRKHVEETVERSKKLNDEIKKHVDRTVKEAKDELRRLREEVKKRG

SEQ ID NO: 19984 - protein, 62 aa, Artificial Sequence
  Synthetic
EEAKKLLEDVARRVRKVAEELKKKNKELLETSDRVIEKVRKKNEDLKRTVDEVARRLEEAIK

SEQ ID NO: 19985 - protein, 60 aa, Artificial Sequence
  Synthetic
SEVDEVVERLRRISEELDRRVKKLVKDARRISKELEEAVRRVVKTAKDANKELRKEVRER

SEQ ID NO: 19986 - protein, 56 aa, Artificial Sequence
  Synthetic
VDTLAEDAKRSARETEEILRRLVKKLEESARDTKRIIDELDKELKDSNEEVRRRLK

SEQ ID NO: 19987 - protein, 57 aa, Artificial Sequence
  Synthetic
DEAEEVVKDVEREVRRLEKENRDLVERSKRLVERLEKESRDLVRKSREDVKRLREKG

SEQ ID NO: 19988 - protein, 56 aa, Artificial Sequence
  Synthetic
EEELRKDVERVVKKDEDITDEVRKENDEVVKKNEDIIDELRKKNEEVLRRVDEEAR

SEQ ID NO: 19989 - protein, 56 aa, Artificial Sequence
  Synthetic
SEVEDVVRKVRELVKRLRDESRRLVEESRRLVEELEKRSRDLVKTAEDIVRELKEA

SEQ ID NO: 19990 - protein, 56 aa, Artificial Sequence
  Synthetic
KDELDKEVKEAVKKNREIIRRLEKRNRDVVEENRKIIEDIEKKVRDVVREVRREAK

SEQ ID NO: 19991 - protein, 60 aa, Artificial Sequence
  Synthetic
SSLEEVAERVKKLVRELEESTKTVEELVRRLVTELRKSTEKVRRDVDKLVKELEEIIRDV

SEQ ID NO: 19992 - protein, 58 aa, Artificial Sequence
  Synthetic
REVKRLVEEVEKLIERLRRESRRLIERVRREARELKEESRRLEEEVRKKIEELARRVK

SEQ ID NO: 19993 - protein, 60 aa, Artificial Sequence
  Synthetic
RDLEEVKKKVDKLVRELEESSKKVRKDVEDLVKELEDTTRDVKRLVEELVTRLKRIIEKV

SEQ ID NO: 19994 - protein, 58 aa, Artificial Sequence
  Synthetic
REVKKIIEDVEREMERLERDSRRIVKEVREEADRLRKESKRLEEDVKRKLKELRERVN

SEQ ID NO: 19995 - protein, 60 aa, Artificial Sequence
  Synthetic
DELERVKEKVDKLVAELEKSTDDVKKKVEDLVRELERSSEKVKKDVDRLVKELEDIIRRV

SEQ ID NO: 19996 - protein, 58 aa, Artificial Sequence
  Synthetic
REVKKVVEDVRREAKRLKERSKKLEDEVRDLLRELEKRSDEITKRVREEMKRLEDEVK

SEQ ID NO: 19997 - protein, 60 aa, Artificial Sequence
  Synthetic
DELEDVKRRVEKLVRELEESSKEVRKRVEDLVRELERTTEEVEKLVRDLVRRLEDIIRRV

SEQ ID NO: 19998 - protein, 58 aa, Artificial Sequence
  Synthetic
EDIKRLEEDVERKLRRLEEESRRIVEEVKKEAERLKERSERLTKEVRELADRLAREVD

SEQ ID NO: 19999 - protein, 60 aa, Artificial Sequence
  Synthetic
RELEEVKRRVERLVRELEESLRRVRKEVEDLVRDLERVSKEVEDTVRELVRRLDEVIRRV

SEQ ID NO: 20000 - protein, 58 aa, Artificial Sequence
  Synthetic
REVKTLVEEVRRLLEELERRSRKLVKEVRDEAERLKREDEEIIREVRELLKELERKVR

SEQ ID NO: 20001 - protein, 55 aa, Artificial Sequence
  Synthetic
DELEEVKRTVEELLERLERVNKDVKRKVKELLDRLREVDDRVKKEVKRLIEEVKN

SEQ ID NO: 20002 - protein, 58 aa, Artificial Sequence
  Synthetic
EEIKKLADRVRRELKRSEDHTKRLAEEVRKDLEESRKHTKELEKEVEEELRRLKKEVR

SEQ ID NO: 20003 - protein, 55 aa, Artificial Sequence
  Synthetic
SELEEAAKAVEKLAREAEKSSEDARRAVERLAREAKRANDEAEKAVRELAERARR

SEQ ID NO: 20004 - protein, 58 aa, Artificial Sequence
  Synthetic
KEAKKLAKEAREIADRLRRESEEIAREAEKIAKELADHTRELAERARRIADKLKKDVK

SEQ ID NO: 20005 - protein, 60 aa, Artificial Sequence
  Synthetic
SAEDLIREVRRRVKELERKLEEILKRSEDLTRRLREEAERILKESRDRVRKLEEDARREA

SEQ ID NO: 20006 - protein, 55 aa, Artificial Sequence
  Synthetic
KEVIKKIRDILRRLSEELEKVLEDSERILRRLEDELRESLKRTEEILRELRRELK

SEQ ID NO: 20007 - protein, 56 aa, Artificial Sequence
  Synthetic
SVDEVLKEIEDALRRLKEEVERVLKENEDELRRLEEEVRRVLKEDEELLEELKRKV

SEQ ID NO: 20008 - protein, 59 aa, Artificial Sequence
  Synthetic
EKKIRDVAKEIRDRLKELEEEIEEVTRRNKKLLDDVEEEIRRVHEKTRRLLETVLRRAT

SEQ ID NO: 20009 - protein, 56 aa, Artificial Sequence
  Synthetic
RLEEVVEEMERLIRDLEKKVEDARERNERLVRESRKKAEELIKELRKLLRELEEEI

SEQ ID NO: 20010 - protein, 56 aa, Artificial Sequence
  Synthetic
VETVLKRVREVIRRVEETIKRLDDRNKESSEDVERRLRELLREVREIIKRVREKTR

SEQ ID NO: 20011 - protein, 56 aa, Artificial Sequence
  Synthetic
RLEDVVRESKKLVEESERRVREAIRRNEELVKDSEREAREVIEELKELLRRLEEEL

SEQ ID NO: 20012 - protein, 56 aa, Artificial Sequence
  Synthetic
VEDLLREVRRVDKEANEKIEELDRRNKKSSDDVKKKIRDLKREVKKVIDEVRERTR

SEQ ID NO: 20013 - protein, 57 aa, Artificial Sequence
  Synthetic
SELEKVLTESRDVVRRATKRLREVHKKTKEVVDRLREKLKRVEDEVRKAVRELEEKV

SEQ ID NO: 20014 - protein, 59 aa, Artificial Sequence
  Synthetic
KRLEDVLKESKKLTDDLRKDAKRVLDEDRRLVEELKKELDEARKRVEDLVREVKDRARR

SEQ ID NO: 20015 - protein, 60 aa, Artificial Sequence
  Synthetic
DEVEEVRKRVEEVIRRNEERIEDVRKKVEDVIRRNEKLVDDVRREVKEVLDKLRELLERR

SEQ ID NO: 20016 - protein, 60 aa, Artificial Sequence
  Synthetic
KETVDEVAERLKKLLEESERRVKRVLDEARKLVKRSEDRSKKVLDELEELLRRVRKEADK

SEQ ID NO: 20017 - protein, 61 aa, Artificial Sequence
  Synthetic
RELEELLEEARRSSEEVKKILKKLKKEVDESSERLERIIEKLLRDAKRVADEVRDILEKKR

SEQ ID NO: 20018 - protein, 60 aa, Artificial Sequence
  Synthetic
EERVKRVIDELRELLRRSREEVKRVVEELKKELERSKREVERVIDELRRLLETVEKEIRD

SEQ ID NO: 20019 - protein, 61 aa, Artificial Sequence
  Synthetic
SELEDLKRRIRKSSEDSKKSLEDSDRTIEESSRDSSRTARESERKLEKVLREVDDILKKVK

SEQ ID NO: 20020 - protein, 60 aa, Artificial Sequence
  Synthetic
EEDVERIVRELEELVRKSREDHKRVIDALREKLKKSREEHRRVIDKLRRELKRVEDEIRR

SEQ ID NO: 20021 - protein, 61 aa, Artificial Sequence
  Synthetic
SILEKLEREVRKSSRESRESAKKSLREIEESSRRVEEELERLLREVRRVAEEVLDILRRKK

SEQ ID NO: 20022 - protein, 60 aa, Artificial Sequence
  Synthetic
REEVKRIIERLRKLLEDSKRDHEEVIKELRKLVEDSRRRVEEVIRRLRELLKRVADELRR

SEQ ID NO: 20023 - protein, 61 aa, Artificial Sequence
  Synthetic
DELEEALRRLKKIVEDLARRNEELLKELRRDSKRLKDEIKRVVDELRDIVRRLKEELDRVK

SEQ ID NO: 20024 - protein, 62 aa, Artificial Sequence
  Synthetic
ERLERRVREIIRRAEELLERSRKRSEEIAREAEKSNRELEDAVRRIIRELEELLEKLERDAR

SEQ ID NO: 20025 - protein, 60 aa, Artificial Sequence
  Synthetic
DEVDKVTRELREIMRKLKEDDKEVLDRLREDSERVERTNREVEKRLEAIIRDLEEKLRRK

SEQ ID NO: 20026 - protein, 62 aa, Artificial Sequence
  Synthetic
ERLKEKVDRIREEAKRLLEELEKHVRDSEREAEDSNRRSRETSEEIIRRLRKKVKELEDKVR

SEQ ID NO: 20027 - protein, 60 aa, Artificial Sequence
  Synthetic
SEVDKVEEELERIVKELKDRDREVLKRLRDDSERLVRELKKVAEELRKIAKDIDERLKEK

SEQ ID NO: 20028 - protein, 62 aa, Artificial Sequence
  Synthetic
ERLKDRVDKIREKARKLLEELKKHVDDSIEEAKRSNEELRKTVEKIIREAEKLLRDLKEAVK

SEQ ID NO: 20029 - protein, 60 aa, Artificial Sequence
  Synthetic
SEAEKVERELDKIIRELKETDKKVLEDNRRVVEKIEREMERVLRELERIMKELKEELDRK

SEQ ID NO: 20030 - protein, 62 aa, Artificial Sequence
  Synthetic
ERLKEKVDEIRKRAEELVKELARHVEKSIRESRELDKRLEEKVKEIIRRARELLEDLRRKAE

SEQ ID NO: 20031 - protein, 57 aa, Artificial Sequence
  Synthetic
SEAEKVRREVEDLIRTLEEVVRKSSEEIKELLRRLREVVERIRDTTRRLIEEIEKKV

SEQ ID NO: 20032 - protein, 59 aa, Artificial Sequence
  Synthetic
REDLERVLKEVREIVKRLLKRLEESLRDVRRIAEELREMLKRSLKRSEEIIRKLLEDVR

SEQ ID NO: 20033 - protein, 57 aa, Artificial Sequence
  Synthetic
DEVDTVDEKVKRLAEELRKRVRESKERTKKLARDLREAVKESLKDSERLAEDLRRKV

SEQ ID NO: 20034 - protein, 59 aa, Artificial Sequence
  Synthetic
REKLERVEREIEKLVREVEKILRDIHRDNERVVREVERRLEEITRRSRELAKRVEDETR

SEQ ID NO: 20035 - protein, 57 aa, Artificial Sequence
  Synthetic
DEVDEVARKVERDAERLEDLNRRSEETSRRLAEELRRLNERSERETERLAEELRREV

SEQ ID NO: 20036 - protein, 59 aa, Artificial Sequence
  Synthetic
KKKLEDILREIEKLIRRVEEISRRILEESKRLADEVRKITKKLHDDNKRLADRVKEETR

SEQ ID NO: 20037 - protein, 57 aa, Artificial Sequence
  Synthetic
REIDEIKERVDRLAEKLRRDMERSTRESRKLVEELKERAKRSKEETTKLAEELRRRV

SEQ ID NO: 20038 - protein, 59 aa, Artificial Sequence
  Synthetic
KEELERILREIKRLMDEVKRILEELLKTNKKLIDEVRKRLEELHKRNRELVEEVARRAN

SEQ ID NO: 20039 - protein, 61 aa, Artificial Sequence
  Synthetic
SEVEAVEKEARELVREDERRDDEIEEDLRRLLEENRRKDDKVEKEVRELLKRLRDKVDDRA

SEQ ID NO: 20040 - protein, 59 aa, Artificial Sequence
  Synthetic
KRDVKRVRDTVRDISRKNNRTTEELLKRVRDISRRNKEITEELLRRIREIAEDLARKLD

SEQ ID NO: 20041 - protein, 61 aa, Artificial Sequence
  Synthetic
SEVEKVEEEVKRLVEENERRVRESSREVEKLLREDAERDERASRELKKLLEKLKRAVDKRA

SEQ ID NO: 20042 - protein, 58 aa, Artificial Sequence
  Synthetic
RAVEKVLRTARKISEDNKRKNDEISERLRRISERNNRESEKLLRDLEKIIEDVERKLE

SEQ ID NO: 20043 - protein, 61 aa, Artificial Sequence
  Synthetic
REVEEVEKKARELVERDERTDERIRKELEDLVRENKKEVKRVRETIERLLRDLKKAVDERG

SEQ ID NO: 20044 - protein, 59 aa, Artificial Sequence
  Synthetic
EEDVKRVEKTVEDISRKNNEITKRLRDTVRRLSEKNRRDLEKALEDLKRIVDDVRRKIT

SEQ ID NO: 20045 - protein, 61 aa, Artificial Sequence
  Synthetic
SEVEEVEKEARELVKRDEDRDKEIEDKLRELVERNRRLVRKSSEELKKEIKRLKDEVDRRA

SEQ ID NO: 20046 - protein, 59 aa, Artificial Sequence
  Synthetic
KEKVEKVLKEVRDISRENNKTTDTLEKEVRRLSEENKRRNEEVTRRVRKILEDVERKAR

SEQ ID NO: 20047 - protein, 61 aa, Artificial Sequence
  Synthetic
KEVEDVEEEVKKLVEENKKAVDDSREEVRKLLEENKKAVDDSRKEVEKLAKKLKEAVDRRA

SEQ ID NO: 20048 - protein, 59 aa, Artificial Sequence
  Synthetic
KEKVKRVLDEAKKISDDNKRKNEEVSKELEKISRDNLKLNEDITREIREIVERVDERLE

SEQ ID NO: 20049 - protein, 61 aa, Artificial Sequence
  Synthetic
SEVEKVEKDLRKLIKDNRDSVRRVKEEAEKLVEENRRSVEEVRRTIKELLERLEKLVRDRG

SEQ ID NO: 20050 - protein, 59 aa, Artificial Sequence
  Synthetic
KRLVDKVRRELEKILRDDNRIIKEVLDTVRRLSEDNLKKVKDVLEELTRIAEEVRERAR

SEQ ID NO: 20051 - protein, 56 aa, Artificial Sequence
  Synthetic
SKVEDLLEKLERELEKNRKRTKELLKRAEESSEDIREKVRELRERLERLIEELERR

SEQ ID NO: 20052 - protein, 59 aa, Artificial Sequence
  Synthetic
DKLLEDLERLVRRVLDEARKINEELDKRVKDSVREVEKRLRELEEEVKRIIEEVEKKAQ

SEQ ID NO: 20053 - protein, 56 aa, Artificial Sequence
  Synthetic
EELERLARIVDEAHKRSRDLLETSKREVEDAIDEIRARLEDSRRLVEEVTDEIRRI

SEQ ID NO: 20054 - protein, 58 aa, Artificial Sequence
  Synthetic
ERLKELKKRLRDLIEENDRRAKESTKKIRDLAKELRERARRTEEEIKTLMKELEDRMK

SEQ ID NO: 20055 - protein, 56 aa, Artificial Sequence
  Synthetic
KELEDLRREVEEIHKTSERLLRESDKLVEEAIRRIEELLERSKDTVTKAADEVRKA

SEQ ID NO: 20056 - protein, 58 aa, Artificial Sequence
  Synthetic
ERLKKLKEDVKRLIEENRKRAEDTKRKIEEEIRRLKEEADRTSEEIKKRADDLRRRAD

SEQ ID NO: 20057 - protein, 60 aa, Artificial Sequence
  Synthetic
DELEEVDKLVKKVHEDSRKLIEDVDRKVREVVERSDRIIETVEELVERVITEVEDMLRKG

SEQ ID NO: 20058 - protein, 58 aa, Artificial Sequence
  Synthetic
DRLRKVEKRIEDLARENEKRNRDLERKIEKLADESRKKNEDLKKRIEDLAKRLKDEAD

SEQ ID NO: 20059 - protein, 60 aa, Artificial Sequence
  Synthetic
SSLETVREEVRRVKEESDRIIKEVRDRVEEVHKTSKRIIEEVEERVERVIREVREMLRRG

SEQ ID NO: 20060 - protein, 58 aa, Artificial Sequence
  Synthetic
ERLDRVVEDIRRLAEESRRKNEELRKEVEELVKRNKELNEKLKKKVKELAKELRDEAK

SEQ ID NO: 20061 - protein, 60 aa, Artificial Sequence
  Synthetic
DDLETVKRLVDEVIRTSEELIDTVRRLVEEVHRESERILKEVKKEVERVIREVEKLRRKG

SEQ ID NO: 20062 - protein, 58 aa, Artificial Sequence
  Synthetic
KDLERVRKRIEDLAKELERRNRELEEDIKRLAKENEELARELKKEIETLAKRLEDEDR

SEQ ID NO: 20063 - protein, 60 aa, Artificial Sequence
  Synthetic
SSLEEVDRRVKEVHKESDKIIREVDKRNKEVNRRSEEIIEEVEKTVEEVAKTVDDMLRRG

SEQ ID NO: 20064 - protein, 58 aa, Artificial Sequence
  Synthetic
RELKRVKEEIDRLVEEDKEKNERSDKRAKETVDKNKKLNDDLEEKIRRLAEELRRRKK

SEQ ID NO: 20065 - protein, 60 aa, Artificial Sequence
  Synthetic
SSLKEVERLAKELHEKSERIIREVEKLSRELHKTSEKIIRDVARRVKKLIDDVREVITRS

SEQ ID NO: 20066 - protein, 58 aa, Artificial Sequence
  Synthetic
EELEKLRKRVEDLVRRNEEENKRTLRESEELVKENRKRNKELRDRVEKLVEELRRELK

SEQ ID NO: 20067 - protein, 60 aa, Artificial Sequence
  Synthetic
KKLEDVKELVERLHRESEEIIRDVERRSRELAETVKKILEEVRRLSKKLVDEVREVIKRS

SEQ ID NO: 20068 - protein, 58 aa, Artificial Sequence
  Synthetic
KDVDRVDREVEELVKENRERNKDTKRESERLAEKLRRDVEKSLRDSERLVKELRDRLR

SEQ ID NO: 20069 - protein, 60 aa, Artificial Sequence
  Synthetic
KKLEDVKRLVDKLVTESEDIIRRVTEESRRLVEESRRVIEEVKKLSEELVRRVEKVIREK

SEQ ID NO: 20070 - protein, 58 aa, Artificial Sequence
  Synthetic
ERVKKVKRDVEKLVRDSRELNKRTREESERLVEESERLNEESRKESERLVRELREKLR

SEQ ID NO: 20071 - protein, 60 aa, Artificial Sequence
  Synthetic
SKLEDVERKVRELVRRSKRVIKEVERLVRELHKRSEDVLRKVKKDSRDLAREVKDVIRRK

SEQ ID NO: 20072 - protein, 58 aa, Artificial Sequence
  Synthetic
KDVDKVRRDVEDLVRESRELNKRLKREVEELAKENRRRVEESRRESEELAKELRERLK

SEQ ID NO: 20073 - protein, 60 aa, Artificial Sequence
  Synthetic
SSIEKVLRELEDIVRKIEERNKKSHDEVRRVVEEIKRRVKKSHEDVRRVVEKIDEDIKRK

SEQ ID NO: 20074 - protein, 58 aa, Artificial Sequence
  Synthetic
DEIRRVKERLDELIRRLEELIRRNVTELKRLIDDLRRLVEENVRRLKELIDKLREDVK

SEQ ID NO: 20075 - protein, 60 aa, Artificial Sequence
  Synthetic
SEIERVLEELKKIVRRIKEKLKESHERVREVVERLKRRNEKSHRDVRRVAERIRREIEKK

SEQ ID NO: 20076 - protein, 58 aa, Artificial Sequence
  Synthetic
KDIREVKKEADRLIKELRDLIETNEREMKKLIDELEELIRDNARRLEELIKRLEEEVR

SEQ ID NO: 20077 - protein, 61 aa, Artificial Sequence
  Synthetic
SELEKVLEEAKRVVDEIKKKLEESHKDNRRTVEEIKRRNKESHERLKEAVDKLKAEIEKKR

SEQ ID NO: 20078 - protein, 58 aa, Artificial Sequence
  Synthetic
DRIREIAEELDKLIRELEKLVKRNADESDKLLDELRKLVEDNEREAERLIKELEDEAR

SEQ ID NO: 20079 - protein, 61 aa, Artificial Sequence
  Synthetic
SEIERVLRELEKIVEELKRENEDVHRRVREVVKKLKDENRKSHEEVKRMVDKIREEIKRIR

SEQ ID NO: 20080 - protein, 58 aa, Artificial Sequence
  Synthetic
DDIRRAAEKVDKLIKELEDLIRRNAEELRKLIEELEELIRRNRERLKRLIEDLKRAVE

SEQ ID NO: 20081 - protein, 57 aa, Artificial Sequence
  Synthetic
SEMERVEEEIRRLLKELDKKARDVHEADKELVKENRKLADEVERDLRRLLEELRRDV

SEQ ID NO: 20082 - protein, 59 aa, Artificial Sequence
  Synthetic
KKAIEDVLRKIKKLVEDLKRRIEEVLRESEALNEDTKRLIEEVLRDVRRTIDRLKKEAK

SEQ ID NO: 20083 - protein, 57 aa, Artificial Sequence
  Synthetic
SDMDRVEKELEELLRENEELAKDIHRRDKELLEENRELVRRAEEELRRLLEELARDV

SEQ ID NO: 20084 - protein, 59 aa, Artificial Sequence
  Synthetic
KEVIKDVLRKVRKINKETKELLRTVLEKSEKLNRDTKKRIKDVLEKIKRLIDELRERAR

SEQ ID NO: 20085 - protein, 57 aa, Artificial Sequence
  Synthetic
KEREDIEDRVRKLIEELEESVRRSNETVKKLLRELEKLLEDSNRSVEELARDLRRKV

SEQ ID NO: 20086 - protein, 55 aa, Artificial Sequence
  Synthetic
EKVLRKVEKVVEDLKRHNRKVNEEIKRVAEKLKRELEEVNKDIRRMARKLEEEVR

SEQ ID NO: 20087 - protein, 57 aa, Artificial Sequence
  Synthetic
SEAEKIAEDVERLARDLERLLKESNDTVRTLIEDLRRSVEETAKEVRDLIEDLRRRV

SEQ ID NO: 20088 - protein, 55 aa, Artificial Sequence
  Synthetic
EEVLKELKKVADELRRILEDVNRRIRKVVDDAREHNKKVVEDVRRVAKEARDRVR

SEQ ID NO: 20089 - protein, 59 aa, Artificial Sequence
  Synthetic
DEVEELERRIEKLAREVKKEIKDALRRNKRLIDEVKKIIEDVNRENRRLMEEVKRLIDA

SEQ ID NO: 20090 - protein, 58 aa, Artificial Sequence
  Synthetic
DELRRIAKRVEDLAEELKRLLDKSRETSERLVDELRKLLRESNETSKELVKRLDDRRK

SEQ ID NO: 20091 - protein, 59 aa, Artificial Sequence
  Synthetic
SEAEKLLKEAKRLADEAKKIIKRAHEENKRAADEAKKIIEEANRENEKLAREAKKLIDA

SEQ ID NO: 20092 - protein, 58 aa, Artificial Sequence
  Synthetic
DEAREIEKRVRELAEELKKLARESNEASKELAKELKELAERSNKTSEDLAKELEDRAR

SEQ ID NO: 20093 - protein, 59 aa, Artificial Sequence
  Synthetic
SEVERLLEEIKELAKRVKDIIKEVNKENKRLVDEVKDRIRKINEDNNRLVETVKELIRK

SEQ ID NO: 20094 - protein, 58 aa, Artificial Sequence
  Synthetic
KELERIEREVERLADELRKLLEESNESTERLAEELERLVRESERDSRRLAEELKRRLD

SEQ ID NO: 20095 - protein, 60 aa, Artificial Sequence
  Synthetic
SELEKLKEEIKKLADDVKRIIKKVLDENRKLVDDVKKIIKKVTEENRKLVREVAELIKAG

SEQ ID NO: 20096 - protein, 58 aa, Artificial Sequence
  Synthetic
KELEEIDKDVDRLIEELKRLLEDSNRDTERLAKELKDLLDESNKDSRRLAEELKRRTD

SEQ ID NO: 20097 - protein, 59 aa, Artificial Sequence
  Synthetic
REVDELRKEIRRLAKEVKDIIKKATERNEELVRRVKEIIKEVNRRNRKAAEEVKELIRA

SEQ ID NO: 20098 - protein, 58 aa, Artificial Sequence
  Synthetic
EDLERIRKEVEELARELEKLLEESNRETKRLARELEKLLEDSRRSTEELAKELEEAER

SEQ ID NO: 20099 - protein, 57 aa, Artificial Sequence
  Synthetic
REAEEVDKEIKKIVRDVRERIRKLNEDNRRIAEKVKREIEELNKRNRDTAKEIEKRG

SEQ ID NO: 20100 - protein, 58 aa, Artificial Sequence
  Synthetic
DELREIERDVDRLVEELRKLVEDSRRTTKRLVEELDELVETSDRETEKLVRKLRERER

SEQ ID NO: 20101 - protein, 57 aa, Artificial Sequence
  Synthetic
SDLERVLREIKKEVDDVKRLIRELNERNRTIVEEVKKLIEKLNRDNERIVREVKKRG

SEQ ID NO: 20102 - protein, 58 aa, Artificial Sequence
  Synthetic
EEVKRIEDEVRKLVRELEELLKRSDDDTERLVEELKELLKRSEKKTRELAKELRDRRR

SEQ ID NO: 20103 - protein, 57 aa, Artificial Sequence
  Synthetic
SEVDEVLKRIKEEVDRVKEEIKRLNKENNDIVRKVKKEDRDIVETIRKIAEDVKRRG

SEQ ID NO: 20104 - protein, 58 aa, Artificial Sequence
  Synthetic
DELREIDERVEKLVKELEETLRESEKDTKRLVEELEKSLKETEDDVRRLVKELKDRDD

SEQ ID NO: 20105 - protein, 57 aa, Artificial Sequence
  Synthetic
SKLEEVLRDIRRIVEEVKDEDRRIVEEIRKIAKDVKEKIKELNRENNRIVREVKERG

SEQ ID NO: 20106 - protein, 58 aa, Artificial Sequence
  Synthetic
DELRRIDEEVEKLVKELEKSVEDTKREVDRLAKELEDLVRDSKRDTDRLVKELKDRTD

SEQ ID NO: 20107 - protein, 57 aa, Artificial Sequence
  Synthetic
REVEEAADDLRRLIEENERSVRESKRTLEELIKENEDSVRRSEKSLRDLIRELEEEG

SEQ ID NO: 20108 - protein, 56 aa, Artificial Sequence
  Synthetic
VEELLKRVRDVSEESKRLDRKLNEDVKEVSKDSKRRDRELNERVRKVAEDVKETER

SEQ ID NO: 20109 - protein, 57 aa, Artificial Sequence
  Synthetic
SEVEEAAERAKRLIDKLKESADRSEKTARDLIRDLNRSTEEIAREARKLIEELKKAG

SEQ ID NO: 20110 - protein, 56 aa, Artificial Sequence
  Synthetic
VKKALEEVRRAAEEAEKADRKLNKEVKEAADRARELNKKLADEVRKAAKEAKEKAD

SEQ ID NO: 20111 - protein, 57 aa, Artificial Sequence
  Synthetic
SEVEEAAKEAKRLIEELNRSTEKIARDAKKLIEELRKSAKESADSARKLIEELKKRG

SEQ ID NO: 20112 - protein, 56 aa, Artificial Sequence
  Synthetic
VKKALEDVKRAADKAKEDNKKLLKEVEDAAREAKRADRELNKRVKEAADKAKEEAN

SEQ ID NO: 20113 - protein, 61 aa, Artificial Sequence
  Synthetic
DELEEVRERIERLIRRSEELNKKVEKENKELVDRSREINRRVLDEIRRLIREVERILEEEG

SEQ ID NO: 20114 - protein, 59 aa, Artificial Sequence
  Synthetic
EEEVRKLEEEVRELIKKLERSNRELNKETEKLVEDLKRSNKELEEDVERLARKLEEELR

SEQ ID NO: 20115 - protein, 61 aa, Artificial Sequence
  Synthetic
KELEEVEKRIEELARRVEERIKKVIEDNRRLVEESEKINEEVRREVKRLIDEVKEIIRRKG

SEQ ID NO: 20116 - protein, 59 aa, Artificial Sequence
  Synthetic
EREVRRLEERVEELARRLEELLKESNTRSEKLARDLEKSNEDLEREVEELAKRLEEELK

SEQ ID NO: 20117 - protein, 61 aa, Artificial Sequence
  Synthetic
DSVREVAERIDRLVKESERINREVIETNRRLFKESEKINDKVRKEIEDLIRRVKEIIDRDG

SEQ ID NO: 20118 - protein, 59 aa, Artificial Sequence
  Synthetic
EEDLRRLKKKVDDLARKLEESNRRSNEDSKRLARELEESNKDLKRRVDELARELEERLK

SEQ ID NO: 20119 - protein, 61 aa, Artificial Sequence
  Synthetic
DELKEVEERIERLIRESKRVNEEVKETNRRLVRESKEINKRVHDTVRRLVEEVRRIIDERG

SEQ ID NO: 20120 - protein, 59 aa, Artificial Sequence
  Synthetic
EKEVRRLREEVEKLAKELKRSNDESNKESERLVEDLKRSNTENSKAVEDLARELKERLK

SEQ ID NO: 20121 - protein, 60 aa, Artificial Sequence
  Synthetic
RSVEELKKKVEDLVRKLEELVKDSKRESKELVDDSERLVKELEDDVRRLVRELRERVRRR

SEQ ID NO: 20122 - protein, 59 aa, Artificial Sequence
  Synthetic
ERIIKRIEEEIEELIRRVEEIIRKVIKENRELVERDREIIKTVLERIRELIKEVTDRIE

SEQ ID NO: 20123 - protein, 60 aa, Artificial Sequence
  Synthetic
SEVEKLEEEVERLVRDSERLNKRLEDRVKKLVEDSERLVRELEKTVRDLVKKLKDDVRRR

SEQ ID NO: 20124 - protein, 59 aa, Artificial Sequence
  Synthetic
ERIIRRIRKEIKDLFDDDKRISEEVERRIERLFKEDKKIIEDVEREIRRLIKEVEDRIR

SEQ ID NO: 20125 - protein, 60 aa, Artificial Sequence
  Synthetic
DDVERLERRVRELIKESEKLVDDLRKDVERLVKKSRDLNERLREDVERLVKELEDRVRKR

SEQ ID NO: 20126 - protein, 59 aa, Artificial Sequence
  Synthetic
KEIIDKVRKEIEDLVRKDKEIIDEIRKEIRRLVEEDEEISRRVEETIRRLIREVAERIR

SEQ ID NO: 20127 - protein, 57 aa, Artificial Sequence
  Synthetic
SEVDELRKRVEELVRRSRKLVEEHRRKVRELVEESRRLVEELRRDVERLVKKLRDEL

SEQ ID NO: 20128 - protein, 60 aa, Artificial Sequence
  Synthetic
ARDLIEEVRERADRVAKKDEDVIRKSEEDTERVVREDKKIIDRVRKDVEEVIRRVEEETR

SEQ ID NO: 20129 - protein, 61 aa, Artificial Sequence
  Synthetic
STLERLTEDVKRVIREVEEVIKKLKEEVDKSLEDVRRKIEESRKETKRVIDEVKRRIKDKR

SEQ ID NO: 20130 - protein, 56 aa, Artificial Sequence
  Synthetic
VEELAKRLEELIRRLEELVDRLRKELKESIEEIRKRVRDHKEESKRLIRELDEEVK

SEQ ID NO: 20131 - protein, 61 aa, Artificial Sequence
  Synthetic
STLERLDEDVKRVAREDTELIKESEERTKKSADDVRKKIEDSRRTTDKVVTDVEDIIEKKR

SEQ ID NO: 20132 - protein, 56 aa, Artificial Sequence
  Synthetic
VEELAEKLKELLKDSERRVDEHRRKSEESTREIEELVKRHEDRSRELIKRLDEEVR

SEQ ID NO: 20133 - protein, 60 aa, Artificial Sequence
  Synthetic
SLLEKLRRRVDEVIKRDDELIEESKRRTDEALKRVEERIRKSLEETKEAVDRVRDIIRRV

SEQ ID NO: 20134 - protein, 56 aa, Artificial Sequence
  Synthetic
VDELRERLRKLLEDSEEKVKRHKDESDKLIKDIEDKVKRHEDESRRLIRELREELK

SEQ ID NO: 20135 - protein, 56 aa, Artificial Sequence
  Synthetic
SEADELRKKLEETNKDIKRRVEELKRRLEESNERIEELVRRNEKKSKDLLDDVRRR

SEQ ID NO: 20136 - protein, 59 aa, Artificial Sequence
  Synthetic
EEVLKRLDKKLEDSRRDVERVEKEVEELLRESEERVKRVVETVDKTDEEVKKDVDDKRR

SEQ ID NO: 20137 - protein, 56 aa, Artificial Sequence
  Synthetic
SEAEDLEKKAEDTNREIKKIAEELKKHAEDTNREIEKKVEDLRREAERILREVARK

SEQ ID NO: 20138 - protein, 59 aa, Artificial Sequence
  Synthetic
EEVLERLERKLRESKREVDRLAEKIKKLNDDSRKRVDEVVERVRRLLEDVKRKVDEARR

SEQ ID NO: 20139 - protein, 58 aa, Artificial Sequence
  Synthetic
DEVERLEEDVERSIRDSEKVVRDSERRVRESNEEIRRLIEESDKDVKRLIDEATKKSG

SEQ ID NO: 20140 - protein, 59 aa, Artificial Sequence
  Synthetic
REVIRELKERLKEISDRLKKRSEKSVRDLDDISRKIVRRSEDTVRKLREIARRLDERTK

SEQ ID NO: 20141 - protein, 58 aa, Artificial Sequence
  Synthetic
REKDELEEAVRRSNKRLKDILEKSRKDVEESIKRSEELLKRSDDEARKLIEEMTRKSG

SEQ ID NO: 20142 - protein, 59 aa, Artificial Sequence
  Synthetic
RKVIEDVLRELKKITDEIEKESRRSLDELRRISKELEDDSRRTLEELKKIVKELKDRET

SEQ ID NO: 20143 - protein, 58 aa, Artificial Sequence
  Synthetic
DEDRRLEEEVRKSIEESERVIERSEEEVRRLIEEARTLLEDSRRKVEDLLREMTRRAG

SEQ ID NO: 20144 - protein, 59 aa, Artificial Sequence
  Synthetic
REVIEKVLRELREISERLKRESERSLRELEEIARDLLRRSRRTVEELRRIAEELVKRAK

SEQ ID NO: 20145 - protein, 60 aa, Artificial Sequence
  Synthetic
DELEEVLERIEREIRRVSERSEELSRRNEKIIREVEEESRRILEEIKREIDEVKKRAERV

SEQ ID NO: 20146 - protein, 62 aa, Artificial Sequence
  Synthetic
EEAKKLVREVEETVRKLVEELREMNKRHEDKNRELSDRLREIDKRLEDEVRKLVEELRKKVE

SEQ ID NO: 20147 - protein, 60 aa, Artificial Sequence
  Synthetic
DELEEVEKEMERIIREVERKLREVNERIKEIIERVIRESKEILDELKRIIDEVKKRAERV

SEQ ID NO: 20148 - protein, 62 aa, Artificial Sequence
  Synthetic
EDAERLVRELRKKVEELKRRLEELNRDDKRTIDELVKTLDKIDRELRKTVEDLVRDLERDVK

SEQ ID NO: 20149 - protein, 57 aa, Artificial Sequence
  Synthetic
SKVDEVLKDVRRISEESERRIRELNDRSRKISKESEDRIRELLRRLEEIVERLKRTN

SEQ ID NO: 20150 - protein, 56 aa, Artificial Sequence
  Synthetic
AEELRKEVERLIRENEELVERHRKTVEELRRRNEELVKRLEDTVRKLEKELKEEAD

SEQ ID NO: 20151 - protein, 57 aa, Artificial Sequence
  Synthetic
SELDRAADRLRKISKRSEEEIRKLNEEVKKISKESEEKIRRLNEEVKRIVEEVKRRN

SEQ ID NO: 20152 - protein, 56 aa, Artificial Sequence
  Synthetic
AKELAEIVEKLIRDNRRLVEEHEESVRRLEDRNRKLVEDHERTVRKLIKELRETRR

SEQ ID NO: 20153 - protein, 57 aa, Artificial Sequence
  Synthetic
SELEKLLRDLEEIARKVEEEIRTLNEDVKRISKESKERIDRLKEELKKIVDDLKKRR

SEQ ID NO: 20154 - protein, 56 aa, Artificial Sequence
  Synthetic
AEDLRREVERLIRELRKLVREHERSVRKLIEENRRIVRELEELVKKLRKELEDTLR

SEQ ID NO: 20155 - protein, 57 aa, Artificial Sequence
  Synthetic
SELEEAERRLREIVRKVEEDSRKLNEELKREVDEVRRRSEELNKRVRDEAERVRKEN

SEQ ID NO: 20156 - protein, 58 aa, Artificial Sequence
  Synthetic
EKAEDLARIVKKLVEDLKRLNKRHKESVDELVRRLEELDREHERTIRRMIEELRETER

SEQ ID NO: 20157 - protein, 60 aa, Artificial Sequence
  Synthetic
KEVEKLLEDLKEVARRVSEEIKRLLKELKEVSKRSEDRIRTSLERVKKVVEDVLREADEF

SEQ ID NO: 20158 - protein, 55 aa, Artificial Sequence
  Synthetic
RELKEEIEKLLRRLRKLVKELKEEIKKIVDRNRKLVREHEARSEELKEEIRREVE

SEQ ID NO: 20159 - protein, 60 aa, Artificial Sequence
  Synthetic
SEKEELLKRVAEVSKKSKDRARELNERLKKVVDEVLETIRKLNEDLKRVVERVKEKIKDK

SEQ ID NO: 20160 - protein, 55 aa, Artificial Sequence
  Synthetic
KELRKEAKRNVDENREVVKENKRTTEKLLRDLDRILKENKRTVEKLVRELREEVR

SEQ ID NO: 20161 - protein, 60 aa, Artificial Sequence
  Synthetic
DEKERLLEDVKRASEDSERRIRELNDRVRRVSEESERRIRKLNKELRDEVEKVLREIDRI

SEQ ID NO: 20162 - protein, 55 aa, Artificial Sequence
  Synthetic
DELREEIEKNLRRNEELVKKNKKDSEDNKRDNDRLVKENEKTTEDLLRRAKEEVD

SEQ ID NO: 20163 - protein, 60 aa, Artificial Sequence
  Synthetic
DETETVEKKLRDVLERVKKDSEDSREELKRVHKRSEELSRRSNKELDDVLDEVRRIIERS

SEQ ID NO: 20164 - protein, 55 aa, Artificial Sequence
  Synthetic
EELKKRLDEMRKTIEKLLEDTKEELRELIERNKKLLDDTARRAEEIIKEIEDRSK

SEQ ID NO: 20165 - protein, 60 aa, Artificial Sequence
  Synthetic
SREEKVLEDLDRVLKRVTDLSKESLDEVERVHEESERLIRDSNRVLRDVLEKVREIITKS

SEQ ID NO: 20166 - protein, 55 aa, Artificial Sequence
  Synthetic
KELKDRAREVIRRIEKLVEDTERALRDLIRKNEELLKRTEEELKRAEEDIRRKSK

SEQ ID NO: 20167 - protein, 61 aa, Artificial Sequence
  Synthetic
SDAERVLREIERLLEELKELVERVVRKSEELLRRAKRVNEEVNREIKKLADELEEVIRRKG

SEQ ID NO: 20168 - protein, 59 aa, Artificial Sequence
  Synthetic
KEVVDTLRRVVEEITRELEELLERLRRVSEEIRRTLEELLERTRRLVEEIERKLREALK

SEQ ID NO: 20169 - protein, 61 aa, Artificial Sequence
  Synthetic
SELDDVRRKIKRLIDELKRVNEKVNKDSEDLVREVERVNRDVNRRVKELLEELKRVIDERG

SEQ ID NO: 20170 - protein, 59 aa, Artificial Sequence
  Synthetic
EEMVERLRREVEKLERELRELLRRTEENSRRAKERLEDLLRRTRELVKRIEERLREELR

SEQ ID NO: 20171 - protein, 60 aa, Artificial Sequence
  Synthetic
SDVERLKKRVDELAERLKRLDEELKKEVDRIETELRELLKRHEDRNRDISRRLAELLKDA

SEQ ID NO: 20172 - protein, 59 aa, Artificial Sequence
  Synthetic
KEIVERILEELDRLMEKVERVSREILKTIEKLARDIKKRIEEVTRESERLAREVEEALR

SEQ ID NO: 20173 - protein, 60 aa, Artificial Sequence
  Synthetic
DEVETLEKRVRELERRLEELNKELREEVRKIVERAKELDKRHKDDNERIEKELRELLRDV

SEQ ID NO: 20174 - protein, 59 aa, Artificial Sequence
  Synthetic
DEIAKRILDEIDRLMEEAEKVTRDILRKVEELLRRVEDASRRVTKKSRELLKKVKEDLR

SEQ ID NO: 20175 - protein, 60 aa, Artificial Sequence
  Synthetic
SEVETLEKAVRDIVERLKDLNRRLEKEVRDAVKRLRDLLREHEKRNREIAKDLTDKLRKA

SEQ ID NO: 20176 - protein, 59 aa, Artificial Sequence
  Synthetic
KEAATDILRKAEELADEVRRATEEIAKEIRRLVKEVEEVIKDVTRKSDELLKRVADAAK

SEQ ID NO: 20177 - protein, 60 aa, Artificial Sequence
  Synthetic
DELETLADVVRKLIERSRDLLRRHEKRNDEIKKRLDELDRELKERAEEIKKRLEELLRRR

SEQ ID NO: 20178 - protein, 60 aa, Artificial Sequence
  Synthetic
AEDVVRDVLRKAEKVVEEDERLIRRVTEESDRVLDRVEKETKKIVDEAKRMLREVEERIR

SEQ ID NO: 20179 - protein, 60 aa, Artificial Sequence
  Synthetic
SLIDELRERVKEIKKRSEELLKRHEDENRRIVKRSRELLKKLRDVVRDIIRELRKELEDD

SEQ ID NO: 20180 - protein, 60 aa, Artificial Sequence
  Synthetic
AEEVVRRVLKEAEDLLRKDEKILRDVTRRSEKALREDEELAKRVLDEMRKVLEDVKRKSK

SEQ ID NO: 20181 - protein, 60 aa, Artificial Sequence
  Synthetic
EELERLAESVRRIKERLKKLDREHEERNKRIVETSRKLLEELEREVRKIEEDLKRLLDER

SEQ ID NO: 20182 - protein, 60 aa, Artificial Sequence
  Synthetic
AEEVVRDILRRLEELMRRAEEVTKKLTDDSRRLLKEDEDLVREIEERLRRLLKEVKERVD

SEQ ID NO: 20183 - protein, 60 aa, Artificial Sequence
  Synthetic
DEDRDVKREVKKVHEDSARTVEKLDREVEKVHEESERTVRKSEKEAKEVLDRVKDIVKKK

SEQ ID NO: 20184 - protein, 55 aa, Artificial Sequence
  Synthetic
EELKEDLKRILKENEDLVRELEKKLDDIMRENEELVREHEEKSKRIVRELEEEVR

SEQ ID NO: 20185 - protein, 60 aa, Artificial Sequence
  Synthetic
EEKERADRKLEEVHKESKKTVEDSDEALERVHRESKRTVEESRKTLEDVVREVKRIVEEK

SEQ ID NO: 20186 - protein, 55 aa, Artificial Sequence
  Synthetic
KELRRKVEEILKRNEEEVRKHKEKSKKIVEDNRRLVKRHKEESEEVVRDAAREVK

SEQ ID NO: 20187 - protein, 61 aa, Artificial Sequence
  Synthetic
DEDREALKEVEDVHRRSEEKVRESRRRAEEVHKESKKIVDELRRRSEESLKRVEDEVRKKR

SEQ ID NO: 20188 - protein, 55 aa, Artificial Sequence
  Synthetic
EELKDELRKIVETNRELVRRHHETVKKIMEENERLVRELEKRLEEADRKLEEEVR

SEQ ID NO: 20189 - protein, 61 aa, Artificial Sequence
  Synthetic
SLEEEVRRIVDDIRRTNKELLDRSARRAEEIERRLEELLRRSRERADRIREEMRRMLEKAG

SEQ ID NO: 20190 - protein, 59 aa, Artificial Sequence
  Synthetic
KKTVDDVLKRLKEENDRSREEIKRSNEESDRVLDEVRKRSEDSNRRLDKIVDEAKKELK

SEQ ID NO: 20191 - protein, 57 aa, Artificial Sequence
  Synthetic
DELEEVLERLREIAERVIKESKEINDELKRSSERSKRESDKVNKRMREIMKELKDRG

SEQ ID NO: 20192 - protein, 59 aa, Artificial Sequence
  Synthetic
EEDVRRIRKLVEDIARRLKEIIERNRESVRKSREENKKSIEENRRSVKKIADEAREDAR

SEQ ID NO: 20193 - protein, 57 aa, Artificial Sequence
  Synthetic
EETERLIEAVKRIAEEVRKTIERLMERVEKTTRESEELNRRLNRELDREVEEVERAN

SEQ ID NO: 20194 - protein, 55 aa, Artificial Sequence
  Synthetic
EELEKVVREVAERLDRLLKALRDLVEESARRNKRLIEETDRRIKEIAERLKRTSD

SEQ ID NO: 20195 - protein, 60 aa, Artificial Sequence
  Synthetic
SEAERLLEELERSTRESAKRIRDLADKLRRSSEESVKDIERLTKELEEAVRRVLDKIRKK

SEQ ID NO: 20196 - protein, 59 aa, Artificial Sequence
  Synthetic
EEVVRRLAKVVEESRRTNEKLLRDLEKLVEDSKRRNDELLEKNARRIKEVEDELKRETK

SEQ ID NO: 20197 - protein, 60 aa, Artificial Sequence
  Synthetic
KDAEDLLRRLRESTKRSEDLVRKLLEELERSSRESEKLIRELTDRLDKVVKDVERRIREK

SEQ ID NO: 20198 - protein, 59 aa, Artificial Sequence
  Synthetic
EEVVKRLEKAVKESEDRNKELLDRLRKRVEDSKRRNDKLLKENRKRIEEIKRRLDELLR

SEQ ID NO: 20199 - protein, 60 aa, Artificial Sequence
  Synthetic
SKAEKLLRDLEKSTEDSERRIRELLERLRESSRTSEELAKRLEEEVERATREVADKIRKK

SEQ ID NO: 20200 - protein, 59 aa, Artificial Sequence
  Synthetic
KEVVDRLREIVERSREKNRKLLEDLRRAVEESKKRNEEVLRKLKKKVEEIEEELKERLR

SEQ ID NO: 20201 - protein, 60 aa, Artificial Sequence
  Synthetic
SEIEELLKTLKRSTEKSEEDARRLLEELTRSSEESVKRLRDLTERLKEVAKEVIERIRRR

SEQ ID NO: 20202 - protein, 59 aa, Artificial Sequence
  Synthetic
KKVVDRLKRMVDESRKRNEELLKRLEKRVRESRKRNDELLEENKRVIDKIREELERLRK

SEQ ID NO: 20203 - protein, 60 aa, Artificial Sequence
  Synthetic
SLLEEIEELVRRAIDTVRRSSEELKRLVDRVNETNKRSTEELRELAERVDRRLDKLLKEI

SEQ ID NO: 20204 - protein, 59 aa, Artificial Sequence
  Synthetic
RELVEKLKRELRRILEEVRRLNEELMKEIRDTNRKSEKLNRDLKEEIKKILEDVEREVR

SEQ ID NO: 20205 - protein, 60 aa, Artificial Sequence
  Synthetic
DEAEKLKERLKRVLRRVREINRKLLDELRKSNEKVRRINKRLKEELKRVLDEVEKRVRED

SEQ ID NO: 20206 - protein, 59 aa, Artificial Sequence
  Synthetic
EKLVREIEEMVRRLKEEAEKLSEEIRKIVRESRETLKKLSDEVRRLVERAEEKARKDTK

SEQ ID NO: 20207 - protein, 61 aa, Artificial Sequence
  Synthetic
KEDDDLRREIERLLRELEKMNRKVLEDARRLLEELRRVNKEVAERIKDLERRLKDVVEKKG

SEQ ID NO: 20208 - protein, 55 aa, Artificial Sequence
  Synthetic
ERVKEEVDEIRDRLRKSNETLREIVRRIEEDLRKSDRELEELVERIEKRLRELVR

SEQ ID NO: 20209 - protein, 60 aa, Artificial Sequence
  Synthetic
KLVEEVKRLIEESARKNEELIKEVEKEIRRSRKRDKELIEEIERLIREVKKRLEELLTEK

SEQ ID NO: 20210 - protein, 62 aa, Artificial Sequence
  Synthetic
EEAEELVRRVKEEIKRSTTESEKLVKEVKDRARKSHEDSERLAREVLKEIRRLLEEVEKDVR

SEQ ID NO: 20211 - protein, 60 aa, Artificial Sequence
  Synthetic
KEVEDVKELIKKVNEEIKKIHERSNEEIKRVNEELRKIIKKVKDDLRRVLEEIERLSREG

SEQ ID NO: 20212 - protein, 59 aa, Artificial Sequence
  Synthetic
EDLLREAEKLVEDSRRSSEELVRRDKKLVKESRETSERLVRDLERLLREIEKRVREEAT

SEQ ID NO: 20213 - protein, 60 aa, Artificial Sequence
  Synthetic
SEVETVAELIKDVNRRIREEVEEVKRRIEELNDRNRKIAEEVKERIRRVEDEIREARKRG

SEQ ID NO: 20214 - protein, 59 aa, Artificial Sequence
  Synthetic
DELLTRIDRLVKDSERSSRKLVRELEELVRRSEEETEKLVRELERLVTEVARKVDEEAT

SEQ ID NO: 20215 - protein, 60 aa, Artificial Sequence
  Synthetic
KDVEEALETLKRILDRVAKDNEDLIRELRDINRKITKENEDLIRDLERILREVEEEVKRR

SEQ ID NO: 20216 - protein, 59 aa, Artificial Sequence
  Synthetic
DELRRRLEALVEDVRRTLKELIEKTEKVVKEVEDNLRRLLKRTEEVVREVEKKLEEDRR

SEQ ID NO: 20217 - protein, 60 aa, Artificial Sequence
  Synthetic
SEVEKVLEDLKRILEEIARRNEELNERLERINEEITRRNEKSNEETKRVLDKLADDVRKR

SEQ ID NO: 20218 - protein, 59 aa, Artificial Sequence
  Synthetic
EELERTLEKLVDEVRKRLKELLDRSRELVKRVRENLERLEEDTRRLVERVRRELEKLRK

SEQ ID NO: 20219 - protein, 60 aa, Artificial Sequence
  Synthetic
DEAEKVKRDIEEILKRVAEELKRVLEEIRRSSEEVERRNKEVLETLKRILEEVKERLKRI

SEQ ID NO: 20220 - protein, 58 aa, Artificial Sequence
  Synthetic
ELVRELRELVRRIEEELRKLTEEARKLLEDNRRRLEELDRELKELVDRIREELERARK

SEQ ID NO: 20221 - protein, 60 aa, Artificial Sequence
  Synthetic
DEAEKVLEDIKRSSEEVTRRNEKVARDSRKLSEDVEKKNRDVAERIKEIVDKVRRDLSRI

SEQ ID NO: 20222 - protein, 58 aa, Artificial Sequence
  Synthetic
ELVERARELVETNKKRLEDLDRELEELVKENEERLKRLDERLKELVDDIRRRAEEARK

SEQ ID NO: 20223 - protein, 60 aa, Artificial Sequence
  Synthetic
REAEELLKDLERSSEEVDRRVKESNKESEKVSRDVEKKVKDSNKELREITREVAERAKRT

SEQ ID NO: 20224 - protein, 59 aa, Artificial Sequence
  Synthetic
EKMIKRAAELLKTSEDRLRKLIKESEDSIRENEKKLRELIRESEETLREIRKRLEDLER

SEQ ID NO: 20225 - protein, 60 aa, Artificial Sequence
  Synthetic
KEAEDLMEELKKSSEDVERRVRESNKRSKEVSDRVAEEVKKLLERLKKILEEAARKRDRV

SEQ ID NO: 20226 - protein, 59 aa, Artificial Sequence
  Synthetic
EKVIRTIERLVRTSEKKLRKLLDDSRKSVEENRKRVTDLKKEARDLVEDIKRRLEEERR

SEQ ID NO: 20227 - protein, 61 aa, Artificial Sequence
  Synthetic
REEEKVLKDLDDVLKEVTERVREDLRTNEDVVRRAEEEVTRLHEELKRSNDRAKEEVDRKK

SEQ ID NO: 20228 - protein, 55 aa, Artificial Sequence
  Synthetic
EEVRKLVRELKEMLKRLEEDARRLVETTKKRLEDLKRTTDKLVKELEKTLEELRR

SEQ ID NO: 20229 - protein, 60 aa, Artificial Sequence
  Synthetic
SDRERVAKKLRDVLKEVDEEAKKDHDTNKTVVKKVREDIERILRRLKEVLRKVKEEAERK

SEQ ID NO: 20230 - protein, 55 aa, Artificial Sequence
  Synthetic
EELRKLVKELRDRLRELEESSRKLVEDTRRDLERLREEIDRLVEELERRLEELRR

SEQ ID NO: 20231 - protein, 61 aa, Artificial Sequence
  Synthetic
SDAETVLREIRKLNKEVNDASRETLERIEELNRRVERIVREVLKDIERLAREVEEVVRREG

SEQ ID NO: 20232 - protein, 59 aa, Artificial Sequence
  Synthetic
EELIRRLEEIVKESEDNSKENVDRNDRIVRESERSSKELEDELRRIVKKLAREVDELIR

SEQ ID NO: 20233 - protein, 61 aa, Artificial Sequence
  Synthetic
DDVERVLERIKELNRRVEEIVRRVLKTSRDLNKELNDISREVLKRIKDLMREVEEVVRRDG

SEQ ID NO: 20234 - protein, 59 aa, Artificial Sequence
  Synthetic
EELIRELERIVEESKRTSDKLAKELDKLNEDSERNSRKNIEDLRRLVEELARKAEELIK

SEQ ID NO: 20235 - protein, 60 aa, Artificial Sequence
  Synthetic
SLVEELEKLVEENERNMRELDKENRDIVEKNRENVERNERELRKLVERLERRIREVVRTK

SEQ ID NO: 20236 - protein, 60 aa, Artificial Sequence
  Synthetic
LEEIVREVKERIKRSNDEANKENKRTLDEIRDSNRDVNRVSKEVLDEIRRLLKELEDAAK

SEQ ID NO: 20237 - protein, 60 aa, Artificial Sequence
  Synthetic
SLIETLEELVDRNRRNLEKLDEENKDMLRKNEEDVEKNERDLRKLVKELRDEIRKLIEEK

SEQ ID NO: 20238 - protein, 60 aa, Artificial Sequence
  Synthetic
LEDIVREVIKRIEESNRRVNKRNRETLERSKKSNKDVNEASERVLRRIKELLDELRERAK

SEQ ID NO: 20239 - protein, 60 aa, Artificial Sequence
  Synthetic
SLEEELRRLVEELEKRLRELDKRNKDLLRENERNVEKLARDLEELVKKVRRVVEDVVTKK

SEQ ID NO: 20240 - protein, 60 aa, Artificial Sequence
  Synthetic
LEDIVREVLKRVKDLLERAEEENKKTLDDSRKSNEEVNREVEKVIRRIEELVKRLEEAAK

SEQ ID NO: 20241 - protein, 60 aa, Artificial Sequence
  Synthetic
DLVERLEELLKKIKRELEENIKRNRELLKKLEENLRRNEEKNRKLLEEIRKRLEDLLREK

SEQ ID NO: 20242 - protein, 62 aa, Artificial Sequence
  Synthetic
EEAEELVRRVEERMKEMVKRVHEVSEKNLRDIKKWLEDVNRISKETLDRLRELLKEAERRVR

SEQ ID NO: 20243 - protein, 60 aa, Artificial Sequence
  Synthetic
SLREELEELLKRIKERLKRLIEENRRLLEDLRRNLEENIRRNERTVEELKRDVKRLLDEK

SEQ ID NO: 20244 - protein, 60 aa, Artificial Sequence
  Synthetic
AEELVRRVKEEMERAVEEVKKTSEENLKAIKTWLEEVNRISEETLRRMREVLKELREDAK

SEQ ID NO: 20245 - protein, 60 aa, Artificial Sequence
  Synthetic
RLVEELEKLLKDSHDKDRKLIRENEELLKELKRNLDENIKTNEELVDRIRKRVEDLLREK

SEQ ID NO: 20246 - protein, 60 aa, Artificial Sequence
  Synthetic
AEDLVRRVEKEARDSSDESRRISEENLKEIKKWLDEVNEISKRTLEDAKRLLEDLERKAT

SEQ ID NO: 20247 - protein, 60 aa, Artificial Sequence
  Synthetic
DLEEELKTVLDRARKDVKRLKEELERILEEVKRMVEELDKRLEDLDEEVREKVKRLIDEK

SEQ ID NO: 20248 - protein, 59 aa, Artificial Sequence
  Synthetic
ERDVKRVLREAEELLKRVRDLVEKVLREIKRILEEVEELNRRIIRTSREILKRVEEEVK

SEQ ID NO: 20249 - protein, 60 aa, Artificial Sequence
  Synthetic
SLEERLDKVRRRVEEEIKRLEDRLEELDRRVAETVKRLDDEARKLDEELRERVKDIIRKK

SEQ ID NO: 20250 - protein, 59 aa, Artificial Sequence
  Synthetic
EEKVKRVIEEMEEIVKEVRKRVDEVIKTSEEILRRVRELNKEILKESEDLAEEVRKKAT

SEQ ID NO: 20251 - protein, 60 aa, Artificial Sequence
  Synthetic
KLEDELRKILEENRRIVKELEERMKRLDEAVRKAVEDLARSNEESNKRVKEVVDDLIRKK

SEQ ID NO: 20252 - protein, 59 aa, Artificial Sequence
  Synthetic
EEDVKKVLDDIKESSDRVRREIEEVLKESEERLRRVEKKNEDIDRRSEEILDDVRRKAK

SEQ ID NO: 20253 - protein, 60 aa, Artificial Sequence
  Synthetic
SLEEKARDVLRRSKELNDENRERAERMLDTNRRIADKLREEVERILREVEETVRRLIDEK

SEQ ID NO: 20254 - protein, 59 aa, Artificial Sequence
  Synthetic
EDVVERLLKEVEDSSRRVHKRSEELLRESREISERVRETVKKLLEDVERLLRKVTKEVK

SEQ ID NO: 20255 - protein, 60 aa, Artificial Sequence
  Synthetic
SLEDELREVLERSREKNERLRREAKKLLDTDRERVREILREAEKVLEEVKRTVEDLVREK

SEQ ID NO: 20256 - protein, 59 aa, Artificial Sequence
  Synthetic
EKVVEELLKRVEDSSKKVEDDVRRLLKEVEKISTELEELAKELVEEVRRIVKEVADRVK

SEQ ID NO: 20257 - protein, 60 aa, Artificial Sequence
  Synthetic
SLEERAEKILRDSKRTNEKNEEDVRRLLERNERRVRKIEEEAKKVLEDVRREVERLIREK

SEQ ID NO: 20258 - protein, 59 aa, Artificial Sequence
  Synthetic
EDVVRKLLDEVRESSERVHRKSEELLRRVEEISRTVEREVKKLLDRVRRVLEEAEKEVR

SEQ ID NO: 20259 - protein, 60 aa, Artificial Sequence
  Synthetic
DESRELVERVERVVRKVEKDHERLDRANKESTDRVREAVRRLDEENREVVRKVEDEVKKV

SEQ ID NO: 20260 - protein, 55 aa, Artificial Sequence
  Synthetic
KEAERLLDDVRRKLEELVRNAERSLEESRKTNEELEKRVRESLKEVERVLRELEK

SEQ ID NO: 20261 - protein, 60 aa, Artificial Sequence
  Synthetic
RETEEVIKTLEEVVKEVEERVRRLDEENKESTERVKKTVDDLDEENKRVVREVERRVKEV

SEQ ID NO: 20262 - protein, 55 aa, Artificial Sequence
  Synthetic
KRMEEVLKRVDERLKELERKVTDSLRRSREVNKRLRDKVEKSLREVEKVLEDLKR

SEQ ID NO: 20263 - protein, 60 aa, Artificial Sequence
  Synthetic
SLEERLREILKRNKEDVEDIRRRLEEILKRNKEEIDRLREELRRILEEVKREVKELIKRK

SEQ ID NO: 20264 - protein, 59 aa, Artificial Sequence
  Synthetic
EKTAEEVIERIKKLTEDVRRDVERVIREIEKSSDDLRKVVKDVIDDIKRLLKELREEIN

SEQ ID NO: 20265 - protein, 60 aa, Artificial Sequence
  Synthetic
SLEERLRKILTENERVIRKLERDLEENLERNKKTVKEIEDRLRKLDEDVERLVRELLRRK

SEQ ID NO: 20266 - protein, 59 aa, Artificial Sequence
  Synthetic
KDTAEEVIKEIEELTRRLEEEVRRVNERSDKSNEDVRRRVKEVEDESRDLARRLAERVN

SEQ ID NO: 20267 - protein, 60 aa, Artificial Sequence
  Synthetic
SLEERLRKILEKVKRTVDESRKRSKRLLEENRETMDRLREEAEEILERVKEKIKELVDRK

SEQ ID NO: 20268 - protein, 62 aa, Artificial Sequence
  Synthetic
EEAEKLVEEVIRDLDRVADELRELSKRLSDRSRESNERVRRTVKEVIKEIKRVLKELEEKVK

SEQ ID NO: 20269 - protein, 60 aa, Artificial Sequence
  Synthetic
DLRERMEKLLKEVKDEIDKSEKKSEDNLRTNKKDVDEIRKRLKRILDEVKEELRKLIDEK

SEQ ID NO: 20270 - protein, 60 aa, Artificial Sequence
  Synthetic
AEELVDRVAKRIRRVVEDVKRKSEDLNRKSNESNKRVRDLVERVKEEIDKVRDELRKSVK

SEQ ID NO: 20271 - protein, 60 aa, Artificial Sequence
  Synthetic
SEEERIRELLERVRRRLEESKKKSKDVADEVKETNDESRERSEKLLREVEERLRELLREL

SEQ ID NO: 20272 - protein, 56 aa, Artificial Sequence
  Synthetic
VEELRKEVEEVVERVRRISERLTEELRRSSERVKRISERLLEDLERVVRDVARRVK

SEQ ID NO: 20273 - protein, 60 aa, Artificial Sequence
  Synthetic
SEEERIRELLERVDRRLKESEKRSTDVARRVREENKELEKAARKILEDARRELEKLLREI

SEQ ID NO: 20274 - protein, 56 aa, Artificial Sequence
  Synthetic
VEELIKRVEDMVREVEKTSRKLIEELKRSSDEVRKMVEELLRRLERVLEEVKKRVK

SEQ ID NO: 20275 - protein, 58 aa, Artificial Sequence
  Synthetic
KDEETVTKLLEDVERKNRESEKDSRKIVEDVKDENRKLEDEARKSLEDSERKLERLER

SEQ ID NO: 20276 - protein, 56 aa, Artificial Sequence
  Synthetic
VRELAKRLRESTERVEEISRRLIKELEDSSDKVRKVVEDLLRENKEAVRRVAEEAT

SEQ ID NO: 20277 - protein, 60 aa, Artificial Sequence
  Synthetic
SELEKVEEDIRRLVERVKKIAEDVERLTRELVKEVRKSTEDSVRDIERLMKELREIARDV

SEQ ID NO: 20278 - protein, 59 aa, Artificial Sequence
  Synthetic
KDAKKRLEDLLDTLRKIVEDVSRRLKELNDRLRKLVEDSKRRNEELLRRLREIVKEIAK

SEQ ID NO: 20279 - protein, 60 aa, Artificial Sequence
  Synthetic
DSDKEVEKRIRELMKEVKDSTKESEDKIRESNERVKESSKRSEDEIRKLMEELDEIAKRV

SEQ ID NO: 20280 - protein, 59 aa, Artificial Sequence
  Synthetic
EDATRRLKKLLDDLKKEVDDSRRRNDELIKETERLIRESAKRNDKLLEDLKKRVDEIRK

SEQ ID NO: 20281 - protein, 60 aa, Artificial Sequence
  Synthetic
DEREEVEKRIRDLAEEVRRIVKRVEDETRRLVEEVKKSSDDSRRTIEKLARELKEITRRV

SEQ ID NO: 20282 - protein, 59 aa, Artificial Sequence
  Synthetic
KEAKDRLEDLLRRLREEVKRVKEKLKKLNDDLRREVEKSKEDNERLLKKLRDEVRKSAT

SEQ ID NO: 20283 - protein, 56 aa, Artificial Sequence
  Synthetic
DEVEKVLREIEKLIKEIREINKRINDRIEELIRRLRERVKKVSRESEELIRDLRRD

SEQ ID NO: 20284 - protein, 56 aa, Artificial Sequence
  Synthetic
ERKAREIIKRVEKVLEEVRRSLETSEKRVRDALREIEERLKENKRRVREVLEEIRK

SEQ ID NO: 20285 - protein, 61 aa, Artificial Sequence
  Synthetic
DEKEKLIKEVEDSTETVKRLVEELSRRSKKITEDVERLVKKLSDESKKILDEVRDLVRKRG

SEQ ID NO: 20286 - protein, 55 aa, Artificial Sequence
  Synthetic
EEADKLRKRSEDMVRRIEEHLKKNLKENKDALDKIRKELRENIETTKKTVDDIRK

SEQ ID NO: 20287 - protein, 61 aa, Artificial Sequence
  Synthetic
DEKDKLIEELDKILEDVRRRVEELSRRSKEITETVKELVKRLSDESERILREVDDVVRKRG

SEQ ID NO: 20288 - protein, 55 aa, Artificial Sequence
  Synthetic
EKAREVRRKVKETVERIEEELRRNIEENREMVERVEREARKNIKDTRKRVEEIRK

SEQ ID NO: 20289 - protein, 60 aa, Artificial Sequence
  Synthetic
RVEEKLEKIKRDIEKLVEDMKESNTRSKRKLEKLVEEMRRNNEELTRRVEELVKKIEDDV

SEQ ID NO: 20290 - protein, 59 aa, Artificial Sequence
  Synthetic
EDLVRRLLEEIRRILEEVRRTDKELLDENERILREVEKLNRDLVKEIEEILKKVEDDVR

SEQ ID NO: 20291 - protein, 58 aa, Artificial Sequence
  Synthetic
SEVEKAIEEIEKVIKEVRDKNRRVLEESKKLIRTVEETNKRNIEEIEKWIKTLDELTD

SEQ ID NO: 20292 - protein, 59 aa, Artificial Sequence
  Synthetic
EDAAKKAKEIIDKLRTLVEEVKRTNDKSLRDTREVVRRVEETLRRVEEKVKKRVDEIRK

SEQ ID NO: 20293 - protein, 58 aa, Artificial Sequence
  Synthetic
SEVEEVIRRIEEVLKELRRKNEEVLRESERANDEVRRVNEKNIRDIKKWLEDVKREVD

SEQ ID NO: 20294 - protein, 59 aa, Artificial Sequence
  Synthetic
EDARRRAEELERRVDKVVREVEKTNKESEEESKKLVDDVRRTLREITERVKDAVEKTLR

SEQ ID NO: 20295 - protein, 60 aa, Artificial Sequence
  Synthetic
SRDEEVARRVERVLEESEKLSKEVAEENEKVLREAREILEDVRKKVEDVARTLRELAKKV

SEQ ID NO: 20296 - protein, 59 aa, Artificial Sequence
  Synthetic
EEAKRRLEDLRRKLEELVKRNEKKLRDLDERLKELVERIERAAEKLLRDLRDLVRKITK

SEQ ID NO: 20297 - protein, 60 aa, Artificial Sequence
  Synthetic
RELEKVEKEVEDVLRDIERSSDEVRRENKRVAREMEESSRKVAEDVERVLRTLEELAKKV

SEQ ID NO: 20298 - protein, 59 aa, Artificial Sequence
  Synthetic
EEAKKRAEELVRRLEELLERNRETLERLDKELKDLVEKNKRTAEKLVKELEELVERIRK

SEQ ID NO: 20299 - protein, 60 aa, Artificial Sequence
  Synthetic
DELERVRREVKRLADESEKVSREVEERVRDTNRKSEEISRRVEKLARELLKKVEEVERRS

SEQ ID NO: 20300 - protein, 59 aa, Artificial Sequence
  Synthetic
EDLKRTLDELRKTIEKLVKDNRETLERLIRESEETIKRNREKLEELKRRLETLLRRVRK

SEQ ID NO: 20301 - protein, 60 aa, Artificial Sequence
  Synthetic
DELEDVRRRVDELVEELERVSRRVAELVKRIIDESRDISRRVARRVEELLRRLREVTKRS

SEQ ID NO: 20302 - protein, 59 aa, Artificial Sequence
  Synthetic
DELRKRLEDLKRKIERLLEDNRRKLEELIRRAEKVVEENERTMRKLKEDAKRLLEEIRK

SEQ ID NO: 20303 - protein, 59 aa, Artificial Sequence
  Synthetic
SVEDLVREVEERVRKVEKDLRELLDRLRRENEDAVRRSRESLRRNEEENKRVVDELRKD

SEQ ID NO: 20304 - protein, 55 aa, Artificial Sequence
  Synthetic
EEVVKKVREVLERVKETVKRVVDRNREVVKRLEDENRKVSEENKRVVEKVKEDAR

SEQ ID NO: 20305 - protein, 59 aa, Artificial Sequence
  Synthetic
SVEELVRRIAEKLRKVLDEIERLVDELRKENEEVVRDIERLVEDNEREVRDVLRKLEKD

SEQ ID NO: 20306 - protein, 55 aa, Artificial Sequence
  Synthetic
EDLVRDAERVLKRVTDEVRRVVKENKDVVRKVREEVERVSEENKRVLEKVTRDTK

SEQ ID NO: 20307 - protein, 60 aa, Artificial Sequence
  Synthetic
DEVETLKREVERLNKEVLDRVRKVIKEIKELDDRVRRENERVIREVERLIEEVRDRVRKN

SEQ ID NO: 20308 - protein, 59 aa, Artificial Sequence
  Synthetic
RRAEKIVKELREHSDEVVREMRELVERSKRHSTKVVEELKKSNKELEEKVRKVVRELEK

SEQ ID NO: 20309 - protein, 60 aa, Artificial Sequence
  Synthetic
SEVEELRERIKELNKRVLDTVRRVLERVKELNEEVDRRNKEVIKEVERLLEEVKREVTRE

SEQ ID NO: 20310 - protein, 59 aa, Artificial Sequence
  Synthetic
RRAEKIVDDIRRHSEDVVRRMRKLVEDSRRHSKRVVEEMERSNRELEERVKRVVEELKR

SEQ ID NO: 20311 - protein, 60 aa, Artificial Sequence
  Synthetic
SEVEELIKEIRRLNEEVRRRNKKVIEEVKKLNEDVKRKNDKVIEDVERLLREVKKRVEDE

SEQ ID NO: 20312 - protein, 59 aa, Artificial Sequence
  Synthetic
RRVEEIVRTIEKHSRDVVREMERSNDESEKHSRKVVREMEKSNKELKKKVEKIVRDLEK

SEQ ID NO: 20313 - protein, 60 aa, Artificial Sequence
  Synthetic
SEVEKLKREVERLNEEVLRRVRKVIEDSKRLNEEVRKRNEDVLKELKDLIREVKRRVEEE

SEQ ID NO: 20314 - protein, 59 aa, Artificial Sequence
  Synthetic
DRMRKIVEDLRRHSEEVVREAEDLVRRSEEDSRRVAREMEKSNEEIEKEARDVVRELER

SEQ ID NO: 20315 - protein, 60 aa, Artificial Sequence
  Synthetic
SEVERVVKEAEDLSRENNKRVKEVVRRAEDTNRRVEDENRKLLKEIKDLLREVKETVKRI

SEQ ID NO: 20316 - protein, 59 aa, Artificial Sequence
  Synthetic
ERVRRLLEEVLRRVAEDVRRSEEELDKVLRDSAESLKRSDKSLRDIVREVEKVLDEIRK

SEQ ID NO: 20317 - protein, 57 aa, Artificial Sequence
  Synthetic
SAEDLLRKLREDVERVMRELRKSNEESRKRVEEVVEEAERILKESRERSEELVRRLN

SEQ ID NO: 20318 - protein, 59 aa, Artificial Sequence
  Synthetic
EEVLRKLAEDVKRVLDKVKEENKRLLEENDRMLEEVRRLLKKLLEESEKVLEEVERKAR

SEQ ID NO: 20319 - protein, 59 aa, Artificial Sequence
  Synthetic
DLREEIRKLREDAKRVIDESRKSVKENEKRNKKLLDESEKSVRENEERNKELIKRVKDR

SEQ ID NO: 20320 - protein, 59 aa, Artificial Sequence
  Synthetic
REVLRKVKEELRRVLEKLRRLNEEASRENERILRELRKKNRDMNEDNRRILEELDEKAR

SEQ ID NO: 20321 - protein, 59 aa, Artificial Sequence
  Synthetic
DMEREVEKLERELRELIKRIRKIVDENRRRNEELLERSRESVRRNEEENRKLLEEVKKS

SEQ ID NO: 20322 - protein, 59 aa, Artificial Sequence
  Synthetic
EKVLREVKEEVRKLLEEIEKTVRDVSRENKRILDELRKKNKRADEENREILKKLREDVR

SEQ ID NO: 20323 - protein, 59 aa, Artificial Sequence
  Synthetic
SMEEEIRRLEEDVRRLVDKSRKSVKENEERNRKLLEESKESVRDNARRNEKLIRDVRRK

SEQ ID NO: 20324 - protein, 59 aa, Artificial Sequence
  Synthetic
REMLEEVLRRLEDALRRLEEENKRVSEDNERILEELRRKNEEADKRNRDILDDLRRRAD

SEQ ID NO: 20325 - protein, 59 aa, Artificial Sequence
  Synthetic
DMEDKVRKLERDVRELIKEVEKIVRDNADENRRVVEESEKSVRELADRARRLIDEIRKG

SEQ ID NO: 20326 - protein, 59 aa, Artificial Sequence
  Synthetic
EDVLREVKERVEEVLDRVRKKVEKVSRENKEIVKEVRKKNEDAVREAEELLKKIREEVR

SEQ ID NO: 20327 - protein, 60 aa, Artificial Sequence
  Synthetic
DEVEEVVRRIEELIKEVEDVDRDIERRVKELDEELRRVDDEIRRRAKKLLDDLEKRVREI

SEQ ID NO: 20328 - protein, 59 aa, Artificial Sequence
  Synthetic
ERVRRILTELRKRVEKVVRDSEKTLRESVERSARLLKESKESLEELERRAREVVERIKK

SEQ ID NO: 20329 - protein, 60 aa, Artificial Sequence
  Synthetic
DELEEAEKKVRDLIRRLREMNERALRESERLIRRLREVDEEIVRRIEDLLKKLREEVERE

SEQ ID NO: 20330 - protein, 59 aa, Artificial Sequence
  Synthetic
REVRKTLKDLEDTVKRVLEESEESARESEKRSRDVLRESERSLRELEKKVRKLLEEVKK

SEQ ID NO: 20331 - protein, 61 aa, Artificial Sequence
  Synthetic
SDVDKVAKEIDDALKDVRRKVDKVRKDNERVNREVEERVRRVTERNRDVIEEVKRRVEEVK

SEQ ID NO: 20332 - protein, 56 aa, Artificial Sequence
  Synthetic
SELVREIERRLEELVKELRKILDELRKRNEDTRRRLEEALKRNREEAERLEREIRK

SEQ ID NO: 20333 - protein, 60 aa, Artificial Sequence
  Synthetic
KDVDEIATELDEVIDRIRKKVKEVVERDEKVNRDVNDEVDKLTERNRRVLDKVLKDVTRR

SEQ ID NO: 20334 - protein, 56 aa, Artificial Sequence
  Synthetic
DRLVDELRKRVEDAKREIREILEKLKRDNDESKKRLERLLKENEDALREILERLRK

SEQ ID NO: 20335 - protein, 61 aa, Artificial Sequence
  Synthetic
DDVEKAVREVEEMLKRVDKEVERVSRENKRVSDEVRKKVKEVERKIKEVLDRIKDEVDRVK

SEQ ID NO: 20336 - protein, 56 aa, Artificial Sequence
  Synthetic
DELVKRLEDKMRRVKEKLKRLLEKNREDSERSERELREILKKITREVEELAKELEK

SEQ ID NO: 20337 - protein, 56 aa, Artificial Sequence
  Synthetic
EEVKKLLEEVRDLLRRVLEEVERSSDEDRKLNERVNEAIEKSIREVEELLRRIDRE

SEQ ID NO: 20338 - protein, 56 aa, Artificial Sequence
  Synthetic
EELVEELKRRVDEVKRRAEEINRENDERNKESKRRLEELNERLEERVRRLEEKLKK

SEQ ID NO: 20339 - protein, 57 aa, Artificial Sequence
  Synthetic
DEVEDLRRRVEKILEDVKRTVETASKRDRELNEEVNRLLRESVERVDRLLDRIRREA

SEQ ID NO: 20340 - protein, 56 aa, Artificial Sequence
  Synthetic
KEIVDRLRKAVEEVSREARKILDENRRRNEESEKRMREINKRLEDKVREVKKELEK

SEQ ID NO: 20341 - protein, 57 aa, Artificial Sequence
  Synthetic
REVDKLREDVRRLLEELLRALRESSKEDEKLNRKVNREVDRVLKEVDDLLEDIKKRV

SEQ ID NO: 20342 - protein, 56 aa, Artificial Sequence
  Synthetic
EEIVKRLEEEVREIVKEIKEINDKNRKKNEDSARKADEKVKELEERVRRVVKELRD

SEQ ID NO: 20343 - protein, 56 aa, Artificial Sequence
  Synthetic
KEVEDLVRRVEKLLRDIDRELKRSSDEDRELNERVNREVDRVLREVDRLLKEIRET

SEQ ID NO: 20344 - protein, 56 aa, Artificial Sequence
  Synthetic
ERIVRTLEKRIRDLVRKAEEIDRENEKRNKESSDRMERLVRELRKRVKRLVEELER

SEQ ID NO: 20345 - protein, 56 aa, Artificial Sequence
  Synthetic
DEMRRLLREVERILEEVERVLEKSVRDDERVNREVNRRLDEVLRRVEDLLRRIEKE

SEQ ID NO: 20346 - protein, 56 aa, Artificial Sequence
  Synthetic
ERLLERVRREVEKVRERADRIDKRLEDTNRRSKDRAEELVRELEKRVEDLKEKAEK

SEQ ID NO: 20347 - protein, 56 aa, Artificial Sequence
  Synthetic
DEVRKLEEEVDRILREVKEMVEDSIRRHKEVNDEIRRRVERVLEEVKTLLDLIREK

SEQ ID NO: 20348 - protein, 56 aa, Artificial Sequence
  Synthetic
KEIVDELRKRVEDVSREAKKLDDDLRENVKRLSEEMKKLVDDLRREVDRLEKERRK

SEQ ID NO: 20349 - protein, 57 aa, Artificial Sequence
  Synthetic
DEVEELRRKVEEILRRIREDVRKSIEDHRDVNRRVLEAVRRSTKRNKDVVDRLRDED

SEQ ID NO: 20350 - protein, 56 aa, Artificial Sequence
  Synthetic
ERIVKRLEDEVRKLVDEMRKLDEELTRNVDEVRREAERLDKENRDENRKLKEELKK

SEQ ID NO: 20351 - protein, 60 aa, Artificial Sequence
  Synthetic
SEMEKVVTDAKELLERLDRELERVIRESDKILDELRRKIEEVIKRSDELLEELDRRIKEN

SEQ ID NO: 20352 - protein, 56 aa, Artificial Sequence
  Synthetic
EELIERVRRLVEELIEKAKKLLEESERKSARLIEDLERLLEESRRKSDKLIKKARK

SEQ ID NO: 20353 - protein, 60 aa, Artificial Sequence
  Synthetic
DEVEEIRKEIEDILRRLRDLLRRVIEDSRRLLDELRERNERVIKESEDLLRDLEDKIRKR

SEQ ID NO: 20354 - protein, 56 aa, Artificial Sequence
  Synthetic
KEIVDRLRDEVRKLEEEAKELLRESNELTRELIDRLEKLNRDSNRKSRELIERLRK

SEQ ID NO: 20355 - protein, 60 aa, Artificial Sequence
  Synthetic
SELEEVEERIKKELDRLEKKMEESIKRDKEINRELNEMLKKSIKDSDDILRELRKEIEDD

SEQ ID NO: 20356 - protein, 59 aa, Artificial Sequence
  Synthetic
KRAEEIVKKLEKEVEDLVRKAKKLVDELRKENEESKKRARELLRRSEEKVKKLVREAEK

SEQ ID NO: 20357 - protein, 56 aa, Artificial Sequence
  Synthetic
DSEELVRTVKKELEDIIRESRKLVEDVARALEKIEKEIEEIVRTTDKELRKLIEEA

SEQ ID NO: 20358 - protein, 55 aa, Artificial Sequence
  Synthetic
EEVVKKVKDLLRELEKHNRTVLEEVKKALDELRRRLEEVHRRSKETLDRIRRDAT

SEQ ID NO: 20359 - protein, 56 aa, Artificial Sequence
  Synthetic
REDELVDTVRKRLKELIEESERLLEEVKKKLEEIKRRVEKILRETEKELRDIIRKN

SEQ ID NO: 20360 - protein, 55 aa, Artificial Sequence
  Synthetic
DKVLEKVRKVLEDLKRENKEVVERVDRVLEDAKRKLEKVHKDSRDALKKLDEDAK

SEQ ID NO: 20361 - protein, 56 aa, Artificial Sequence
  Synthetic
SEKELLDRVKEKLKKIIDDVEEILRRSKKELEKIIRESEKLVEEVKRDLRRLIEEN

SEQ ID NO: 20362 - protein, 55 aa, Artificial Sequence
  Synthetic
EKVVEEVERVLEKLLRDVERVHRRTKEVLDELRKENKKVVEDVRDVLEKARERAR

SEQ ID NO: 20363 - protein, 60 aa, Artificial Sequence
  Synthetic
EEVEDVARKIEKLLEDVRRIDKEISDRNRELLKEVRKIDEKILREIEKLLEELRDTATKD

SEQ ID NO: 20364 - protein, 55 aa, Artificial Sequence
  Synthetic
EEAERIKRELDRIRKESEETVKENEERLRRIKEESRRSVERARTELKRIEDEVRK

SEQ ID NO: 20365 - protein, 60 aa, Artificial Sequence
  Synthetic
KVEDELRKLREEVRRSKEEVEKKVKELDEEVKRSKRESEKKLRDLREEVKRLEDDAERSN

SEQ ID NO: 20366 - protein, 59 aa, Artificial Sequence
  Synthetic
EKFLEEVRERVRKLLDENHKILKEAERRVEELLRRNHKILKEALDRVRKLLKELRDRTR

SEQ ID NO: 20367 - protein, 60 aa, Artificial Sequence
  Synthetic
SIEEILRELREHVKENMERSEEIVRDLTRKVDESTRDSERILEKLKKDVDKLEEDAKRAN

SEQ ID NO: 20368 - protein, 62 aa, Artificial Sequence
  Synthetic
EEAEELLREVRERVERVSRRNEELLKRVERDVERVLRENHELLKRVAEEVERVLKEVRERTK

SEQ ID NO: 20369 - protein, 60 aa, Artificial Sequence
  Synthetic
SIEEILEKLRREVEESEKDSRRSAEELRKHVRENEKRSEDIVRKLTEDVERLERKARSRN

SEQ ID NO: 20370 - protein, 62 aa, Artificial Sequence
  Synthetic
EEAKELVREVAERVEDVLRKNHEINKTNAEAVKKWSEDNRKLLEDVRREVERVLKELEKEMT

SEQ ID NO: 20371 - protein, 59 aa, Artificial Sequence
  Synthetic
DEVRKLVEELRKINEDDKRRSDKNFDDNRKLAEDVKRVLERNVEENRKMAKRLEEVLRN

SEQ ID NO: 20372 - protein, 55 aa, Artificial Sequence
  Synthetic
EKLLKEAEERIRRNAEENRKLLERSKKALEEVERRARKLLEESRRALEELKKRAD

SEQ ID NO: 20373 - protein, 59 aa, Artificial Sequence
  Synthetic
DEVRELVKELRELNKRDKKRSKELRDKLEEANREDEEKTRKNKEDNERMAREVERVLRD

SEQ ID NO: 20374 - protein, 55 aa, Artificial Sequence
  Synthetic
ERLLKEAEELIRRNEEENRRILREVEERIKKNEDDNRRVLKRSREELERVEREAR

SEQ ID NO: 20375 - protein, 59 aa, Artificial Sequence
  Synthetic
DEVDKLRKELEDANARDREKSKENKDENDKALKELEEVLEKLKRELEEIVRRVKEVLDK

SEQ ID NO: 20376 - protein, 55 aa, Artificial Sequence
  Synthetic
EEILKKIEKEIRTNREENERLLKESEDELKRLEDEMREILERIKRLIEEVEERAR

SEQ ID NO: 20377 - protein, 59 aa, Artificial Sequence
  Synthetic
DEVRELVKELERINKEDRDKSRENFKRNADIAKEVEDNLERNEEENRKVEEEVRKVLRD

SEQ ID NO: 20378 - protein, 55 aa, Artificial Sequence
  Synthetic
EDLLRDAKRKIDENKEENERLLKESRKLLERVRKRAEELLRKSRKALEDLKEEAK

SEQ ID NO: 20379 - protein, 59 aa, Artificial Sequence
  Synthetic
SEVDKLEKEVRDANERDRRNSERNRKENEEMLRRVERVLRELKKKLEEAIRRARKVLDD

SEQ ID NO: 20380 - protein, 55 aa, Artificial Sequence
  Synthetic
ERILERIEELIRDNAKRNEDLLRRSKEMLDELRKKAKEILDRIRKLIKEVEDKAR

SEQ ID NO: 20381 - protein, 60 aa, Artificial Sequence
  Synthetic
DEVERVVEKLKTLIEEWKRLTEEIEKKNEELIRRIEKVLEDLFRENEKLARDIKREIDEL

SEQ ID NO: 20382 - protein, 55 aa, Artificial Sequence
  Synthetic
EELLRRIEEDIERLERTDREVLKRSEKKIRELRERAKELLKRSEEIIKKLEDEAR

SEQ ID NO: 20383 - protein, 60 aa, Artificial Sequence
  Synthetic
SKDDELKRKIDELIDRWRRLTEEIKKKNDELVKKWEKLTKEVTDHSRDLNRKIREELERL

SEQ ID NO: 20384 - protein, 55 aa, Artificial Sequence
  Synthetic
ERLLEEIEERIEKLERDDKKVLDDSRKKIDDLRKRDEEVIRRNRESIDRLRREAD

SEQ ID NO: 20385 - protein, 60 aa, Artificial Sequence
  Synthetic
DEVETVDDRVKKVIRKLEELLRELAKLNKDIVDDIRRRLKEVEERNRKLAEDIERLLEEG

SEQ ID NO: 20386 - protein, 55 aa, Artificial Sequence
  Synthetic
EDVIKKVRDEAERIRREVRRLDEESRKTVKRLLDEVRELNRRSEEELRELRRRIE

SEQ ID NO: 20387 - protein, 57 aa, Artificial Sequence
  Synthetic
SELEEVRERLRKLIEDLKRLNEESLKENREIIKALRELNERSLRENKELIKRLEDSN

SEQ ID NO: 20388 - protein, 58 aa, Artificial Sequence
  Synthetic
DEARTIIEEIKRRVDELRKHIEESIKEVKKLNDEVEKHIRESIKESEEDLKRLKDRID

SEQ ID NO: 20389 - protein, 60 aa, Artificial Sequence
  Synthetic
KDDEDVDEKIRRAIKKNEELSREIEDKIRRILKKHEDLTRDLAREIREVVRKLRELSKRG

SEQ ID NO: 20390 - protein, 55 aa, Artificial Sequence
  Synthetic
EELLRKVEELLRRLEEENRKILKEVDERLKDLEKKDRDLLEEAKKLLEDVERELR

SEQ ID NO: 20391 - protein, 60 aa, Artificial Sequence
  Synthetic
SELEKLIKELRDLVRESEERLRELVRKVKELIKRSEDEVERLLDRSRELAKELEEEIRRK

SEQ ID NO: 20392 - protein, 59 aa, Artificial Sequence
  Synthetic
REVLDKLKKDAKRVNDDSERIIKRADEEVKRVNEESKRMLEENEKMNRDLVRRIRERIK

SEQ ID NO: 20393 - protein, 56 aa, Artificial Sequence
  Synthetic
DLEEMLTEVERLARELEEESKKIRKEVERLARELEEESKEINKRIKDKADDLKEKL

SEQ ID NO: 20394 - protein, 59 aa, Artificial Sequence
  Synthetic
REIIKRLVDEVKKVIDELMKKNRKLLEDVERILTELSERNRDLARKVDKLIRDLEKRAR

SEQ ID NO: 20395 - protein, 60 aa, Artificial Sequence
  Synthetic
SKLEEVKERVKKLSKRNLDVAKRVLDEIDKLIKEDLKKTEDALRRIKELLDRLREMKRRG

SEQ ID NO: 20396 - protein, 59 aa, Artificial Sequence
  Synthetic
ERIRRIVKEVRELVRRNDEEVDKIVEEVKRLLERSSRENEKVVREVEELLKRLEEEARK

SEQ ID NO: 20397 - protein, 60 aa, Artificial Sequence
  Synthetic
DDVERLLKRVKELIDDDLRKTEKALREIEKLSRDNKKRTEDVLREIEERLRRLEEATRRG

SEQ ID NO: 20398 - protein, 59 aa, Artificial Sequence
  Synthetic
ERVRKIIRDVERLLEESTRRNEEAVKRVERLLEENKKRNEDVVREVEKELRRLREEARK

SEQ ID NO: 20399 - protein, 60 aa, Artificial Sequence
  Synthetic
SDIEKVLEDIRRLSKKNVDDSKRVLDEIRELSKRNLELVKEVLERIRRLLKKLEEARRRG

SEQ ID NO: 20400 - protein, 59 aa, Artificial Sequence
  Synthetic
ERIRKIVEDVKELLDRNREENERIVREVEKLLDENRKEVEKILREVERLLEELEKRERD

SEQ ID NO: 20401 - protein, 60 aa, Artificial Sequence
  Synthetic
KEVEDLLKRIRDLLKRVEETSREVLEEIKRLIDRDRKHSKEVLDEIKELLKRLIEAAKRG

SEQ ID NO: 20402 - protein, 59 aa, Artificial Sequence
  Synthetic
ERVRTIIREVEKLLKELEDKNDEIVRRVEELLRKSHEDNRRIAEEVREMLKRLEDEMRR

SEQ ID NO: 20403 - protein, 61 aa, Artificial Sequence
  Synthetic
SSLEKVEKDIRKLNDDSKKEAKRVTEENRKSNEDVERELRKIVEEVRRLIKDVEDKIRKDG

SEQ ID NO: 20404 - protein, 59 aa, Artificial Sequence
  Synthetic
ERVKRIVDELRKSLRKLEEDVKELIKENKESNDRLRERVERILKELRELLRELEEKVKT

SEQ ID NO: 20405 - protein, 61 aa, Artificial Sequence
  Synthetic
SEVERLVEEVRKSNKKWEEESRELTERNKKLNRETTKRAEDLLERVRELVRTVTEIIKREG

SEQ ID NO: 20406 - protein, 59 aa, Artificial Sequence
  Synthetic
ERLKRIVEEIRDSVRRLKEKSEELVRRNEESNDRLRRRVEEIAKEARDLVRRLEEEVRR

SEQ ID NO: 20407 - protein, 61 aa, Artificial Sequence
  Synthetic
SEAERVLEEVRRLNDKSKKTAEKLTEENKRLNKRTTDFLKEVLERIEELVRRVEDRIRKEG

SEQ ID NO: 20408 - protein, 59 aa, Artificial Sequence
  Synthetic
KRVKDIVREIRDSVRKLEEEVRKLIRENEKSNKDLRRRVRKIEEDIKRIIRELEERVRK

SEQ ID NO: 20409 - protein, 61 aa, Artificial Sequence
  Synthetic
SELEKILKDIEDLVRKWLEESKDLLRKLKKLNEDTTERLRRLLDELRKLIKDLLDKIRKDG

SEQ ID NO: 20410 - protein, 59 aa, Artificial Sequence
  Synthetic
KRVKDIVKKIEELVKKAKEESKKIVEEVRRSVKRLEEEVRKIEKDIKDLIDELRKKVTT

SEQ ID NO: 20411 - protein, 59 aa, Artificial Sequence
  Synthetic
SEVEDLRRELEEINKEWNKRTKDLVKEVEEVNRDINKKIRDLLREARRLVDEIRRLIEK

SEQ ID NO: 20412 - protein, 56 aa, Artificial Sequence
  Synthetic
EEVIKELRKLLEESERRAREMNKRLDRLLEESKKDVDRVREEIKRLVDEIEDRARK

SEQ ID NO: 20413 - protein, 59 aa, Artificial Sequence
  Synthetic
DEIEEVLKRLEEIVKTWDERTKRLTERVRTVNREVNERHKKLTRDLRELAREVLDLVRQ

SEQ ID NO: 20414 - protein, 56 aa, Artificial Sequence
  Synthetic
REMLRELEERIRTVEDKVRRVNEELRELLKTSNRRSEEIEKELEKILREIRERARK

SEQ ID NO: 20415 - protein, 59 aa, Artificial Sequence
  Synthetic
DEVRKVLEDLRKIVREWEERTERLLRDLKRINEEINRRVEKLTEELRRLVKEIKKLTDD

SEQ ID NO: 20416 - protein, 56 aa, Artificial Sequence
  Synthetic
EDVLREADKIIEDVEREARRVNKELKDLLDESAERIERIIREIERLVEKIKRDADR

SEQ ID NO: 20417 - protein, 59 aa, Artificial Sequence
  Synthetic
SEIEKVLDELREINRRINETAKEILRRLKEINERTKKEIDRLLDELRKLLRRVEELRKE

SEQ ID NO: 20418 - protein, 56 aa, Artificial Sequence
  Synthetic
EEALKDLERLLRESEKRIREIIKRIRESVEKLERDVRRVIDEIRRRLEEIERRLRK

SEQ ID NO: 20419 - protein, 55 aa, Artificial Sequence
  Synthetic
KEVEEALEELRRILREWEEVTKRLEERVEEINRRSLEELRRLKEEVEEIAKRIRD

SEQ ID NO: 20420 - protein, 56 aa, Artificial Sequence
  Synthetic
KEVLEELDKLVKDIKRKVDEVNEKWKESSKRLEDEHRKVIKELEELVKRVEEELRR

SEQ ID NO: 20421 - protein, 55 aa, Artificial Sequence
  Synthetic
KEVEDALKKAEDILRRWEEVTKKLKDEARKINEDSRRKLKRLKEESREIVERIKK

SEQ ID NO: 20422 - protein, 56 aa, Artificial Sequence
  Synthetic
EEVLRRLEKLVEDIKRKVAKVNDEWRKSSEDLEREHRKVHRESEKLIRDVEDRLRK

SEQ ID NO: 20423 - protein, 55 aa, Artificial Sequence
  Synthetic
SEVEEVRREVKRVVDDWRRVTKKLLDDIRRISEESKKIIRDLKEAAKTMIREVER

SEQ ID NO: 20424 - protein, 56 aa, Artificial Sequence
  Synthetic
EEVLKELEKLLEDLRREVEEVNERLKRLLDENEKRIREVLRELKKLLRDLDEKLRR

SEQ ID NO: 20425 - protein, 60 aa, Artificial Sequence
  Synthetic
DELERVREEVKKLSDTSREKLERALKKARDLLEENERRLRELKKEVEELIRRIEEKLKDR

SEQ ID NO: 20426 - protein, 59 aa, Artificial Sequence
  Synthetic
EELRKVLTDIERLLRENKKELDEVLKEVEKLSREADDKNRKVLKEIKELLDELKKRAKD

SEQ ID NO: 20427 - protein, 60 aa, Artificial Sequence
  Synthetic
SEVERMLEEVERISEESKRKLEEVLRRVEEIIKAIERTLEKVLKDDEEIIRRIEDTLRRR

SEQ ID NO: 20428 - protein, 56 aa, Artificial Sequence
  Synthetic
REVVKTIDDLLRENERRVDEALEEIEKRARDLREKVKELEERLDRTNRKLKKKVED

SEQ ID NO: 20429 - protein, 57 aa, Artificial Sequence
  Synthetic
KEVEDIIEESRKLDKELEDEIRRIIEESRRLNEELEEIARRIDEEIKELLERLKRRD

SEQ ID NO: 20430 - protein, 59 aa, Artificial Sequence
  Synthetic
KEDVERLVRSNREVARDVREKLKRLLEHNKEVVDRVREELKRLLDEARRVIEEVRKKAD

SEQ ID NO: 20431 - protein, 60 aa, Artificial Sequence
  Synthetic
DELERIDEKIKRDVEEHKRETKRILDESERLNREVKKRLEEIRERIRRLAEEIRKEIERD

SEQ ID NO: 20432 - protein, 59 aa, Artificial Sequence
  Synthetic
ERKLEKVMEDVKRLIDEARKENEDVARRMERSNKELKRKLDEIRREVEELIKELRERTK

SEQ ID NO: 20433 - protein, 60 aa, Artificial Sequence
  Synthetic
DDLERAREEVADLIRKHEEKTRRILEESRRLNERHRELSKRILDEIRKLAERIEELIKRE

SEQ ID NO: 20434 - protein, 59 aa, Artificial Sequence
  Synthetic
KEELDRIEEELKRLIDTLREKNREVEKRARDSNRDLKRTNDEIAKEVRELIKKLREDLK

SEQ ID NO: 20435 - protein, 60 aa, Artificial Sequence
  Synthetic
RELETIADRIRKLSRENSEVLKEIARRIERLVEEHRKESERILKEIKELADDITRLIRED

SEQ ID NO: 20436 - protein, 59 aa, Artificial Sequence
  Synthetic
KEELDKVEEEVRRLIRTNREILRTIEKRVRDLIEELKRRNDEIARRVEELIKRLRRETD

SEQ ID NO: 20437 - protein, 60 aa, Artificial Sequence
  Synthetic
SELEKVADELRKLIKDDNDLLDEILDRIRKLSKENEKRLREILKEIRKLMDEISKLIKKD

SEQ ID NO: 20438 - protein, 59 aa, Artificial Sequence
  Synthetic
KEELDKIREELERLIKRNKEKLDEIRREVDELIKKNEETLKRIEEEVRKLIEDLKEELR

SEQ ID NO: 20439 - protein, 60 aa, Artificial Sequence
  Synthetic
SDLEKIEKEIEDLVKRDNEVDKKVMREIRELSKENKERLRKILEDLRREAKKIKDDIERE

SEQ ID NO: 20440 - protein, 59 aa, Artificial Sequence
  Synthetic
KEKLKRVEKKVRELIKRNRDHNERTREDVEKLIRDNEDTLRRIEEEIERLIEKLKRDTK

SEQ ID NO: 20441 - protein, 57 aa, Artificial Sequence
  Synthetic
KEVEDAVKELEDLLRKNEDKTRKIVEDMRRSNKDLEDHSRKSEEEVRKLLDDLRRAG

SEQ ID NO: 20442 - protein, 56 aa, Artificial Sequence
  Synthetic
IKTLLDRVRKLAEEDNERLDRLRRESEELNERVRRVDKKLLEEIRRKAKKVEDDTR

SEQ ID NO: 20443 - protein, 57 aa, Artificial Sequence
  Synthetic
DEVREVDRRLKELLRRLKETIDEIRRRMEESNRRLEDHSRKSEEEARKLLEELERKG

SEQ ID NO: 20444 - protein, 56 aa, Artificial Sequence
  Synthetic
LEELLRRLEELAERAERKLEKALRDSEDLNRKVTEVDRRLLKEIRDLVEKVERERR

SEQ ID NO: 20445 - protein, 57 aa, Artificial Sequence
  Synthetic
SEDEKVRKEAEDLLRELEKHSRDTERRARKSNRDNNEHSKESVKDLRRLLERLRKAG

SEQ ID NO: 20446 - protein, 56 aa, Artificial Sequence
  Synthetic
IRKLLEEVRKLVDDLRKRDEEIMKTSERLNEEDNRKDRRLVEDVKRLADEVEKKTR

SEQ ID NO: 20447 - protein, 57 aa, Artificial Sequence
  Synthetic
SKVDDVKRRIRKLLEDSKKRSRESIERVERSNRRLEKHSRDSARRAKELLDKLREEG

SEQ ID NO: 20448 - protein, 56 aa, Artificial Sequence
  Synthetic
IDELLERLKELAKRIKELDDRLLRELEEINKTTEKLDRDLLKEIKERIDELRKREK

SEQ ID NO: 20449 - protein, 57 aa, Artificial Sequence
  Synthetic
DKVERVKKEVRDLLRRLEKHSEDSVREIDTSNKRLEEHSRRSKEELKRLLRKLKEAG

SEQ ID NO: 20450 - protein, 56 aa, Artificial Sequence
  Synthetic
IDRVLEEVRKIIRRIEEEDRRLLKEIRDINETTERLDRKLLDELRKVVKDIEDRER

SEQ ID NO: 20451 - protein, 60 aa, Artificial Sequence
  Synthetic
SELEEVKKKVEKLIRDVEKVSEDTRREVERLIREVEEATKEHLDRVRRLIEELREVRKAG

SEQ ID NO: 20452 - protein, 62 aa, Artificial Sequence
  Synthetic
DRLRERLERLAKEIEDLLRRLREISRTIEERARRLLEELKKRSEDLRKTAEELLKEIDEELK

SEQ ID NO: 20453 - protein, 57 aa, Artificial Sequence
  Synthetic
DEVETIKKKAEDLLRDSKRKTDELTKRMEELLERSKEDSERLIRRLRELLERLRRRG

SEQ ID NO: 20454 - protein, 56 aa, Artificial Sequence
  Synthetic
EEDVDREVKRLVDESKKIIERVEEDVKRLIRESEKKSRDVERRVEELERKAREDER

SEQ ID NO: 20455 - protein, 56 aa, Artificial Sequence
  Synthetic
SEVEKIKREMEKLLEEHKKLVDDIRREAERLHEEHRRLSDKIREDLKRLLEELRRS

SEQ ID NO: 20456 - protein, 59 aa, Artificial Sequence
  Synthetic
RKELDRLRREVEKVVRELKERNKELLKRLEEAVEELKRRNRKLLEDARRVVEEIKERAR

SEQ ID NO: 20457 - protein, 56 aa, Artificial Sequence
  Synthetic
STVERIDEELKRLHTEHKKLSDDIKREAERLHEEHRRLSEEIRERLERLLEELRRR

SEQ ID NO: 20458 - protein, 59 aa, Artificial Sequence
  Synthetic
EEDLDKILRDLERTAKELKDRNRRLLEEVERVVRELKRRNKELLKTVERVAREIERRAE

SEQ ID NO: 20459 - protein, 56 aa, Artificial Sequence
  Synthetic
REVEEIDKELRRLHEEHRRLVEDIRRKLKKLHDEHRRLSEEIKRRLEELIRKLRED

SEQ ID NO: 20460 - protein, 59 aa, Artificial Sequence
  Synthetic
REELTKLLEEVKRVVDRLKEENKRLLKEVKEVAERLKRENERLLEELRRVAEEVRERTR

SEQ ID NO: 20461 - protein, 56 aa, Artificial Sequence
  Synthetic
KEVEEIREEAKRLHEEHRRLSKRIDDELKRLHDEHKRLSDEIRKELERLIEELKKG

SEQ ID NO: 20462 - protein, 59 aa, Artificial Sequence
  Synthetic
RDKARKLLEEVRRMVKRLKEENKRLLEEVRKVVEDLKRRNKELLEKLKREAERVKEEAK

SEQ ID NO: 20463 - protein, 56 aa, Artificial Sequence
  Synthetic
SEVDEIRKRLEDLHREHRELSREIEERLKKLHDEHRRLVEEIIRRARELLEDLRRE

SEQ ID NO: 20464 - protein, 59 aa, Artificial Sequence
  Synthetic
RDKVERLLREVKKVVDKLKKDNEKLLRDLKRVVDELKEKNKRLLEEVKRVVDDIRRRAK

SEQ ID NO: 20465 - protein, 60 aa, Artificial Sequence
  Synthetic
DEVREVERKIDKLAKDLKDELRRLLKEYEELVERLEELLERILRESEKLAEELKEELKRR

SEQ ID NO: 20466 - protein, 55 aa, Artificial Sequence
  Synthetic
DKVRKRIEELVKELKDILEEIKRRVEELDERSKRILKEIADRNRKLVDELRKTLE

SEQ ID NO: 20467 - protein, 60 aa, Artificial Sequence
  Synthetic
SEVEKALEDVRRLVEELKKELKEILERYKRLVDKLKKENREDHERSKELAERLKDLLRKS

SEQ ID NO: 20468 - protein, 55 aa, Artificial Sequence
  Synthetic
EKVRDTLRKLLEELDDLVRRIKTTLRKLVEESRRSLRKNEEDNRKLVEELREEAR

SEQ ID NO: 20469 - protein, 60 aa, Artificial Sequence
  Synthetic
DEVREVLREAREVVKRLKDRLRRILEESRRVVDELRDKNRKDHETYRKVVEELKKRLEER

SEQ ID NO: 20470 - protein, 55 aa, Artificial Sequence
  Synthetic
EEVRKDIERLFKELEDILKEIKEDNRRLVEDIKRSLEKNKRDLEKLVKESEDEER

SEQ ID NO: 20471 - protein, 60 aa, Artificial Sequence
  Synthetic
DEVRKVLEDARRLVEKLERDLEKVLEDYKRLVDELKERNERSHRESRRLAEELKKELERE

SEQ ID NO: 20472 - protein, 55 aa, Artificial Sequence
  Synthetic
DEVKERIDRLVKRLEDLARRIKEELDKLVKESRESLERNKTEVKKLIRELEETVR

SEQ ID NO: 20473 - protein, 60 aa, Artificial Sequence
  Synthetic
SEVEDVLTKIEDVVRKLEEENKRSHDESRKLADELKKENKEDHDRYRKEVERLKKELEER

SEQ ID NO: 20474 - protein, 55 aa, Artificial Sequence
  Synthetic
DKVRKRVEELVKEIEKSARDNEEAVKRLAEELRDSARRNKEELEKLVKESDDELK

SEQ ID NO: 20475 - protein, 56 aa, Artificial Sequence
  Synthetic
RETEEIEKEIRRLVKELRELNDEVEDRVRKLIKELKELNDRSERTLRELADELRRS

SEQ ID NO: 20476 - protein, 59 aa, Artificial Sequence
  Synthetic
DDVVRKVLERAERLVREDKKHTKEVLERIKELVDRDKKHTRDVNEEVKRLVEEIKKKTK

SEQ ID NO: 20477 - protein, 56 aa, Artificial Sequence
  Synthetic
SEIEEIEKRIEDLARELKELNKEVEERVKKLIEDLRRLNEESRESTDRLMDELRKA

SEQ ID NO: 20478 - protein, 59 aa, Artificial Sequence
  Synthetic
DEVVRRVLEEIERLVRRDKEHTERVLRTIEKLVREDEEHTKRVNEEIRKLAKEIEERAR

SEQ ID NO: 20479 - protein, 56 aa, Artificial Sequence
  Synthetic
REIEELRKEIETLIRENEELNRRSKETSEELIRRLKKLNRDVEEEVRRLVKDLRDR

SEQ ID NO: 20480 - protein, 59 aa, Artificial Sequence
  Synthetic
DEVVRRVAEEARRLSKRNKDAIREVNETSRRLATRDAKHTRDVLREIKRLADEIRERTR

SEQ ID NO: 20481 - protein, 56 aa, Artificial Sequence
  Synthetic
SEIEKAEEDVKRLIKENEELNRRSEETSRKLVEENERLNKEVEDRVRKLIKELEDN

SEQ ID NO: 20482 - protein, 59 aa, Artificial Sequence
  Synthetic
DDVVRRILKRIEDLSRKNKRDIEEVNKESERLSRENKKKIKDVLEEIRRLVERIEREVR

SEQ ID NO: 20483 - protein, 60 aa, Artificial Sequence
  Synthetic
SEIEKVLEDLRRLADRHRKRVEEILREAEDSNRKTKKKHREVEKEVKELADKLKDEIRRD

SEQ ID NO: 20484 - protein, 58 aa, Artificial Sequence
  Synthetic
RRLDEVEKDLRRLIRELKRLNEEVEKRVRDLIKENEELNKRIHDDLRRLIKELEDETR

SEQ ID NO: 20485 - protein, 60 aa, Artificial Sequence
  Synthetic
SDIEKVLDDLRKLAEEIERAHEEVAREVRELSKRNKEVIKDILRRAKELAERIKELIDRS

SEQ ID NO: 20486 - protein, 58 aa, Artificial Sequence
  Synthetic
DDLRKVEETLRELIRKIRKKNEEIRRDLRRLIEENKELLERVRREVERLIEDIKRKLK

SEQ ID NO: 20487 - protein, 60 aa, Artificial Sequence
  Synthetic
SEIEKMLEELRRLSERNKRTTEEIEKRLRDSNRDTKRKHEEALRTIKELIDRIKRAIREE

SEQ ID NO: 20488 - protein, 58 aa, Artificial Sequence
  Synthetic
DKLRKAADDVRRLIEENRRLDERLHEEVKKLIEENRKLNEDINERVRRLIEELRRETK

SEQ ID NO: 20489 - protein, 60 aa, Artificial Sequence
  Synthetic
EEIERALREMRELSRTHKELVEKILRDIAELAKTHERINEDILRKIKKLIDEIADEIRKE

SEQ ID NO: 20490 - protein, 58 aa, Artificial Sequence
  Synthetic
RELDEIAKDVKRLIDENRELLKRVEDEVRRLIRKLEELNRRTEEEVKKLIKKLEDDLK

SEQ ID NO: 20491 - protein, 57 aa, Artificial Sequence
  Synthetic
RELEELEKELRELLRELRRLSEESRKELKKLLDELEELSRRSAKKLKDLLDDLRRRG

SEQ ID NO: 20492 - protein, 56 aa, Artificial Sequence
  Synthetic
IDEVRERLRELIERDKKLNKKLTDDLRRLAERDKRENEKLSKELEDLARKLREDAR

SEQ ID NO: 20493 - protein, 57 aa, Artificial Sequence
  Synthetic
SEIEELEKRIDELLKELRDLSRRIAEEVKRLLEELKKLSKDSEDKLRELLERLKRKG

SEQ ID NO: 20494 - protein, 56 aa, Artificial Sequence
  Synthetic
VEEVLRRLEKLVREDKERLKKVLKDARDLIKKDKDLNEKLSRELEKLVRELEERAR

SEQ ID NO: 20495 - protein, 57 aa, Artificial Sequence
  Synthetic
SEIEDLERRIRKLLEENRKLVDDVAKKLRELLRELRKLSEESRKRLEDLLRKLRKDG

SEQ ID NO: 20496 - protein, 56 aa, Artificial Sequence
  Synthetic
VEEVLRRLEKLSRENKDLIRRIDERIEKLIRDDKRRNREISERARELARKLEDEAR

SEQ ID NO: 20497 - protein, 57 aa, Artificial Sequence
  Synthetic
KESEELEKEIRRLLRELREISRKIEEDARRLIEELRRLTEESERELEELLEKLKRDG

SEQ ID NO: 20498 - protein, 56 aa, Artificial Sequence
  Synthetic
VREVLERLKKLVEEDKRRLKELLDRIRELMERDKRKNKEISERVRKLIKELEDKAR

SEQ ID NO: 20499 - protein, 56 aa, Artificial Sequence
  Synthetic
DEEDRLREELRRLLEELRELSERSRDEVKKLLEDLERLTRESEEKVRRLLEKLKRD

SEQ ID NO: 20500 - protein, 56 aa, Artificial Sequence
  Synthetic
VKRVLEELRRLVEEDKKLNEEITEDARRLIEEDRRLNKKISDEAEKLARELRERAR

SEQ ID NO: 20501 - protein, 57 aa, Artificial Sequence
  Synthetic
DELRDVKRELDRLLRENEEIVERIAETVRRLLEELKKLTKELAEELRKLLEELRKRG

SEQ ID NO: 20502 - protein, 56 aa, Artificial Sequence
  Synthetic
VETVLRRVRELSRDNKRRMRRVLEEAKRLAKEDKERIDKIRKEIEELIKRLKDKAT

SEQ ID NO: 20503 - protein, 56 aa, Artificial Sequence
  Synthetic
DEEEDLERRIKKLLDENRELLKRIAEELRRLLEELRRLTEESADRLRRLLKELKDR

SEQ ID NO: 20504 - protein, 56 aa, Artificial Sequence
  Synthetic
IETLLRELEKLSRDNKELLKKIEKEIRDLIKEDKERNRELSERLRKLVEELKKKAT

SEQ ID NO: 20505 - protein, 57 aa, Artificial Sequence
  Synthetic
REIEEAAKDLDRLLEENKKLVKEVEEELRRLLKENRDLVKESEDRIRKLLEELRRRG

SEQ ID NO: 20506 - protein, 56 aa, Artificial Sequence
  Synthetic
VEEVLRRVRKLSRENKEKIRKILEDVKKLSEDNKRRNEELSRRVKTLVDEIKKRAT

SEQ ID NO: 20507 - protein, 57 aa, Artificial Sequence
  Synthetic
SRIEELEKRIRELLKENRDLVKESEDRVEELLRRNEELVRRSKEKVERLLEELRRKG

SEQ ID NO: 20508 - protein, 56 aa, Artificial Sequence
  Synthetic
VDEVLRRLKKLSDDNKELNERLTRTLEELSRRNADINKKLSDEAEKLIRDLEKRAT

SEQ ID NO: 20509 - protein, 57 aa, Artificial Sequence
  Synthetic
KEIEDAERELRRLLEELKRLLDDVAREVKRLLDENKRLVEKSEEDVKRLLDELREEG

SEQ ID NO: 20510 - protein, 56 aa, Artificial Sequence
  Synthetic
VEEVLRRVRETVERVKKKIKDVLKEIEDLSRENKKLNRDLSERLKKLADDLREKAR

SEQ ID NO: 20511 - protein, 56 aa, Artificial Sequence
  Synthetic
DELEELSREIKKLLEENRRLVRESEEDLRRLNEENRKLVEDSERRVRELLKDLRDR

SEQ ID NO: 20512 - protein, 56 aa, Artificial Sequence
  Synthetic
IEEVRERLRKLSKENKDLNRELTKRSRELNARTKERNEEISRRAEELARKIREDAR

SEQ ID NO: 20513 - protein, 56 aa, Artificial Sequence
  Synthetic
DEKETLARKLDELLRELEKLVRDSAREVEKLNEENRRRLEESRDRLRKLLEKLKRD

SEQ ID NO: 20514 - protein, 56 aa, Artificial Sequence
  Synthetic
IERVDRELKRLAEEIKELNKRITDESRKLNEDTKRVNDKLSRDLEELARDLERRAT

SEQ ID NO: 20515 - protein, 57 aa, Artificial Sequence
  Synthetic
SEIERIERENDRLNEENKKITEDIERELKRLLEENRELSRTIEEELERLLRELRKRN

SEQ ID NO: 20516 - protein, 59 aa, Artificial Sequence
  Synthetic
EKTLRELLKRSEELSKENKDRLKKLLDDLREVSKKNKEDLKRLLREVREVARKVKERAN

SEQ ID NO: 20517 - protein, 57 aa, Artificial Sequence
  Synthetic
DDIERILREMERLLEENKEISDEIRKELKRLLDENRKLSEDVVKALEDLLRDLERRK

SEQ ID NO: 20518 - protein, 59 aa, Artificial Sequence
  Synthetic
KDTLRELARKIRKLSEENKERLKELLRELKKLSDENKERIKKLLKDAEKIIEDVRRRAK

SEQ ID NO: 20519 - protein, 57 aa, Artificial Sequence
  Synthetic
SEIERIDEDNKRLNDENRKLSDRVRRENERLNKENRELSKRVEETLKRLLDELRRRG

SEQ ID NO: 20520 - protein, 59 aa, Artificial Sequence
  Synthetic
KRTLTELLKESRELSKRNKDKIRELLRRSEKLSRENKKRIEDLLRELRRVVEKIKREAD

SEQ ID NO: 20521 - protein, 57 aa, Artificial Sequence
  Synthetic
KEIEDLRRDLDRLLRENRELTREVKEELEKLNRELEELVRRIKRTLDELLKDLERRN

SEQ ID NO: 20522 - protein, 59 aa, Artificial Sequence
  Synthetic
REEIERLREELRKLSEDNKDRIRRILERLRKTVEEIKKRLEDILRRLTEIAKEIEERAR

SEQ ID NO: 20523 - protein, 59 aa, Artificial Sequence
  Synthetic
SELEKLLEDLRRLSERSERELRRLRKELEEIIREIKKKMEENLERNRKVIDEIDKVIKD

SEQ ID NO: 20524 - protein, 58 aa, Artificial Sequence
  Synthetic
EEAKRLKEDAERLLRENERRIDELRKEADELIKELKKRIEDLVKESRRLLEELDRRAK

SEQ ID NO: 20525 - protein, 59 aa, Artificial Sequence
  Synthetic
EELERLEERLDRLIEEAERRLKDNLKKNEDMARKWEEDTKRNEKRNRDLIRRIRKVIKD

SEQ ID NO: 20526 - protein, 58 aa, Artificial Sequence
  Synthetic
RKVKELKRRARELLERLARLIDELRRRSEDLIRRLAEKSERLERESRKLLRDIAEKTT

SEQ ID NO: 20527 - protein, 60 aa, Artificial Sequence
  Synthetic
RELEELKKEAEKVSKESKDLIEKVIRDNEDVSRRSEELIRELMREVKEVIDRLRELIERR

SEQ ID NO: 20528 - protein, 59 aa, Artificial Sequence
  Synthetic
EDKVRRIKEELERLIEENEKLLEESKKRSEDNARRNEELLERLRRELERLARELEEELR

SEQ ID NO: 20529 - protein, 57 aa, Artificial Sequence
  Synthetic
REKEELKKDIERMVEELKKLNKESRDRTRKLIKELEDLVKESDDDTERLARKLEKEV

SEQ ID NO: 20530 - protein, 56 aa, Artificial Sequence
  Synthetic
VEDLLREARKLIEELKRHTEEVIKRNKKLIDELKEIIEDVIRRNRKLVKELEDTAK

SEQ ID NO: 20531 - protein, 57 aa, Artificial Sequence
  Synthetic
SEKEDLKRRLDKLAEDLRRLNKEVDDEVKELARRLRKLNKDSRKRTEDLIRELEKRV

SEQ ID NO: 20532 - protein, 56 aa, Artificial Sequence
  Synthetic
VDELREEIKELIDRLRKHTEEIIRRIRRLFEELRKHSKKVIDDNKRLFDELEKTAR

SEQ ID NO: 20533 - protein, 57 aa, Artificial Sequence
  Synthetic
KEKEDLKRKVDELDKELKKLNEDSRRKTKELIKRLKDINKRLREELEKLADELRKKV

SEQ ID NO: 20534 - protein, 56 aa, Artificial Sequence
  Synthetic
VEELDREITELIKELRRHTEEVIRRNEKLARELEKHSRDIMETIRELIRDLERTAK

SEQ ID NO: 20535 - protein, 57 aa, Artificial Sequence
  Synthetic
SEKERLEKRLREVVRELEKLNEDLDRRLEELARDLERLNEESRRESRKLAEDLKREV

SEQ ID NO: 20536 - protein, 56 aa, Artificial Sequence
  Synthetic
VEEVEERIERLIRDLKRHTEEIKKTIEELMKELREHSREIIKRSRDLFKELKDTTK

SEQ ID NO: 20537 - protein, 60 aa, Artificial Sequence
  Synthetic
SELEKVIEEIREISERSLEKIKRLMEKIKELSDRTAERLRRVLEEIRKIIEEIKELRDRG

SEQ ID NO: 20538 - protein, 59 aa, Artificial Sequence
  Synthetic
KELAKKITEDLKRNEERNRRAIEELERTLRKLEEENRRLIREAEDTLRRLVEELEKKDE

SEQ ID NO: 20539 - protein, 59 aa, Artificial Sequence
  Synthetic
SELEEVLKEAKRLIDEIRKHTRDVSERSKRLLEEDLKHTEEVIKEIRKLIKEILDRIRA

SEQ ID NO: 20540 - protein, 59 aa, Artificial Sequence
  Synthetic
EDDLRRLKETIERLAKDLERLNREHDETNKKLAKDSEDLNRELKKRVEELEEELRRALK

SEQ ID NO: 20541 - protein, 59 aa, Artificial Sequence
  Synthetic
KELEDVLKEIRDLARRIEEHSKKVLREIEELIRRLEEENREVLRRMREEIKKIKEDIRN

SEQ ID NO: 20542 - protein, 59 aa, Artificial Sequence
  Synthetic
KRKLDELRRDVRRLERRLERLNETLKERIDRLAERLEEVDRRLDEELKRLAEELKEELR

SEQ ID NO: 20543 - protein, 60 aa, Artificial Sequence
  Synthetic
DKLDEIKERIERLVETDLRVIKRILEEADELIKENEKLIEKILRDNRRLIEEVEEIIRRD

SEQ ID NO: 20544 - protein, 59 aa, Artificial Sequence
  Synthetic
EKKLRELKKRVDELREESKDLNDKLEKRIRDLKRELKKLNDRHEEELRKLKERLRRATK

SEQ ID NO: 20545 - protein, 60 aa, Artificial Sequence
  Synthetic
DELDEILKTADKLAEDDLDTIRRLLEEVRDLVRKDKEVIKRILEEIDRLIKEVEDIIRRD

SEQ ID NO: 20546 - protein, 59 aa, Artificial Sequence
  Synthetic
EKKLKELEDRVRELKRRSEELLKKVEETLRRLKEESRRLNEELERTIRELEERLRRATK

SEQ ID NO: 20547 - protein, 56 aa, Artificial Sequence
  Synthetic
SKEDRAREELKRLKEELEKLLEEHRKTLEDLNRELKRLVDEHEKSIRELRKELKDS

SEQ ID NO: 20548 - protein, 56 aa, Artificial Sequence
  Synthetic
IDDVIRRVRETIDEVVRRIEELLEENRKLIEDLEEKIRRLNERLKRLVEEIKERDR

SEQ ID NO: 20549 - protein, 56 aa, Artificial Sequence
  Synthetic
SERERVREEVRKLLERLRELLERHRRKLEKLNRELEKVLEDHRRTLERLKEELERS

SEQ ID NO: 20550 - protein, 56 aa, Artificial Sequence
  Synthetic
IDTVLEEARKLIEKAERDIRRLAKENEKTIEEVKERLKKLMEENKRLIEEIKERTR

SEQ ID NO: 20551 - protein, 60 aa, Artificial Sequence
  Synthetic
SEIEDLLRRLKEVADEIKERLKKLSEESEELVRRVKRRIEELNKENREVMKEIKRRIDSG

SEQ ID NO: 20552 - protein, 59 aa, Artificial Sequence
  Synthetic
EEDVRRLAEDIRRLLEEIEKLLKEHEEKNRKLKKELEDLVRRHRKSVEDLKREIRERSR

SEQ ID NO: 20553 - protein, 56 aa, Artificial Sequence
  Synthetic
DDEERLEETLERLERELKKIADEHRRRNEELRDTLRRIAEELRKTHKDLLERLEEE

SEQ ID NO: 20554 - protein, 59 aa, Artificial Sequence
  Synthetic
KRVVEEVERKLRRLMDRIREELKRLTDESEDLVTKILDTVRRIVESIKKLVDELREERK

SEQ ID NO: 20555 - protein, 60 aa, Artificial Sequence
  Synthetic
DEAERLLERVDKAHERSEELLDRVLKENRKVLEEIRKLADDLRKLLDDIMRRIEDLVRKE

SEQ ID NO: 20556 - protein, 59 aa, Artificial Sequence
  Synthetic
DRDLREIERRLKEIEEENRKLVKRLEDENRKIAREVEKLVERLERRLREIARRVEESVR

SEQ ID NO: 20557 - protein, 56 aa, Artificial Sequence
  Synthetic
REKEELKKSIERVKRELERLLEEHRKRSEELKRRLEELLKDHKRRTDEVLKEAKDK

SEQ ID NO: 20558 - protein, 56 aa, Artificial Sequence
  Synthetic
VDTLEEEIKDIIRDVKRAVKESLEEDDRLAKEVEDMVRKSKEEVERLIEKVKRDTD

SEQ ID NO: 20559 - protein, 56 aa, Artificial Sequence
  Synthetic
REKEELEKEIERIKREIKKMLDELKRHSEELKRRAERLLEEHRRETERIIREMRES

SEQ ID NO: 20560 - protein, 56 aa, Artificial Sequence
  Synthetic
VKTLLEEIRKILKEVEDRIREILREDKRLADELEKAVRDSLREVKRILDEVREAVR

SEQ ID NO: 20561 - protein, 56 aa, Artificial Sequence
  Synthetic
DEDKRLADEIKRVLDELKKSVKEHRDHSEELLRRAKELLKRHEDETRKIEEEARRN

SEQ ID NO: 20562 - protein, 56 aa, Artificial Sequence
  Synthetic
VETLKREIEELIRRAKKVNKESKEDDRRLADEVRKVVERSEETVKRLRDEVTERVR

SEQ ID NO: 20563 - protein, 56 aa, Artificial Sequence
  Synthetic
REKEELEKELRRIKRELEKILEEVRKRSKELLDRLRELLRRHEAETEKAIEEMERA

SEQ ID NO: 20564 - protein, 56 aa, Artificial Sequence
  Synthetic
VDKLLRDVREIAREAKRVIRRILKTDEDLARELEEIVRRSLKKVEDLIRKVKEDAR

SEQ ID NO: 20565 - protein, 60 aa, Artificial Sequence
  Synthetic
SEEEKLEEIIRRSRKRLKELIDRLRELVKKIDDDLKRLLDEHRRRLEESERRAEELLKKV

SEQ ID NO: 20566 - protein, 56 aa, Artificial Sequence
  Synthetic
VEKVLKELEESSRRVVELIKKLMRELEKLLRDVEERAKDLLRKNTRSSEELEKRIE

SEQ ID NO: 20567 - protein, 60 aa, Artificial Sequence
  Synthetic
SEEEKLKKLLDESEKRLREILKRHEEIVRDIKRRLEELLKRHKELLDRSLKRLEELLKEN

SEQ ID NO: 20568 - protein, 56 aa, Artificial Sequence
  Synthetic
VEELLERVKKSSEDVAREIRKLARDNERLLEEVKRLIRKLLEENRESSKDVEDKIR

SEQ ID NO: 20569 - protein, 60 aa, Artificial Sequence
  Synthetic
SKEEELRDKLRKIRKRLEELLERLAREIDRIRRALEDLLRRHKEELDRSRKRAEELLKEI

SEQ ID NO: 20570 - protein, 56 aa, Artificial Sequence
  Synthetic
VDRVLEELDRLLKEVEETIRDLARKLRELLKRVEDTLRKLLKENKDSSRRLEEEIR

SEQ ID NO: 20571 - protein, 60 aa, Artificial Sequence
  Synthetic
SKEEELARMIEESVKRLKKLLDDLRKVIKESKDRLKELIDDHRRILEEIRRELEELLKKK

SEQ ID NO: 20572 - protein, 56 aa, Artificial Sequence
  Synthetic
VDKLLKEIEDSSRKLAEEIKKLIDEIRESSKEVIERVRRLLERNKELVRKVKEEIR

SEQ ID NO: 20573 - protein, 60 aa, Artificial Sequence
  Synthetic
SEVEKLEEEIKKINDEIRRLSDKNLEDLKRILEEIEDLSRRNLKKTKDILREIEEEAKRR

SEQ ID NO: 20574 - protein, 59 aa, Artificial Sequence
  Synthetic
DEFAERLKRSLEDSKRTSKELVDENRKLNEELERTVRKLIEDNKRLNDRVEKRVKELAD

SEQ ID NO: 20575 - protein, 58 aa, Artificial Sequence
  Synthetic
SLEDEIRRLIEEIKRKLKELLERLKEEIDRIREELKKSNRKLDELSRRIEEEARKRVG

SEQ ID NO: 20576 - protein, 59 aa, Artificial Sequence
  Synthetic
EEKIERVLREMEKLLRELERIAREVLKEIEKILRENKKHNEEVMERNKRLAKELKEKAD

SEQ ID NO: 20577 - protein, 58 aa, Artificial Sequence
  Synthetic
DLEREIDELIKDIARRLEESNRELEKLVRRIEEELRRSNKELEDLSRRIKTELRKEVG

SEQ ID NO: 20578 - protein, 59 aa, Artificial Sequence
  Synthetic
EEKAKRVADEIRKILRENEEHNEEVARRIEEILRRNKKHNKEVADKNRELLKKLKEEAR

SEQ ID NO: 20579 - protein, 56 aa, Artificial Sequence
  Synthetic
KLVEEIRKSAEDNRRRLEKLVRESKKSLDDNERENRKLVDELRKIATKIKEDLERD

SEQ ID NO: 20580 - protein, 59 aa, Artificial Sequence
  Synthetic
KEAVDKLEEENKRDHDEYKKVVDELKKENKEDHERSRKLAEDLKRLLEDIRRRIKETRR

SEQ ID NO: 20581 - protein, 59 aa, Artificial Sequence
  Synthetic
DEVEKLIEDLKEVTKKHAKRVEETNRHNEDVLRKVAKEVKRILDDVKRVVDEVKKVVDA

SEQ ID NO: 20582 - protein, 59 aa, Artificial Sequence
  Synthetic
DKAKKKLEDVLKRSREEIERLKDDSRKSVDETRERLKKLKEDLKRLLEEVRKEVEKLKR

SEQ ID NO: 20583 - protein, 59 aa, Artificial Sequence
  Synthetic
SEVEKLIKELRDVLKKVAEDVEKTNRDLEEVSKRSAEKVKKLEDELEKVLREVEELVKN

SEQ ID NO: 20584 - protein, 59 aa, Artificial Sequence
  Synthetic
RKAEEDLRKVLTEIRKRAEELRRESDESVKRSRKELERLLREIEKRVEEIEDRARKAKK

SEQ ID NO: 20585 - protein, 56 aa, Artificial Sequence
  Synthetic
EEVERIIEEIRDEVKKAAEKVEKVLKESREISKRAEDEVRRVLDEIRKLDETLRDA

SEQ ID NO: 20586 - protein, 56 aa, Artificial Sequence
  Synthetic
REKLRKVLDEIRREIERLKERLDRLDEESDRKSEKLKEDLERLLREIEKRIRDERR

SEQ ID NO: 20587 - protein, 56 aa, Artificial Sequence
  Synthetic
DEVRKVLEEIKELLKRLAEKVKKLIKESREISKRAAEKVKRLIEKSRRLLDTLEKA

SEQ ID NO: 20588 - protein, 56 aa, Artificial Sequence
  Synthetic
KDTLKTVLDTIKKKIEELVKELREVDEESKKRSKELKEEMDKVDEDIKRAIERRTR

SEQ ID NO: 20589 - protein, 56 aa, Artificial Sequence
  Synthetic
DEVRKVLEDIKRDLDRLAKRVKDVLREIEELTKEAARTVKKVIEESRRLLRKLKEA

SEQ ID NO: 20590 - protein, 56 aa, Artificial Sequence
  Synthetic
REDLTELLKRIEEKIKRLVEELERLLKRSREESKRLVEEMEKVNREIEEEIKKRAT

SEQ ID NO: 20591 - protein, 60 aa, Artificial Sequence
  Synthetic
EEVERLLKEIKDLLDEVARENKEALKRSKELLEEVAEDNKRVLREIEKLLEDVERKVKDE

SEQ ID NO: 20592 - protein, 59 aa, Artificial Sequence
  Synthetic
KELLKELEDLLRKARKTVEDLDRELEELNEEIRKALEELDKELERLVREIRKRLEDARR

SEQ ID NO: 20593 - protein, 60 aa, Artificial Sequence
  Synthetic
REAEELLKEIERLLREVERENKKALEDSRRLLEEVAEEVKKVLREIEELLKTLEELVRKE

SEQ ID NO: 20594 - protein, 59 aa, Artificial Sequence
  Synthetic
EELLRELKRLLEEIERRVRELDEELRKLNEDIKRELERLIRELEELLKRAEETLRRLKD

SEQ ID NO: 20595 - protein, 60 aa, Artificial Sequence
  Synthetic
SEVEDALRRLKELLRRVAEENRKVLEESKKLVEDARRKNEEVLKEIEKLLEDVAREVKDR

SEQ ID NO: 20596 - protein, 59 aa, Artificial Sequence
  Synthetic
EELLRELKKLLEEIKKSVEDLDRELKKLNDEIRDESRKSKEELERLLEDIERALRELAR

SEQ ID NO: 20597 - protein, 60 aa, Artificial Sequence
  Synthetic
SEAEEVLRRIEELVERATRTVEKLAEESKRLLEKLAEENKRVLEEIKRLLDEVADKVRKK

SEQ ID NO: 20598 - protein, 59 aa, Artificial Sequence
  Synthetic
KELLDELKTLLDEITKRLKDLTDKLERLNDKIRRELERLDEELRELLERIREEMEKLTR

SEQ ID NO: 20599 - protein, 60 aa, Artificial Sequence
  Synthetic
DLEEELKELLERIRKAHEELIKELEDLTEKIERDHEKLIKRLEDLLKRIEDEMRKLLEEI

SEQ ID NO: 20600 - protein, 59 aa, Artificial Sequence
  Synthetic
SRTVKEILKRIEDSLRRAAKKVKDLAEENKDSLRRVAEKVERILEELKRLLEEIARRVK

SEQ ID NO: 20601 - protein, 60 aa, Artificial Sequence
  Synthetic
SLEEKLEDLIRRLKESNERLKRELERLIEELRKNNERLLKELDDLVEEIERALRDLLREK

SEQ ID NO: 20602 - protein, 59 aa, Artificial Sequence
  Synthetic
SRKVEKILKDAKDSNKKVADTVREILKRARDSNKRVAERVKDLLRRLRELLKELAERVK

SEQ ID NO: 20603 - protein, 60 aa, Artificial Sequence
  Synthetic
DLEEELKELIKRIRDAHRELKERLDKLVEEIKRNNEKLSDDVRRLVREIEKELRRLLEEI

SEQ ID NO: 20604 - protein, 59 aa, Artificial Sequence
  Synthetic
KEKVKKLLKELEESLKRVADEVKRLLEELERSNREVEKRVRELLEEARRLLKDLADKVR

SEQ ID NO: 20605 - protein, 60 aa, Artificial Sequence
  Synthetic
DLERELRELIKRIEDDIRKNVKRNEESIRKTEDELRKNVRENERLIEEMRKELEKLRRRN

SEQ ID NO: 20606 - protein, 59 aa, Artificial Sequence
  Synthetic
EEVARKLLDELREIKKRINDTSRTTLEDNKRLAKEIHDSSKESLKRLKKILDDIREEAR

SEQ ID NO: 20607 - protein, 60 aa, Artificial Sequence
  Synthetic
RLAEELRKLIDKVRRDLDRNRETNRELIKRAKDELRKNEEENRRIIDEIRRALEDLTRKN

SEQ ID NO: 20608 - protein, 59 aa, Artificial Sequence
  Synthetic
EEAVRKVKKEIEDIVREIHKLSKRTLEELERIVEKIHEDSKRMLERVKKLLDKIRRDAE

SEQ ID NO: 20609 - protein, 60 aa, Artificial Sequence
  Synthetic
SLAEELRKLIKRVEDEIRRLAEENKDLIRKARETIRKNEETNREVITRIRREIEKLEKDN

SEQ ID NO: 20610 - protein, 59 aa, Artificial Sequence
  Synthetic
EEVVRELLKEIRKVLEDIRRESKTSLDDIRRLLKEINDLSEETIREAEELLDRIRKKAT

SEQ ID NO: 20611 - protein, 60 aa, Artificial Sequence
  Synthetic
SLREELKRLIDESRKSLRENEERNKKSIDDTRRLLRENERRNRETIKELKKTLDELRRRS

SEQ ID NO: 20612 - protein, 59 aa, Artificial Sequence
  Synthetic
KEAVDRLLERIRRINEEINRTSEKTLEENDRLVKELHERSERLLRKLEELLRKIDETIR

SEQ ID NO: 20613 - protein, 60 aa, Artificial Sequence
  Synthetic
SLAEELRRLIEEVKKRLKELEDRNRKLIKEARDELKENEETNRKTIEDIERTLEKLERDN

SEQ ID NO: 20614 - protein, 59 aa, Artificial Sequence
  Synthetic
EEAVRDLLRRIRELLRDLERLSEESLRKLKEIVEDIHRKSKTMLDKLRKMLEELRREAT

SEQ ID NO: 20615 - protein, 60 aa, Artificial Sequence
  Synthetic
SLAEELKRLIEESRKSVEELERRNRKLIEDARRDLERLARENRKLIEEIRRRLKDLAKDN

SEQ ID NO: 20616 - protein, 59 aa, Artificial Sequence
  Synthetic
EEVVRRLLEEIKRLNDEAKRKSKESLDRLREILKEIRKTSERTLEKLKRILDRIREEAT

SEQ ID NO: 20617 - protein, 60 aa, Artificial Sequence
  Synthetic
SEIEELLERIRDLMRRINKKSEDHLRELEKILREIRRLAEKSNEEIERLLRELEDLAEKR

SEQ ID NO: 20618 - protein, 60 aa, Artificial Sequence
  Synthetic
MKDLKKTLDDLLDELRKDIERNVKENRDTLKRIEDDIRRLAEENKKLLEEVRKKIEELET

SEQ ID NO: 20619 - protein, 60 aa, Artificial Sequence
  Synthetic
SEIEELLRRLEDILRRIEELIRKVLKELRDLVEKSNDLSRRHLEDAKRILKEIEEEVKRR

SEQ ID NO: 20620 - protein, 60 aa, Artificial Sequence
  Synthetic
VEELRRRLRKILEDIRKRIEELVEELRRLLKEWEEESKKNDETNREVLKRIEDRIRELER

SEQ ID NO: 20621 - protein, 60 aa, Artificial Sequence
  Synthetic
DEAEEIKERIKKVVEDLERKVRELLRRSEKLAEDLHELSKENIERMKRLLEELEDLVRKR

SEQ ID NO: 20622 - protein, 55 aa, Artificial Sequence
  Synthetic
EEIEDLLRKVEERIRELEEELRRLNKKIEEEVRRNKDENRRVNEEIERRIRELAR

SEQ ID NO: 20623 - protein, 60 aa, Artificial Sequence
  Synthetic
DESKEILDRIRKVNEDLRRLAEELLKDSRRVVEEAHKLSEDNIRRLEELLKEIEKEVRRR

SEQ ID NO: 20624 - protein, 55 aa, Artificial Sequence
  Synthetic
DKIRKLLEDSKKTSDELKEELDRLNEEIERSVRDNKRRNEEVNKRIEDEIRKLAT

SEQ ID NO: 20625 - protein, 60 aa, Artificial Sequence
  Synthetic
SEAETILEKIRRANEELNRLSEENIRKSRKVVKELHELSKENIKRARDLLREVKKLVEKR

SEQ ID NO: 20626 - protein, 55 aa, Artificial Sequence
  Synthetic
ESIKELLKEVEDDVRKNKEENKKVNKEAEDEVRENKERNTRVNKEMEEEIKRLAK

SEQ ID NO: 20627 - protein, 61 aa, Artificial Sequence
  Synthetic
SERERLERLVREAAKELKRLLEELERLHKKIDEDLKRSNDRLRELHERIKKDIERLLRRIG

SEQ ID NO: 20628 - protein, 56 aa, Artificial Sequence
  Synthetic
VEEILKEIEDILRKVKEDVKRVLDENRRVLEENKEHAERILRENKRMLEELRREAK

SEQ ID NO: 20629 - protein, 61 aa, Artificial Sequence
  Synthetic
DSEERLRKLMREAREELKELLRRLRELHEEIRKRVEELLRRLEELSDKLRRDLERLLREIG

SEQ ID NO: 20630 - protein, 56 aa, Artificial Sequence
  Synthetic
VEELLKTIKELVDRLRRIVEKVLDENRRLLKRLEEEIKRVLDENREMLDRLRKAAE

SEQ ID NO: 20631 - protein, 61 aa, Artificial Sequence
  Synthetic
SKEETLEKLVREVKDRLKKLLEEVRRLTEELERELKKLREELEELSKELEKDLRRLKKRVG

SEQ ID NO: 20632 - protein, 56 aa, Artificial Sequence
  Synthetic
VEELLKRIKELLEELERRVEEVLRRNRELLKRLEETIRKVLEENKKLLKEVREDAK

SEQ ID NO: 20633 - protein, 61 aa, Artificial Sequence
  Synthetic
DKEEELRRLVEEVEKRLRELEKELEDLTDKIEKRLRESNERIKKLSDDIRRRLEDLLRKVG

SEQ ID NO: 20634 - protein, 56 aa, Artificial Sequence
  Synthetic
VEELLKRIRDILKRVEEIVKEVLERNRKVLEDNERHAEEVLRRNKRLLEELEKRAT

SEQ ID NO: 20635 - protein, 61 aa, Artificial Sequence
  Synthetic
SKEDDLRKIVKEIEEEVRKLLKELEELTKELEDRLRESNKTLKELNERIKRRLEELLRRIG

SEQ ID NO: 20636 - protein, 56 aa, Artificial Sequence
  Synthetic
VEEVKKELEDLLRRLREEVKRVLDDHRRILKENEDHAREVLKRNKELLRKLEEEAK

SEQ ID NO: 20637 - protein, 61 aa, Artificial Sequence
  Synthetic
SKEERLKKLVDDVRKTAEKLKRDLERLTKEAEETLERLKRELDRLNREIAEEIKKILDRVS

SEQ ID NO: 20638 - protein, 56 aa, Artificial Sequence
  Synthetic
VETLLEEIERKLREVEKRIREVLKRHRELLRRLRETIKRVLERNKELLDRLREAAR

SEQ ID NO: 20639 - protein, 61 aa, Artificial Sequence
  Synthetic
SKEETLKKLMDRAEEELRRLKRELEELNDRIREALKKLNEDLRRLHEKIKEDIRKLLEEVD

SEQ ID NO: 20640 - protein, 56 aa, Artificial Sequence
  Synthetic
VEELLETIERILEEVRRRIEKVLEENKRLLDENKKHAEESLKKNKELLKRLRDAVK

SEQ ID NO: 20641 - protein, 59 aa, Artificial Sequence
  Synthetic
SEVDEVRERLERLLRTVERVVERILRELKRLNDELRKIAEDLLRENKDLLRELAERVRK

SEQ ID NO: 20642 - protein, 59 aa, Artificial Sequence
  Synthetic
SEALKDIEKLVRKIKEELKRLLKEVAETLERSERSLDKLIEDHRRLVEDIERALKELRK

SEQ ID NO: 20643 - protein, 60 aa, Artificial Sequence
  Synthetic
SEVEKVLETIKDLLRKLEEIVKKILDEDRKLMEKVTKIVEDLLEENKRLLEELERLAREG

SEQ ID NO: 20644 - protein, 59 aa, Artificial Sequence
  Synthetic
SELLKRIRELVKEVKDRLRRLREELEESVRRARKTLEDLERRHRKLLKDIRETIKELIR

SEQ ID NO: 20645 - protein, 55 aa, Artificial Sequence
  Synthetic
DLDREIERLVEELERRLRELLRRNEELVKRVEDELEKLKRESEKLLRELRKKLEE

SEQ ID NO: 20646 - protein, 59 aa, Artificial Sequence
  Synthetic
KEAVDKLLKELKDILKKLEELSRKSMEDIKDILRRYEKLVKELLDELKKILDELDRADK

SEQ ID NO: 20647 - protein, 55 aa, Artificial Sequence
  Synthetic
DLKDEIEELVKRARERLERLREESEEIVKELEKVLRDLEKENRDLARRLRDELRK

SEQ ID NO: 20648 - protein, 59 aa, Artificial Sequence
  Synthetic
EEAVRRLKDELRRILEEYERVVEELKKRLKDLLREAERLSKESLDELKRILRKLKEDAK

SEQ ID NO: 20649 - protein, 60 aa, Artificial Sequence
  Synthetic
SLEDELRRLVEEDERNIRKLNDENRKSVRKLEELLRRLNKRNRETIERIKRLLDRLREES

SEQ ID NO: 20650 - protein, 59 aa, Artificial Sequence
  Synthetic
KEEIDRILRKVERLSRKAHEDVRRINEELEKLLEKLKREVKRENDRVEEEAKRLADEVK

SEQ ID NO: 20651 - protein, 60 aa, Artificial Sequence
  Synthetic
REVDELVKRIEELLREMKKKNDESLKDSRDLLRELEKRVERVIEEIEKLLRDLEELVRKE

SEQ ID NO: 20652 - protein, 56 aa, Artificial Sequence
  Synthetic
EKRLKKLLDELRDMSRKADRALRELNKDVARKIEELRRRLKKLLDEVKERADELTK

SEQ ID NO: 20653 - protein, 60 aa, Artificial Sequence
  Synthetic
SEAEKLLEDLKRLVEDLRRKNKKLNDDNERLTTELEKTSRKLLEELKRLLEKVADDVRRT

SEQ ID NO: 20654 - protein, 58 aa, Artificial Sequence
  Synthetic
ELKERLDRLLEEVKKTIRELEKRNRESHKRTKDVARRSAEETKRVLEKIEDDLRKLDK

SEQ ID NO: 20655 - protein, 60 aa, Artificial Sequence
  Synthetic
SEAEKLLKEIKDLVDELRKRSKELIDENKRLTEEVEERARRLLTELRKLLKRLEELVRRE

SEQ ID NO: 20656 - protein, 58 aa, Artificial Sequence
  Synthetic
ELEERIRRLLREIEKEAKRSRDRSREVHRRTDEELRRLEREIKEILKEIKRKLDELRR

SEQ ID NO: 20657 - protein, 59 aa, Artificial Sequence
  Synthetic
SDVDRLLKENRDVSKKVEDDVRRLLEELKRISEEIARRVKRLLEELRRILREIEELVKK

SEQ ID NO: 20658 - protein, 59 aa, Artificial Sequence
  Synthetic
DELRRRAEKSIEDNERKLRKLEEDAKRIIDDNERILRDLERRAKDVIREVRKALEDLKR

SEQ ID NO: 20659 - protein, 60 aa, Artificial Sequence
  Synthetic
DEAEKLLEEVKEENRRVNEDIKRVIEEIKKLIDESRRLMEKIIRDVEALLTRIRDVVEKL

SEQ ID NO: 20660 - protein, 59 aa, Artificial Sequence
  Synthetic
EDVRREIERIMRELKKNLDRLEEEIRRIADELRRVNTRLEEEIKRVIDEARKTLEELRR

SEQ ID NO: 20661 - protein, 60 aa, Artificial Sequence
  Synthetic
SKEERLEEILRRHKKSLDEIRKELRKLLEDHRKSIEDLIRKLRELLERLKELLERLERSG

SEQ ID NO: 20662 - protein, 56 aa, Artificial Sequence
  Synthetic
VDRLITEIKRINEELRESVRRLLERAKRIDEELRRTAEELVKTIEKLAKELEETVR

SEQ ID NO: 20663 - protein, 61 aa, Artificial Sequence
  Synthetic
DEIEEVVERIRRIDKELNKRAEEVIRRNKELDERLNREIERVKEEIRRLIKRLEEVTRRDL

SEQ ID NO: 20664 - protein, 59 aa, Artificial Sequence
  Synthetic
EEAKKKLEDLLEEHERNLRKIERDLEELNERHERNLRKLKRELEEILKRAKEVLDELRK

SEQ ID NO: 20665 - protein, 61 aa, Artificial Sequence
  Synthetic
SEIEKVLREIEEIDKRLNKEVEDVLRENRRVDEELNRHSERVREEIERLVKRLDDVAREEL

SEQ ID NO: 20666 - protein, 59 aa, Artificial Sequence
  Synthetic
EEMKKTLEKLLREHEENIKELKRRLEELNEEHERNIRRSEETLKKLLKEAEDRLREIKK

SEQ ID NO: 20667 - protein, 60 aa, Artificial Sequence
  Synthetic
EEAERVLKRIADLIEELKRHSEEVSRRSKKLLDDLSRHTEKVSKESEDLLRRLEELARRG

SEQ ID NO: 20668 - protein, 59 aa, Artificial Sequence
  Synthetic
REIEERLRTLRRRLERMVEEIERLNEENLRRVEKRVRELEKENEDNLREAKKLLDEIRR

SEQ ID NO: 20669 - protein, 60 aa, Artificial Sequence
  Synthetic
SEVEEVLKDIERLIKELREENKRSLDRSRRLAEDLERRNRESLRRIEKLLRELEKIARDL

SEQ ID NO: 20670 - protein, 59 aa, Artificial Sequence
  Synthetic
EEVRKRAEDVLRRLEEVIKELEKTNEDAKRELKRLIDELRRTNEEVNKRLEERLDKIRE

SEQ ID NO: 20671 - protein, 60 aa, Artificial Sequence
  Synthetic
SEVERVLKDIERLLKELEERNRRSLEESAKSTRKVEEDNKRSLDKSTELLKRLEEDAKDD

SEQ ID NO: 20672 - protein, 59 aa, Artificial Sequence
  Synthetic
EEVRKRAEDVRRRLEEILKRLKETNEDMKRENKRVLDELRKTNEDAEKKLRDLIRKLRE

SEQ ID NO: 20673 - protein, 60 aa, Artificial Sequence
  Synthetic
SEVEKVLKEIDELIKDVERTNRESLEESERLLEKLKRENERTVERSERLAEELERLAREL

SEQ ID NO: 20674 - protein, 59 aa, Artificial Sequence
  Synthetic
EEVKDRADKLLRRLEEMVEKIRRTNETLLRALEKLIRDLKRNNEEVEKRLREIAKKIRD

SEQ ID NO: 20675 - protein, 60 aa, Artificial Sequence
  Synthetic
SEVDELLKRLKKLLEDDKRLAEELLKTIEKVNDDTRKRSEELLRRLERALEELEKLVRKV

SEQ ID NO: 20676 - protein, 59 aa, Artificial Sequence
  Synthetic
EEVKRRLEEVLREIKRLVDETRKELRRIDEESKRLAEKSRRDSRRVEERLRTLLEELRK

SEQ ID NO: 20677 - protein, 60 aa, Artificial Sequence
  Synthetic
SEVEKLLEDMERLLKEDEELVRRLSKRSEEIVRDDRRRNKEILDEIRKLLEELKRLADRL

SEQ ID NO: 20678 - protein, 59 aa, Artificial Sequence
  Synthetic
KDVEERLRRAEERIRRAVERTRDHARRNHEKLKELVKETRESNDRLKKEIRKLLEELRK

SEQ ID NO: 20679 - protein, 60 aa, Artificial Sequence
  Synthetic
EEEERIREVKKRSEDLLEELKRSNERVERESDKLAEEIRRKLEELARRADEVIRRLRARK

SEQ ID NO: 20680 - protein, 56 aa, Artificial Sequence
  Synthetic
TEKLLEDLKRINKETERLNRELLRDLERINEETRERIDRLLRELERMIDELRKRVD

SEQ ID NO: 20681 - protein, 60 aa, Artificial Sequence
  Synthetic
SERERAEEIRKRSEDVVREMRESNKDVSRKSEELAKKLREDLKRVEKKVRELLEEIKREK

SEQ ID NO: 20682 - protein, 56 aa, Artificial Sequence
  Synthetic
TEELLKRLEEISRRSRELNRRLLEDLKRINKETKERADKLLEDLERLLEDIKRRVD

SEQ ID NO: 20683 - protein, 60 aa, Artificial Sequence
  Synthetic
DEDERLKEVEEESKKVADELRDRLRRLMEESRRRLKRLREEAEEIKRELDTIAEDLKREK

SEQ ID NO: 20684 - protein, 56 aa, Artificial Sequence
  Synthetic
TEEILRRLEEISEESERRVEKLLRENKEINEETDRRVKELLERLKEVLERIERRVK

SEQ ID NO: 20685 - protein, 60 aa, Artificial Sequence
  Synthetic
DERERLREVLERSRKLAEDLRRSNEELERRSRELAKELRKTNKELEKRLKDKADDLRREK

SEQ ID NO: 20686 - protein, 56 aa, Artificial Sequence
  Synthetic
TERLLEELERISEESKRRNDELLEKNERVNEETRRRNEELLDELRRLLEEVERRVK

SEQ ID NO: 20687 - protein, 59 aa, Artificial Sequence
  Synthetic
DIEERIREVLRKARRVLERSEERSRELVERLRRVLEDSRRRTKRLTEEAKELLDEVRKR

SEQ ID NO: 20688 - protein, 59 aa, Artificial Sequence
  Synthetic
KKLVEDLLREIEKIIKEIEDTTKRVVDELRRLLEEIKRTSDELEKEVRKLLEEIKRATD

SEQ ID NO: 20689 - protein, 60 aa, Artificial Sequence
  Synthetic
STREALKELIDRLRDLVRRIRDKHRKLLEEIKRVLDESERRHRELIKRVEELLRDLARRV

SEQ ID NO: 20690 - protein, 56 aa, Artificial Sequence
  Synthetic
VETIIRRAEEALKRLEDSSRKVEETIRKVLEDLRRSSEEVAERVRRVLERLEEKAQ

SEQ ID NO: 20691 - protein, 60 aa, Artificial Sequence
  Synthetic
SSEERLRKVIEDLKRLAEESRKRHKELIDELRKAVERIERRHKKLLDEIKKVVDDIRRRV

SEQ ID NO: 20692 - protein, 56 aa, Artificial Sequence
  Synthetic
VDTIIEEVKRVLEELKRSTEEVEKRVRDAIEELERSSEELARRIKEVLKRLEEETR

SEQ ID NO: 20693 - protein, 60 aa, Artificial Sequence
  Synthetic
SAEEKLDRLRKEVERLSDETRKELERILKKVEDVIRETRRRAKELEEELRRLIRDIEEKL

SEQ ID NO: 20694 - protein, 56 aa, Artificial Sequence
  Synthetic
IETVIREIERLLEEDRKAVEEILRRIEKLIEDDKRAVDRIVKEIKDILDKLREETR

SEQ ID NO: 20695 - protein, 60 aa, Artificial Sequence
  Synthetic
DIEDELRKLEEEIRRVIEKWKRLTEENRRENERVIRKWDKLSKDLADEIRRVIEDARRKL

SEQ ID NO: 20696 - protein, 59 aa, Artificial Sequence
  Synthetic
KELVKELVDRVKRLIREIEKEARRTSEENKDLLKKIEDDAKRSEDELRELIKEIKKRID

SEQ ID NO: 20697 - protein, 60 aa, Artificial Sequence
  Synthetic
DIEDTLRKLAEDIKKVERDMEESNRRNREKNREVIEKWKKLSDDLERELEEVIEDARRKL

SEQ ID NO: 20698 - protein, 59 aa, Artificial Sequence
  Synthetic
RELVRKLIEDVRRLIEEIRRENKESSDRNKRLVEEIDERAKRSADELKRLLKEIRDRID

SEQ ID NO: 20699 - protein, 60 aa, Artificial Sequence
  Synthetic
DIEEALDEVRKEIEEVIRRWKKLTRENEEENRKVIEDIRRRLDELRREIEKVIRDARRKL

SEQ ID NO: 20700 - protein, 59 aa, Artificial Sequence
  Synthetic
RELVKKLIDDIRKLIDEIRRDAERTSRDNKRLVEEIERTIEKLIREVKELLERIKEEID

SEQ ID NO: 20701 - protein, 60 aa, Artificial Sequence
  Synthetic
DIEEILKKVEDDAREVIKEMRKSNEDNKRKNKKVIEEIERTLKKIEDDARRVIDEIEKKL

SEQ ID NO: 20702 - protein, 59 aa, Artificial Sequence
  Synthetic
RELVKKLDDELKELIKKIRTDNKRSSERNDELVKEIRKRIEKLVREAKELLKRIREDID

SEQ ID NO: 20703 - protein, 60 aa, Artificial Sequence
  Synthetic
SIEETLDELRKKIEEVIRRMKKSNDDNEKENREVIDRIRRTNEEIRKRAERVIEDARRKL

SEQ ID NO: 20704 - protein, 59 aa, Artificial Sequence
  Synthetic
KERVDKLIREVEDLIRRIEEENKKSSEENKRLVRRIEKDNEDSIRELEKLIEDIRRTID

SEQ ID NO: 20705 - protein, 60 aa, Artificial Sequence
  Synthetic
SLEELLEKVKREIDKVLERIERIVRKNAKENERVIREDERLLRELVKEIKEVEDRIRKRG

SEQ ID NO: 20706 - protein, 58 aa, Artificial Sequence
  Synthetic
DLMRKLLEEVKELIKRLEEEIEKASREDRRLVEEAKEKSKELAKRIKEELKRIEDEVR

SEQ ID NO: 20707 - protein, 60 aa, Artificial Sequence
  Synthetic
DEVDDIIRKLKELIKELREKSKRISEENKRLVRRLEELSRRIIKEIKDLLEELKDRARKD

SEQ ID NO: 20708 - protein, 59 aa, Artificial Sequence
  Synthetic
EEVKDKLRRIKEEADKAIKDNEDLLRRNERENREAVKRNEELLKEVRREVEEVIRRTRK

SEQ ID NO: 20709 - protein, 60 aa, Artificial Sequence
  Synthetic
SEVEEVIKRIKKLNKETEDAVREVIKRIEDSNEKLLRDVEELIKKIEKALRDLEDKARRV

SEQ ID NO: 20710 - protein, 59 aa, Artificial Sequence
  Synthetic
REVEELLRRVKRHTEEVVRRVERELRRIAEHVKEVEKTVRELVRRIREKIREVVERVRK

SEQ ID NO: 20711 - protein, 60 aa, Artificial Sequence
  Synthetic
DEARELVKELEDLIREITKTVRRLLEESEELIKRIDDAVDDLRRRDEDLNREIKEEIEKR

SEQ ID NO: 20712 - protein, 56 aa, Artificial Sequence
  Synthetic
ERILRELEERVKELEKEAREILKRSEDETDKLREKAERILEDLERKNRRTMDEARR

SEQ ID NO: 20713 - protein, 60 aa, Artificial Sequence
  Synthetic
SEVEELVERVKRLIDEIRKRVTDSVEESKRLIKEIKEEVDRLAEEDKRLNERIKETIRRR

SEQ ID NO: 20714 - protein, 56 aa, Artificial Sequence
  Synthetic
ERIVKKLEEEIRKIIKEIRELNKRSEDETKKIVDEARKILEDLRRENEDTKRKITE

SEQ ID NO: 20715 - protein, 60 aa, Artificial Sequence
  Synthetic
SEVEDLAKRIEDLIRRILRENERSLEESKRLIDEIRKRIEDLLRRSKELIDRIREEVRER

SEQ ID NO: 20716 - protein, 56 aa, Artificial Sequence
  Synthetic
KRILDELRKAVKKLEDDSRRLNRESEERTKKLKKELDELLKKSKDETKKLVEDLRT

SEQ ID NO: 20717 - protein, 57 aa, Artificial Sequence
  Synthetic
SEVEKLLRELEDVIRRLREDVKRIVEEDERLNKRLNDELRRLSEKNDRLNDRIRREV

SEQ ID NO: 20718 - protein, 56 aa, Artificial Sequence
  Synthetic
KEKVKRLRELVKKVIEDMERILRRLEKANRESAERAKDVLRRNHKKDEDSKRELER

SEQ ID NO: 20719 - protein, 57 aa, Artificial Sequence
  Synthetic
DRVREIVERVERVIRDILRTVEKLSEENKDLNRRLTEKIRDLERRDRELNKRLRDEV

SEQ ID NO: 20720 - protein, 56 aa, Artificial Sequence
  Synthetic
KEIVEDLRRKVEKVKRDAEKLLEDNHRRDRRNLREIEKIVEELKRRNEKTLRDLTK

SEQ ID NO: 20721 - protein, 57 aa, Artificial Sequence
  Synthetic
SEVEKLEEEVKEVIERLLRTVRDLSRRNEELNKRLTEDNERILKEDEDLNEELERRV

SEQ ID NO: 20722 - protein, 56 aa, Artificial Sequence
  Synthetic
KDVLRKLKKEAEDAIKEAEDILRENHEKDKKNKEDSEKLLRDLERRNEETLRRLRK

SEQ ID NO: 20723 - protein, 59 aa, Artificial Sequence
  Synthetic
RIEEILETLREELRTVLKKSKEILDELRKENKESIDRSKEILDRLRDEIRRILREIREK

SEQ ID NO: 20724 - protein, 59 aa, Artificial Sequence
  Synthetic
DEELKRAADKVKKLIKELDEENKKARDDDKRLNKKLNKDNDDLRREVEELLKRLRDEAE

SEQ ID NO: 20725 - protein, 60 aa, Artificial Sequence
  Synthetic
RIEDLVRDNKRKNDENTKRHERIVERLEEELRELVKRHEEDVRRLRKELEDLKRDAERKG

SEQ ID NO: 20726 - protein, 59 aa, Artificial Sequence
  Synthetic
DKKVEDLDRDNERLNRELTRHLEDLVRRVKELLRRMEEHLRELAERVKKLLDELRKEAT

SEQ ID NO: 20727 - protein, 60 aa, Artificial Sequence
  Synthetic
SDVEELAERVRRLSEEHAELVKRIVETSKRLNDDLRRMVKEIADRVRRLLEDIERKVRED

SEQ ID NO: 20728 - protein, 59 aa, Artificial Sequence
  Synthetic
EDVRKIIEDLRRHLEENRERVERIIRELRRLTEKTKKELEDIARELEKLVDELREEVRR

SEQ ID NO: 20729 - protein, 60 aa, Artificial Sequence
  Synthetic
SEVEKAEEDIRRLLKEVKDMDKKIVDDDERLNRELERTVRELAKEIEKLIRDLEERVRKE

SEQ ID NO: 20730 - protein, 59 aa, Artificial Sequence
  Synthetic
KDVKKIIKELEEELEKIAKESEESIKRLRKENRDSEERLRKILEKLKKDLEDVKRELER

SEQ ID NO: 20731 - protein, 60 aa, Artificial Sequence
  Synthetic
SDVEDVVRKIRELIRENLKRSKEIADENRRLNTENRERSKTLEEEVRRLLEEVKERAERL

SEQ ID NO: 20732 - protein, 59 aa, Artificial Sequence
  Synthetic
EEVRRILEKLRDDLRKLNETNRRIIKELRERNEKSNRDNRKILEELKDRLKKLEDELRR

SEQ ID NO: 20733 - protein, 56 aa, Artificial Sequence
  Synthetic
DEVDEVDKRSKETLKKIEDDARRVLEEYERTLEKIKRDVDRVLKESEETVRKLRAD

SEQ ID NO: 20734 - protein, 60 aa, Artificial Sequence
  Synthetic
EKELEDLVRELEEINKRLEEELRKLVEELRRHLEELRDELRKLVEELRKINEELEDRLTK

SEQ ID NO: 20735 - protein, 59 aa, Artificial Sequence
  Synthetic
SEMEDLKRVSDEVKKELEDLNRKSAKVSKEVEEEAKRLNRESREVVRRLKEELEKLERD

SEQ ID NO: 20736 - protein, 62 aa, Artificial Sequence
  Synthetic
KEVADELKKILDTHRKVDKEAKDRSEKLVRDHREVDKDVKRESDEILKRAKDTLDEIRERLR

SEQ ID NO: 20737 - protein, 60 aa, Artificial Sequence
  Synthetic
SELEKILKEIEEELKRVKERLERLHREHERLLRDVTRKLRKLLRDHREVLERVREELRRR

SEQ ID NO: 20738 - protein, 56 aa, Artificial Sequence
  Synthetic
REDLERTLRRIKEEVRKVERKAKEVLRETREKLKRLLERAREVLDENKKRLDDVAT

SEQ ID NO: 20739 - protein, 60 aa, Artificial Sequence
  Synthetic
SLEDIRRRLRELVRRLEEELRRSHEELERLVRDLERRLRESLRKLEELVDRLKKEIEKRG

SEQ ID NO: 20740 - protein, 59 aa, Artificial Sequence
  Synthetic
DDTARRLLEEAKKELDRIKEENERALRKIKDVIRKIDEESKRLNKEVADLVKKIEDRIR

SEQ ID NO: 20741 - protein, 58 aa, Artificial Sequence
  Synthetic
DLEDIVREIEKLLRDLERKAREIHERDERLARDLERKHRDIIREIERLLDELRERVER

SEQ ID NO: 20742 - protein, 59 aa, Artificial Sequence
  Synthetic
RKKVEEELERVRRIIKELERRLRELHKENKKLLDEILEESKRLAEEVRKTIEDIKRKIK

SEQ ID NO: 20743 - protein, 60 aa, Artificial Sequence
  Synthetic
SEVEDLLRRDRELNREHKRLLEEASKKNKEELERVLEKVKELLERVKKRLDEAKEALERG

SEQ ID NO: 20744 - protein, 59 aa, Artificial Sequence
  Synthetic
ERLERVLRESRKLNKESHETLKELIDRNRKLNKELEEAVKKIEEEIKKLLKELKEEKDR

SEQ ID NO: 20745 - protein, 60 aa, Artificial Sequence
  Synthetic
SEVEKLLREDRELNKRHVEKVRELSERNKELLERHEEKLKKVAKEIEDRLRRLEEMLRRG

SEQ ID NO: 20746 - protein, 59 aa, Artificial Sequence
  Synthetic
DRLKRVEEESEELNKRSHETLRRLVEENKKRNKELHERVERIKRRLEKLLRELEEEIRK

SEQ ID NO: 20747 - protein, 60 aa, Artificial Sequence
  Synthetic
SEVEELLDEDRKLNEELTKSAKRLTDENKKLLEDMKRKAEELKKRVDELLKEVTDVLRRG

SEQ ID NO: 20748 - protein, 59 aa, Artificial Sequence
  Synthetic
DRLERVLRESRKLNEDSKKRLEELIKENKDDNDRLREDLERIVRELEKRLDKLRKDTET

SEQ ID NO: 20749 - protein, 61 aa, Artificial Sequence
  Synthetic
KELEDLLRRIKRLIDENRRLSKEVLEEVRKLSEKHKKEVEDILKEIKELIEEALRRIERDG

SEQ ID NO: 20750 - protein, 60 aa, Artificial Sequence
  Synthetic
KERLDRILKTLRELLRKLREDNERIRREIREIVKRNSDELARIEEELRKLLDDLAKKAEE

SEQ ID NO: 20751 - protein, 61 aa, Artificial Sequence
  Synthetic
KELEDVLKEVEELSRRHKRRAERVSEENRKLLRRLKEEARKILEDIRRLLKKLEERVRRDG

SEQ ID NO: 20752 - protein, 60 aa, Artificial Sequence
  Synthetic
RERLKRILDEIRRIVEKNKRDLERLLRENEELNKRLREELRRILEEIEELLRELEERLRK

SEQ ID NO: 20753 - protein, 59 aa, Artificial Sequence
  Synthetic
SEAEEALKELKETSDRHKEDLDRLHEEDRRTNEEVEKELRKLVDEAKKKLDRVREIVEE

SEQ ID NO: 20754 - protein, 56 aa, Artificial Sequence
  Synthetic
EELLRRLEEIVRDNKRRVEEILERNRRLNEESEKKVRDIIKKLRDDLERLARELEK

SEQ ID NO: 20755 - protein, 59 aa, Artificial Sequence
  Synthetic
SEAEEALKELKRTSDEHRKRLEDLHRRDKKLNDDSKRRLDELLKRDEDTNRTVLDIARQ

SEQ ID NO: 20756 - protein, 56 aa, Artificial Sequence
  Synthetic
EELLRTLEKIVEDNAREVTEIIKKNRKLNDDSRREHERINDESRRLNEETEKRLRD

SEQ ID NO: 20757 - protein, 57 aa, Artificial Sequence
  Synthetic
DELEEILRRVDELIKTIEEELKKIEKRVKELLETHRELNKRLLDDHRRLAEEVKKAN

SEQ ID NO: 20758 - protein, 60 aa, Artificial Sequence
  Synthetic
RDRVEDVLRKIAEKIKRLEDRIKEVLDKLRKLAKELEDESRKVLDDSNKLIERVKRELKR

SEQ ID NO: 20759 - protein, 60 aa, Artificial Sequence
  Synthetic
DTERVVTEIKKTNDELKRRHEKVVEDDRRLLEELRRRHERVVREVERLLRELKERVDRRA

SEQ ID NO: 20760 - protein, 59 aa, Artificial Sequence
  Synthetic
REVLKKLLDDNRKIIEDLTRKNEKLHEDSKRIIEKIDDENREILRRVEEIVRRIEEELN

SEQ ID NO: 20761 - protein, 55 aa, Artificial Sequence
  Synthetic
SAEDVKRRIKESADRIRKRLREALERAKKLHTDNEEENKRVNDEIKKRVEEIRRR

SEQ ID NO: 20762 - protein, 59 aa, Artificial Sequence
  Synthetic
EKLLRELERDVRRLEREITEVVKRLEDEHKRASERNKRLLEEIKDRVRKLIEEAEERRK

SEQ ID NO: 20763 - protein, 60 aa, Artificial Sequence
  Synthetic
EEVERVRRTIDELSKENEKALKEVEERIKKLSDENEKAVRKAEEDNERLNRTAERLKRSN

SEQ ID NO: 20764 - protein, 56 aa, Artificial Sequence
  Synthetic
EKVLRDIRKKIKENHEKNERVIREIERLLKENEERNEEVIRRIKESNRKTEKDLTD

SEQ ID NO: 20765 - protein, 60 aa, Artificial Sequence
  Synthetic
SEVEEVERRIDRLSKENRRVLEEAKRRIKKLSDENKRMLEEARKRNEKLNREVKKLKKSN

SEQ ID NO: 20766 - protein, 56 aa, Artificial Sequence
  Synthetic
EKVLRDIREKAKRNHDANEKVIREIRDILRRNNEENKRVIEEIDKSNKDTEDELRK

SEQ ID NO: 20767 - protein, 59 aa, Artificial Sequence
  Synthetic
REVEEVKKEIKKLSDENKEVLERARKRIEDLSRENEDVLRRLKERNEDLNRRVRELKER

SEQ ID NO: 20768 - protein, 56 aa, Artificial Sequence
  Synthetic
EEVLRDIRRELKENHDENRKVIEDVRRIAEENHRRNKRVIDEIRRSNKETVDELRK

SEQ ID NO: 20769 - protein, 59 aa, Artificial Sequence
  Synthetic
RAEELRKEIEEIIKKNKKENEDVLREDRRRLKELKEEIEKVVREDRRTLEELEERLRRS

SEQ ID NO: 20770 - protein, 59 aa, Artificial Sequence
  Synthetic
EEVLKEIRERVEKLSEKNKRALEKWKRDSERLSREVERELEEWKKRSKRLAEEVEEATR

SEQ ID NO: 20771 - protein, 61 aa, Artificial Sequence
  Synthetic
DLEELEREVEKKLKELEDRVRKVIEESKTELKKLEEELRENSREVRDILRRLEEDVRRKVK

SEQ ID NO: 20772 - protein, 59 aa, Artificial Sequence
  Synthetic
KRLLEELRRRLDRVRKEVERLIKEHRETTDELRKRVEKLSEDHRREVEKLAKTVKDELK

SEQ ID NO: 20773 - protein, 61 aa, Artificial Sequence
  Synthetic
SRAEKIREDIRRLRKENEDRIKEIEDEFRKLLEEHERKNKEIEERVRRLVKRIEDEIRRKN

SEQ ID NO: 20774 - protein, 55 aa, Artificial Sequence
  Synthetic
DELAKRVREVSEDVNRRLDKIMKDLRRVIKELDEESKRLLEEIKRRMEEILEELR

SEQ ID NO: 20775 - protein, 60 aa, Artificial Sequence
  Synthetic
SEEEKLAKDNERLVREHEEESKKLLKTIRDLSEEHKRDLKRAMEENKEKVDRLRDMLKRG

SEQ ID NO: 20776 - protein, 55 aa, Artificial Sequence
  Synthetic
EEIATKSEELHKELEETNERIAREVEKLEKENDEILEEIADRSRRLHEDLDRERK

SEQ ID NO: 20777 - protein, 61 aa, Artificial Sequence
  Synthetic
DELEEVLRTIEKLVEDHNRELERVLRRVKELADRHREESERVAREIKKLVDDARRLVEERG

SEQ ID NO: 20778 - protein, 58 aa, Artificial Sequence
  Synthetic
DEVRRIRERVKELLDRNRERLERIEREIDRLLEDLKRKNEKIEREVRRLLAKLKEEAR

SEQ ID NO: 20779 - protein, 61 aa, Artificial Sequence
  Synthetic
SELEKIVEENRRLVKEHNERLKRILDELRELAKRHEDRSRKAMKENEELVRTVLELMKRDG

SEQ ID NO: 20780 - protein, 58 aa, Artificial Sequence
  Synthetic
EKVRKIREESKRLHETNRRRVEKIEEEIRRLLKRLEDTNRDIERRSKKLHEDLEREAR

SEQ ID NO: 20781 - protein, 61 aa, Artificial Sequence
  Synthetic
SELDKVMRDNDRLVKEHAEVSKELLDRLKKLAEDHKKRSEEVLRENKRLVDEVRRLAKERG

SEQ ID NO: 20782 - protein, 58 aa, Artificial Sequence
  Synthetic
EKVRKIARRSDDLHRELKERNDRIKREIERLLEELKRTNDKIVEDSKRLHDDLEREAR

SEQ ID NO: 20783 - protein, 61 aa, Artificial Sequence
  Synthetic
DELEEIRKTIEELSKENKKKLEEVMKEVEELARRHEKRSRDLLRRLKKLVDELRDRVEKTG

SEQ ID NO: 20784 - protein, 58 aa, Artificial Sequence
  Synthetic
ERVRKISEDVRKLLEDNKRIAERIDERIKELLKRLEDTNRRIEEEIDRLLEELKREAD

SEQ ID NO: 20785 - protein, 57 aa, Artificial Sequence
  Synthetic
DELDDLLRRAKETSDRHKETLKKILDEMREEVKRHNRDLERILEEVKRLIDEVRKAN

SEQ ID NO: 20786 - protein, 59 aa, Artificial Sequence
  Synthetic
REDVKRIKETMKKLLDENRTEVEKIKREADRLLEENRRLVKEIEDTIRELLKRLEDERR

SEQ ID NO: 20787 - protein, 60 aa, Artificial Sequence
  Synthetic
SKKETIKKDAEEALKRSKKKLDELKERLRKVMRETEERLRRLEKELRDLAREIREKIKKR

SEQ ID NO: 20788 - protein, 55 aa, Artificial Sequence
  Synthetic
DRLRKEVEDLNRETDKVIEKLREDIDRLDKESEEVIRRLKDEIRRLFEEIDRRLR

SEQ ID NO: 20789 - protein, 61 aa, Artificial Sequence
  Synthetic
SELEEVKERVDRLIREVEKMNRDSERRVKKLIDDVRRENRRTEEDVRRLVKRAEEIVRKDG

SEQ ID NO: 20790 - protein, 59 aa, Artificial Sequence
  Synthetic
KEKVDRLKKEADDLLRKIKEDNERITEKVKELLERLRKNNEEIKREADRLLEELRRRVK

SEQ ID NO: 20791 - protein, 57 aa, Artificial Sequence
  Synthetic
SELEELDKRITELSEEIKRRLEELLRRNEDLSRRIEEAIRRILKRNEDVIRDIKRKN

SEQ ID NO: 20792 - protein, 58 aa, Artificial Sequence
  Synthetic
KKVRDIEEKIERLNRELEKIAKEIRERTERLNKRLEELIREVDERNRDLLRRLEEEVK

SEQ ID NO: 20793 - protein, 60 aa, Artificial Sequence
  Synthetic
KDEEDARRKLEELRELARRDIERNKRELERLRREIEKDEEDNEEVIKRLRERVEELRRRQ

SEQ ID NO: 20794 - protein, 58 aa, Artificial Sequence
  Synthetic
ESLKRLKEELEKLLRDYKKKLDDSDKELRDLLAEYDDRLTRSDKRLRDLLKEAREKSK

SEQ ID NO: 20795 - protein, 61 aa, Artificial Sequence
  Synthetic
DTAERAEEELERSDRELKETLRRAEEELKRSHKELERIVERARRELRRLAEELEEVIRRKK

SEQ ID NO: 20796 - protein, 60 aa, Artificial Sequence
  Synthetic
EETLRRKLERLLERHKKVVDDVERTLRDLLERHKEVVERVREKLTDLLRKLKKVIDDVRR

SEQ ID NO: 20797 - protein, 58 aa, Artificial Sequence
  Synthetic
SELETIKKRAEELSKESEDILRDIERKLRKLSEESKDILRRLKEELEKLHKELVDKKG

SEQ ID NO: 20798 - protein, 59 aa, Artificial Sequence
  Synthetic
EELEKELEEVLTEYREVVERLADELRRLLKKYEDDVRRLEEHARRDLEKLDRDIKEEER

SEQ ID NO: 20799 - protein, 57 aa, Artificial Sequence
  Synthetic
SKLDDLLRKIERLVTESLRRLRKTNEDAKRLLERSVRELEKSNKEIRDLVKEIKERN

SEQ ID NO: 20800 - protein, 59 aa, Artificial Sequence
  Synthetic
KKKVDELRERLRELLKRHRDAVEKNRRDLEKLREDHRRLVEKNKRDLDKLKEELDRTKK

SEQ ID NO: 20801 - protein, 57 aa, Artificial Sequence
  Synthetic
SELDELLKRLEELVREIIKRLRDSNRRAKEVVDRSVKRLEESNRTLRELIKDVKDKN

SEQ ID NO: 20802 - protein, 59 aa, Artificial Sequence
  Synthetic
EEKLRRIKRRIDELEKTLRKIIKDNTDNLRKLTEDHRRLVEKNKRDLEKLEEELKRRRK

SEQ ID NO: 20803 - protein, 57 aa, Artificial Sequence
  Synthetic
SKLDELLERIREEVKRSVKRLEDSNKEIKRLMEESADELRRSNKELRDAVRDLKRKN

SEQ ID NO: 20804 - protein, 59 aa, Artificial Sequence
  Synthetic
EEKVRRLDKVLEDLRREHEKIVRDNEENLRRLLERHKRLVDKNKEDAERLLRELRETVR

SEQ ID NO: 20805 - protein, 59 aa, Artificial Sequence
  Synthetic
SELEELLKRLRDLIERIVKRLRELSKESEDLIRRIERTIEKLSEDSERAIEEILRRIDK

SEQ ID NO: 20806 - protein, 59 aa, Artificial Sequence
  Synthetic
EDRLREVEEEAKKLEKRIEDMIRKHKETNKRLKEELDKLVKEHKDRNRKLLEELKKRAT

SEQ ID NO: 20807 - protein, 61 aa, Artificial Sequence
  Synthetic
SEIEEVIERLDDTMRRIEERIRDTNRRLKKVIDDSKRRNERTNREVRKTIEKLTRELERDG

SEQ ID NO: 20808 - protein, 54 aa, Artificial Sequence
  Synthetic
EVKRRLEELRRRIEKMLEEHRESLRRLEEELEESHKRHKDTLRKLSKELEEKLK

SEQ ID NO: 20809 - protein, 61 aa, Artificial Sequence
  Synthetic
DEVDEVLKRVDELLKRHEETNKRLEEEIRKIHEENKRTIEELLKEVRKRAEEVERLVRRDG

SEQ ID NO: 20810 - protein, 59 aa, Artificial Sequence
  Synthetic
EEELKRVKERLKEIRKRAKESHDRLRETVKELIDRNRKLLRELEEELRKIEEKIREDAR

SEQ ID NO: 20811 - protein, 56 aa, Artificial Sequence
  Synthetic
SEEDELRETAKRIREEVKKSIEENRELAKRITDEVRELLERNKRRIEEVKERLERS

SEQ ID NO: 20812 - protein, 56 aa, Artificial Sequence
  Synthetic
EDDLRRRLEELLKRLRDESRKVNEDLKRLVDELRRLSKEMNEELKELEDRVREKER

SEQ ID NO: 20813 - protein, 57 aa, Artificial Sequence
  Synthetic
SEEDEVREDNKRIVEEVERLLKEIEDNNREITREAEELLKRLEEEARRLMEEIRRSK

SEQ ID NO: 20814 - protein, 60 aa, Artificial Sequence
  Synthetic
DEELLRRLRDMNRRSKERADRLIEEAKKENDRSSKRVRDLIREVDEILKEVKKRVEDVTT

SEQ ID NO: 20815 - protein, 56 aa, Artificial Sequence
  Synthetic
SEAEKVVEELKKLLREVEKKIRDHTEDVKRILEELERRLRKHSEEVRRTAKELKDK

SEQ ID NO: 20816 - protein, 59 aa, Artificial Sequence
  Synthetic
EKVLRELEKILEDIKRTLDKLLRENRETLKRIEDRLRELLEENRKLLEKIERELRERSR

SEQ ID NO: 20817 - protein, 56 aa, Artificial Sequence
  Synthetic
SEVEDVIRKLRRKAEDLTRRLKEHTDDVKRLMEELSKDIKDHTREVKRIAREAKEK

SEQ ID NO: 20818 - protein, 59 aa, Artificial Sequence
  Synthetic
EEVLRDLERVLRDIERRLRELLRRNEEVLDRIRRTLEDLHRKNEEVLREIERDLRERER

SEQ ID NO: 20819 - protein, 56 aa, Artificial Sequence
  Synthetic
SEVEDVIRRLKKKLRELVERIREHTKRVRDLARKLEEEIKRHTEEVKRIADEAKKR

SEQ ID NO: 20820 - protein, 59 aa, Artificial Sequence
  Synthetic
DELLKRLEDVLRKIRKDLEELLRKNNRDLEEIKKRLEELHRRNRETLERIRKDLEEDER

SEQ ID NO: 20821 - protein, 61 aa, Artificial Sequence
  Synthetic
SEIEEVLERIKKLLDELRKESRKLLEDHKKRAEELEEKARRLSERHKELLDRLKEVVDRDG

SEQ ID NO: 20822 - protein, 59 aa, Artificial Sequence
  Synthetic
EEMLKRAEDLLRRIDEELKRSHEELKELSDRIRERLERLLRTLEELSKEIDKRADDLRK

SEQ ID NO: 20823 - protein, 61 aa, Artificial Sequence
  Synthetic
SEIERVLEELRKLLEELRRESKKLLDELRKLLEDARRESEKLLRELKDLLRRAEELVKRDG

SEQ ID NO: 20824 - protein, 59 aa, Artificial Sequence
  Synthetic
EKVLDELRRELDKIREDLKKSHRELEELIKKIRTELDKSNRKLEELLKRIEERLDEMRR

SEQ ID NO: 20825 - protein, 61 aa, Artificial Sequence
  Synthetic
SEAEKVLEELKKLLRDLEETSKRVLREIRELLKEAREKSKRLLDRLRKLARDLKELVRRDG

SEQ ID NO: 20826 - protein, 59 aa, Artificial Sequence
  Synthetic
KEVLDRIKRLLEEIERELERSNKELEDLLRKIEEDLERSHRELEKLIREILKELEDARK

SEQ ID NO: 20827 - protein, 57 aa, Artificial Sequence
  Synthetic
DAEERLRKLLDDIRRELKRLTEETRKSLEKIKRDNDELEKKLRKLNEDSDRRLKEAN

SEQ ID NO: 20828 - protein, 59 aa, Artificial Sequence
  Synthetic
EKTIEDLLRELEKALRDLEKEVREINKELKRVLDEIAKTHEDLLKKHEELLRRVEERAR

SEQ ID NO: 20829 - protein, 57 aa, Artificial Sequence
  Synthetic
DLERELEKLLKDIKEELDKLIRTNEETLKEIEREVRKLLKRNKELLDRIREEVRKTG

SEQ ID NO: 20830 - protein, 59 aa, Artificial Sequence
  Synthetic
KEVVDRILKEARELLERIREENRRTLEDLRRILEDLRRRNKRHLDELRRVLKELRDKRK

SEQ ID NO: 20831 - protein, 56 aa, Artificial Sequence
  Synthetic
SLEERLEKLLKEIRETVKKNIEENRDLLRRVEEDLRRLTERNKRLLEKIRDALRKA

SEQ ID NO: 20832 - protein, 59 aa, Artificial Sequence
  Synthetic
EEVARRLMDDLRRLLEKIDRLSREHLERVRKILEDLRRLSEKHLKELEDLLREAEEEAR

SEQ ID NO: 20833 - protein, 56 aa, Artificial Sequence
  Synthetic
SLEERLEELLDEIRKMLKRLEDENRRLLKEIEKRVRENTRTNRELLKRIEDRIRKA

SEQ ID NO: 20834 - protein, 59 aa, Artificial Sequence
  Synthetic
EEVVRTLLRELEKILAEAEDLSRRHLERLRDILREAEDLSRKHLEELKKVLEELERRAK

SEQ ID NO: 20835 - protein, 57 aa, Artificial Sequence
  Synthetic
SDVERLLRELEDLLRRLEERIRELNKRHEELVRRLKEEVKRLSREHNEVVADVARKN

SEQ ID NO: 20836 - protein, 59 aa, Artificial Sequence
  Synthetic
KELRDRLRDVVRRLEDELRRLDDELRKNSEEVKKVLDDLRRHLEENSKRAEDTLRELRR

SEQ ID NO: 20837 - protein, 57 aa, Artificial Sequence
  Synthetic
SEVEKLLRELEKALEDLRRTNEKLDREHDAVVKEVKKIAKDLSREHRDVVEDVKRKN

SEQ ID NO: 20838 - protein, 59 aa, Artificial Sequence
  Synthetic
EELRDELRRVVEDVEKKLDDLRKRNEENSRKVKEVLEKLTRELDKNREEVERTLEELRR

SEQ ID NO: 20839 - protein, 57 aa, Artificial Sequence
  Synthetic
SEIEKLLEEIKESLERLKKTAEDLLEELRRLLEELERRVKELSDEHRRLVKELKDRN

SEQ ID NO: 20840 - protein, 59 aa, Artificial Sequence
  Synthetic
EELKKRVEDVLREIKRAHDDLRRRLEKILRDIEKTIEDLERHMKENHDDAERVIEELKR

SEQ ID NO: 20841 - protein, 60 aa, Artificial Sequence
  Synthetic
SEEEALERVLRELRRSLEELEEELRRAIRKLEDNLRRLREALETILKKLDDLLDDLRRRK

SEQ ID NO: 20842 - protein, 55 aa, Artificial Sequence
  Synthetic
DKLKKEADDLDRRSRKTIKEVLDEIKELDDRSNERIEEVIREIEDEARRLAREVD

SEQ ID NO: 20843 - protein, 60 aa, Artificial Sequence
  Synthetic
SEEERLREIRERLKKSLEDLKRELEEILRELERSLDKLRRDLERLLEDLRRLLDELRRRK

SEQ ID NO: 20844 - protein, 55 aa, Artificial Sequence
  Synthetic
EELEKKARELNERSKEKIKRLLEKLRKLDKESKDEIKRVLDKLRELAKRIKEEMD

SEQ ID NO: 20845 - protein, 60 aa, Artificial Sequence
  Synthetic
SEEERLRRVIEEYKRVLDELSERLKRLLDELRRSLKKLEEDLKRLLDELKRTLDELIRRV

SEQ ID NO: 20846 - protein, 55 aa, Artificial Sequence
  Synthetic
EELEKKLREALDTVRRLYEALIKKARELDKRSKDEIKRVVDKLKKLVRDIEERVR

SEQ ID NO: 20847 - protein, 60 aa, Artificial Sequence
  Synthetic
DDIEDVLRRIEKLIRDLRDHSRKLVEEIEKLIEDHTRHSRKLERDIKELLKRLRELRRRG

SEQ ID NO: 20848 - protein, 59 aa, Artificial Sequence
  Synthetic
EEVKKRLDEARRKAEKVVKESRDTLRELKDKVRENLDRSRKELKKLEEELEEVLREARE

SEQ ID NO: 20849 - protein, 60 aa, Artificial Sequence
  Synthetic
SDVERVAKTIEDLIREHTEHVKRSAERVERLIKEHTDHVRRSLTRIEDLLRRLEEMRRRG

SEQ ID NO: 20850 - protein, 59 aa, Artificial Sequence
  Synthetic
EDVERKARELERKVRENVRKVRDDHRKLEEKFRDNLRKVKREHEEAERKMRDLLREARR

SEQ ID NO: 20851 - protein, 60 aa, Artificial Sequence
  Synthetic
KDVDKVEEDIERLLADLRRHNEKLHRDIERLLEELRRHNDKLRKTLEDLLKKLKELAERG

SEQ ID NO: 20852 - protein, 59 aa, Artificial Sequence
  Synthetic
EDVKRRLEDLERKARRVLEESRKDLEEAKKKVDELMKRARDSLRELTRRLEELVRRIRK

SEQ ID NO: 20853 - protein, 60 aa, Artificial Sequence
  Synthetic
SEVEEVMKEIERLIEELRRHNEELARRLEELIKDHTRHNEELHKTIEDLIKELEDLARRG

SEQ ID NO: 20854 - protein, 59 aa, Artificial Sequence
  Synthetic
EEVEKRLRELKEKLDKVLDELRETLKRLEEKARENLKRSRDDLETIKRKLKKVMDEARR

SEQ ID NO: 20855 - protein, 59 aa, Artificial Sequence
  Synthetic
SDVERLIEELERLLDELRKKTEEIIRRIKKLIDELRRKTEEVIKRLEKLARDLTRLTER

SEQ ID NO: 20856 - protein, 59 aa, Artificial Sequence
  Synthetic
EEARRRIDEIRKKAEEVNKESRDRLRRLKEEVDKVDKDSKRRLDELREELRRLMEESKR

SEQ ID NO: 20857 - protein, 60 aa, Artificial Sequence
  Synthetic
DAARELRERLKKAIEDHRRLLERAARDVERLNKELEDILRRMAEDMKRSIEELKRVSEEG

SEQ ID NO: 20858 - protein, 56 aa, Artificial Sequence
  Synthetic
EKDLRRLEEEIRKEIRRSNETLKKLKKKTEDSLRTIKRRLEELHEEAKKVLDDLRR

SEQ ID NO: 20859 - protein, 59 aa, Artificial Sequence
  Synthetic
REDETLKRLEEENEEVNKRSEETLRKLLEDNRRLLERIEERLRELLEELRRLLEKIRKD

SEQ ID NO: 20860 - protein, 56 aa, Artificial Sequence
  Synthetic
KDELTERVKRHIEENKKLTEDVARKSEKHLRDLEELLERLRKLVEDLLRRLEEEAR

SEQ ID NO: 20861 - protein, 59 aa, Artificial Sequence
  Synthetic
SELEKVRKESERNLRSNEKLLRELDELSERNLDKLRRFVEEVRELVREMLERLDSVRRR

SEQ ID NO: 20862 - protein, 59 aa, Artificial Sequence
  Synthetic
EEVKRDVERNEKENKELLDRTRRKVEENAKRNKKLLEDIREDLKRLATELRRKLEEIRR

SEQ ID NO: 20863 - protein, 61 aa, Artificial Sequence
  Synthetic
DKEETVKDLERRYRDLLREIEKRLRELVRRNDKLLEEIKKAIEDLIRENEKKIKEIKERRG

SEQ ID NO: 20864 - protein, 55 aa, Artificial Sequence
  Synthetic
DELRRRAEEALERNKRLLEELKKENDDHLKRLKELLEELKKRNEDHLRRLDEEER

SEQ ID NO: 20865 - protein, 59 aa, Artificial Sequence
  Synthetic
KELEEIKRAVDESLKRAKELMDRHRREVEKSLEEMKRLAEDHKRRADRLLKELKRLADE

SEQ ID NO: 20866 - protein, 59 aa, Artificial Sequence
  Synthetic
DEVRRAVKELKDRHKELLDRIERESERLREEHRRLLEKIERTSEDLIRRLEKLIRDIRR

SEQ ID NO: 20867 - protein, 59 aa, Artificial Sequence
  Synthetic
DEVETVEEEVKKSLEELRDLARKHEKKVRESLKRLEESLRRSEEKVKDIIRRLEELKKR

SEQ ID NO: 20868 - protein, 59 aa, Artificial Sequence
  Synthetic
EEVKKRLEDLRKEHEDTLRDIERRSRELLKRHKDKVDEIRKAHERLIRELEEIARRIKK

SEQ ID NO: 20869 - protein, 59 aa, Artificial Sequence
  Synthetic
SEEEELKKKLEKSLDELRRSLKKSAEDVRRILEELKELMKRHKEVVEEIARELDELRKR

SEQ ID NO: 20870 - protein, 59 aa, Artificial Sequence
  Synthetic
EDVERSLRDLRRKHKELVDRIDEEHKRLEKELRDIIEEIERRSRKLLKELEDIIRETRR

SEQ ID NO: 20871 - protein, 59 aa, Artificial Sequence
  Synthetic
SLEEELKRVMKEVRDLAKEHSDRSRDVMREIRELSEENERRLRRVLEEAKRLADDLRRD

SEQ ID NO: 20872 - protein, 59 aa, Artificial Sequence
  Synthetic
ERLKDILRRIREDIERLLDELRKLNEKIKRDVDRLLKENKETLDDIERRIRKLLDDERR

SEQ ID NO: 20873 - protein, 60 aa, Artificial Sequence
  Synthetic
SVEELITRVERENERVARRDEELLRENEKRNRDVTREDRDLLKKLKEEVEEVLKRIREEG

SEQ ID NO: 20874 - protein, 59 aa, Artificial Sequence
  Synthetic
EETVKELVKHNEDLLRKWEKKSEDLSRKNEEALERWRRKSKKLAEELKKTLEDIRREVT

SEQ ID NO: 20875 - protein, 60 aa, Artificial Sequence
  Synthetic
DVEDKIRRLKERIKEVTERDRKLLEELKREAEEVLRRDKKSLEEVEREIEEILKDAERKG

SEQ ID NO: 20876 - protein, 55 aa, Artificial Sequence
  Synthetic
DELIREVEKVLEDWKRKVDELNRRLKKVLKEWEDTVRKLNEELKDVLDKLREELD

SEQ ID NO: 20877 - protein, 56 aa, Artificial Sequence
  Synthetic
DMEDKLRKIKEAIKKVLDEIRKLLEDIRRRLKRVREEIEEIHKRNEEENDRVKKEL

SEQ ID NO: 20878 - protein, 55 aa, Artificial Sequence
  Synthetic
DELIKKIRELLEELKDELRKLLEEAEEVLERLKRSVEELSRRNKKLVEDLDRKTR

SEQ ID NO: 20879 - protein, 56 aa, Artificial Sequence
  Synthetic
SVEEKARDILEKLKRVVEKIKEIADRNRRENEDADREIKRLIEENKKRNEDLLRRL

SEQ ID NO: 20880 - protein, 55 aa, Artificial Sequence
  Synthetic
DELIKRIKEIIETLEKEVEDLSRENKKKVEEILDKVRKVSTRNREKLDELDKKVR

SEQ ID NO: 20881 - protein, 61 aa, Artificial Sequence
  Synthetic
SDEEILRELEKRLEENVRRVEKRHEELEREVRDNLRRAEEKHRELEERVKRVIEEVIRTKG

SEQ ID NO: 20882 - protein, 59 aa, Artificial Sequence
  Synthetic
EEMVRKLVEDVDRLITDHTRSLEDVDRKVKDVIRRHTDSLRKVEEDVKRIIEELRKKAE

SEQ ID NO: 20883 - protein, 61 aa, Artificial Sequence
  Synthetic
DDEEILKKLREDVERVIKKIEDSLRELRKRLKDNVDRAEELHRRLEERAKKLIDEIIKKRG

SEQ ID NO: 20884 - protein, 59 aa, Artificial Sequence
  Synthetic
REFVRRLAERVKKLLKELEDRLRELEERVKEVITRHTRSLEEIVRRVERVLEEMERAAK

SEQ ID NO: 20885 - protein, 60 aa, Artificial Sequence
  Synthetic
SETEEAKKEIDEIIKRIEEETKRLRETYKRIIEEIERVSKRLEDEYRKLIEELERAKREG

SEQ ID NO: 20886 - protein, 55 aa, Artificial Sequence
  Synthetic
EELDKLRRRLEEILKRHEESNKKLSEDLERILEEHRRENERLHRELREILERLRR

SEQ ID NO: 20887 - protein, 56 aa, Artificial Sequence
  Synthetic
SIEDILRELEKELRESSKRSREILERLREELRDSSRRSEEILERLKRKVKRVKEEI

SEQ ID NO: 20888 - protein, 59 aa, Artificial Sequence
  Synthetic
DKRVREVAERLRRLNERYNREVKRLEKEARRLNEEYNRLVERLAREVEKLIRDLKEEAR

SEQ ID NO: 20889 - protein, 59 aa, Artificial Sequence
  Synthetic
SLEDLVREIRKRLDDMEREVKKVDDESRKRLDEARKRVEKINRESEKRLKEVADELSEL

SEQ ID NO: 20890 - protein, 59 aa, Artificial Sequence
  Synthetic
EKLARDLRREVRKLEKRLEELLKELKETTEKILRELERLLKKLEDDTRRVLEEIKELKR

SEQ ID NO: 20891 - protein, 58 aa, Artificial Sequence
  Synthetic
DEEREVKRKYREDLDDIRRHSEEVLKRYDEAVKKLDEDLKKVVEEYERALEEIVRRAG

SEQ ID NO: 20892 - protein, 56 aa, Artificial Sequence
  Synthetic
EEMSKDLERELRRSRRENERLAKELEDALRKSEEDIRRLVEENKERLERLERELSR

SEQ ID NO: 20893 - protein, 61 aa, Artificial Sequence
  Synthetic
SEAEKVEEEVKELVKRNREKHDEIRRRIEKLKEDLKRTSERSERKIKRLVEKIDDTLRKKG

SEQ ID NO: 20894 - protein, 59 aa, Artificial Sequence
  Synthetic
EDELKRMADTIRDEIRKDNERLRRTLEKAKREADEYRERDKRKLEDFEREIRRIEEETR

SEQ ID NO: 20895 - protein, 56 aa, Artificial Sequence
  Synthetic
DEREEIEKTIRELMRENDDLVRKIRREIEESLRENRRTLEKIKKEIEELTRKAKRD

SEQ ID NO: 20896 - protein, 59 aa, Artificial Sequence
  Synthetic
EETLRKRLEEVKRKSDEHKKELEERLREVRRRSERVNEELKKTLEEVRKKIRELIERDR

SEQ ID NO: 20897 - protein, 59 aa, Artificial Sequence
  Synthetic
SEEEVARRVEERVEELDRRLREIVKDLRDHNRRMKEKLEEAVERVRRRDKELDDILRET

SEQ ID NO: 20898 - protein, 55 aa, Artificial Sequence
  Synthetic
EELRKKLEDLRRKIDEKVKKVTKEHRDSAKKIRDDVRRVKEENKKANRELAEKRR

SEQ ID NO: 20899 - protein, 58 aa, Artificial Sequence
  Synthetic
SREEEVEEEYERLLEEIRRRVKEVEKEYRDLLKKIEDDVREVRKEYEKLVEDLSRKAG

SEQ ID NO: 20900 - protein, 56 aa, Artificial Sequence
  Synthetic
EDASRRLRDIARRSREELEEEVKRLRTEIEKSERELRETTKENRKIIEDVRRRLEK

SEQ ID NO: 20901 - protein, 58 aa, Artificial Sequence
  Synthetic
SEKEEVEREYRELLKEIEKRIDEVIKEYRDLLRDIRREVKRVLREYAELVKELKKTTG

SEQ ID NO: 20902 - protein, 56 aa, Artificial Sequence
  Synthetic
DEAARELRKKAEDSKRELEKLEEENRRIIKRSRERLKKIEEDNRRIIKEVLDRARK

SEQ ID NO: 20903 - protein, 59 aa, Artificial Sequence
  Synthetic
SKEELVKKARDELRRVLEELKRAVDELRKRDEDYERKSEDVVRRLRKIDKDVREVLRRG

SEQ ID NO: 20904 - protein, 55 aa, Artificial Sequence
  Synthetic
EEVEEEIRREAKRIDDELEKVEEENKRTLDRAKKHNEEVEKENRDTLREIDKERE

SEQ ID NO: 20905 - protein, 62 aa, Artificial Sequence
  Synthetic
SIEEEAKEIIDKVRKEVEDIVRRLKETNDEVRERLERILRRLEEVDEEAKRRVEELRERKRT

SEQ ID NO: 20906 - protein, 55 aa, Artificial Sequence
  Synthetic
DRLREELEKLARDVERRTRELEKHHRELMKRAKEETERLERHHDELAKRVREKLK

SEQ ID NO: 20907 - protein, 60 aa, Artificial Sequence
  Synthetic
DEIETVLDEVRRLHEDAKRRLEEMIDEVRKLNEESVRELARVVEEVERLLRTVKEEVERA

SEQ ID NO: 20908 - protein, 56 aa, Artificial Sequence
  Synthetic
AREALKESRKVVEESRESVRRVLEKNRRVVEESKRLAEELLRRVKKVVDEIRKRVE

SEQ ID NO: 20909 - protein, 60 aa, Artificial Sequence
  Synthetic
DELEEVVRRVRELSRTVKEELREVIERVRELSERVKKKLRKVLREVAELHREVMKRVRDS

SEQ ID NO: 20910 - protein, 56 aa, Artificial Sequence
  Synthetic
AEEVLREVEKVVEDSRRSAKDALKRVEDRVRESDKSVRELLEENRKVVEDIKRRVD

SEQ ID NO: 20911 - protein, 60 aa, Artificial Sequence
  Synthetic
EELERILDKVRKVIEEVRKRLRDDLRTVEKVLKETEEVLRRAAERAKRALERVEEAARRG

SEQ ID NO: 20912 - protein, 55 aa, Artificial Sequence
  Synthetic
REVLRKVRELLRTIREEVERVLRKSNELSTRIKKRIDDVLETLERLLKELDDKLR

SEQ ID NO: 20913 - protein, 60 aa, Artificial Sequence
  Synthetic
KDVEDVEREVDEVVKRSDDTVEENLRRAEDVVRDTDRIVKEMKERIDRVVERVEEVVRRG

SEQ ID NO: 20914 - protein, 55 aa, Artificial Sequence
  Synthetic
EEVLRKVTRLLREAKRRTEESHKKVNDLSRRVKERVDEVLERVKRLLEEVKRKVK

SEQ ID NO: 20915 - protein, 60 aa, Artificial Sequence
  Synthetic
DEAEKVLKESKDTVDKIRRDVERLVDESRKTVDRIRELVDKAVKDSKDSVDRLRDVMRRN

SEQ ID NO: 20916 - protein, 56 aa, Artificial Sequence
  Synthetic
EEVLRRIEKVNRDVARRVEEVFREAKEVNKKVDREVEDVIRKVKRVNEKVDEELKK

SEQ ID NO: 20917 - protein, 59 aa, Artificial Sequence
  Synthetic
SEAEEVVRRSRETVTRNVRMLEKVVRDSEETVKKIVRDVERLLEESKKSVDDLRRLKEE

SEQ ID NO: 20918 - protein, 56 aa, Artificial Sequence
  Synthetic
EKVLREVKEVNERVRETSRDIADRVREVNEDVKRKVKKVIDDIRRVNEKVKRELEK

SEQ ID NO: 20919 - protein, 60 aa, Artificial Sequence
  Synthetic
DEAREVVKRVKDLVRRLRRLSEKSLEDDKRLIEEVNKRSKDILDKVKKLVDDLRDMVRRT

SEQ ID NO: 20920 - protein, 56 aa, Artificial Sequence
  Synthetic
EEVIKEIERVVRKVLEESREVHERIRETVKEVNDRNRKVLREIREVVKKVFEDARR

SEQ ID NO: 20921 - protein, 59 aa, Artificial Sequence
  Synthetic
SDAEEVVRENRELVERIVREVEKILRDNEELVKRLVELVETSLRRNEKMVDELKKLVDR

SEQ ID NO: 20922 - protein, 56 aa, Artificial Sequence
  Synthetic
SRVIKEIRDTSKDAVRKVEEVLRRIEETVRDAERKVKEVIKRIRETSKEVLDRVRK

SEQ ID NO: 20923 - protein, 60 aa, Artificial Sequence
  Synthetic
DAAERALRRSEEVVRESVEEVKTWVDENRRSVERLREELRKDEERVRRVVERIRKLVEDG

SEQ ID NO: 20924 - protein, 56 aa, Artificial Sequence
  Synthetic
EEVLKRVRKTNDDSDKEVKRLIDEARKLNDDVRKEVEEVLERTTRILDRVRKEVEK

SEQ ID NO: 20925 - protein, 60 aa, Artificial Sequence
  Synthetic
DEAREVERRVREMVKELKRRLEEDVKESDKSVKDLERIAKEDVDRSRESVKELRDRVRRR

SEQ ID NO: 20926 - protein, 56 aa, Artificial Sequence
  Synthetic
EEAVRRVKRIIEEVRKVLEDVFRESERLNREVREKLKRMFETSKELNKRVEEALRE

SEQ ID NO: 20927 - protein, 61 aa, Artificial Sequence
  Synthetic
DSRRELEDDVRRIVETNRRLLEELERRVKKILEENRRLVEELRKENERIVRELTDRVRRDG

SEQ ID NO: 20928 - protein, 56 aa, Artificial Sequence
  Synthetic
EDVVRTVEKLIRDLEEESRRVLEEVRRLLDEVRKESEEVHKRVNEIVKRVEDEIRR

SEQ ID NO: 20929 - protein, 59 aa, Artificial Sequence
  Synthetic
SSKDEIRRRVEEVVERSDEIVKRSREHVKTVVDELDRVVKELERKVREVVKKLDKIRKD

SEQ ID NO: 20930 - protein, 56 aa, Artificial Sequence
  Synthetic
ERALREVEEISRKSEEKLRRVLKESEDIAKEAEDRLKTVLERVERIADEVLKRLTK

SEQ ID NO: 20931 - protein, 59 aa, Artificial Sequence
  Synthetic
SKVKEVEDRVREVVKESERVARESLEHVRRVVRKTEDVVRRLKEKVRKAVEDLKEIKRR

SEQ ID NO: 20932 - protein, 56 aa, Artificial Sequence
  Synthetic
EEVLKKVEEISERSRRELRRALKESDKISEESLRRLRKVLREVEEIVRRVLEELRR

SEQ ID NO: 20933 - protein, 59 aa, Artificial Sequence
  Synthetic
SKVEKLEEEIARLVERSRRLVEELKKEVTKVKEKVDEIVERSRRHVKKVVEKLRDIKRR

SEQ ID NO: 20934 - protein, 56 aa, Artificial Sequence
  Synthetic
EEVLRRVEETSDRSEKELRTVLRDVTEDIKRIAEELKKALEDSTEIIRRAEDELRT

SEQ ID NO: 20935 - protein, 61 aa, Artificial Sequence
  Synthetic
DSDRKIDDEVRKVVETSERSLRENIKRIEKVVRKLEEEVRKDLEEVRRVVKELREIVKRNK

SEQ ID NO: 20936 - protein, 56 aa, Artificial Sequence
  Synthetic
EEALRKVEEDLRRLDRRVEEVVTRSKEILDEARKSVEEVVRRSDEILRRVEEDLRR

SEQ ID NO: 20937 - protein, 60 aa, Artificial Sequence
  Synthetic
DEVEDILRKVEEIVKKSITDARRLLKEAREIVEESIKTAEELLRRNEDIVRKLSEDVKRT

SEQ ID NO: 20938 - protein, 55 aa, Artificial Sequence
  Synthetic
KRVLEKIKKVVDDSVRVNREVLKRVEEVLEESKRVNEKVEEDVRRVHEEVRKEIK

SEQ ID NO: 20939 - protein, 60 aa, Artificial Sequence
  Synthetic
DRVEKLLEDAKKIVEDSKRTAEKLLRENEKIVEKIKREADKILEDNKKIVDELAEAVKRT

SEQ ID NO: 20940 - protein, 55 aa, Artificial Sequence
  Synthetic
RRVLEEVKRVIDESRRVNKRVEEEIRKVHRDVERRLEEVLKRVRDTSEDVRRKIK

SEQ ID NO: 20941 - protein, 60 aa, Artificial Sequence
  Synthetic
SEAEKLLRDVEREVERVIEDADKLLREIEEIVKRSEDKAREILKENEKIVRELKEAVRRT

SEQ ID NO: 20942 - protein, 55 aa, Artificial Sequence
  Synthetic
EEVLRRIKKVVDDVRERLREVEKRIRDVIDRSRRVNERVLREAERTSREVERAID

SEQ ID NO: 20943 - protein, 59 aa, Artificial Sequence
  Synthetic
DEAEDVLRKVRERVKESERHVEKVLEDVRRVVKKSIDHARDVLRKVKEVIDRVRELVER

SEQ ID NO: 20944 - protein, 55 aa, Artificial Sequence
  Synthetic
ERVEREIRRVLKRSKERLEEVVKEIRELSEKSRRVLEEVKKRIREVLERVRKDVE

SEQ ID NO: 20945 - protein, 59 aa, Artificial Sequence
  Synthetic
REAEEVLKEVRKAVEDSIRHVEEVLEEVKKVVEESIRHIRDSLRDVRRVIEEVDRLVKR

SEQ ID NO: 20946 - protein, 55 aa, Artificial Sequence
  Synthetic
KRVKEEIDRVLDESKRVLEEVVTRIRKVSDDSEKEVRRVHKESKRVVEEVERTVD

SEQ ID NO: 20947 - protein, 60 aa, Artificial Sequence
  Synthetic
DEAEDVLRRVREMVERSIEHVRRVLKEVEDVVRESIKHVEDVVREVREVIREVEELVDRN

SEQ ID NO: 20948 - protein, 55 aa, Artificial Sequence
  Synthetic
KRVEEEIDKLLRESKRELDEVRKRIEDLSRESERRLREAVEEIRRLVKKVAEKVN

SEQ ID NO: 20949 - protein, 59 aa, Artificial Sequence
  Synthetic
KEAEDVLDEVRKAVEESIKHVKRVLEEVEEIVRRSIKHARDSLRKVKEVIDKVRTLVRR

SEQ ID NO: 20950 - protein, 55 aa, Artificial Sequence
  Synthetic
ERVRREIKRLLDESREVLKEVTKRIRKVSRDSERVVEKVHRDSKDVLDKVREDVR

SEQ ID NO: 20951 - protein, 57 aa, Artificial Sequence
  Synthetic
SSLEKAEDEVRELLRDVERVLKEVRDRIEELNRKVNEVLRRVIEESERLLREVLERV

SEQ ID NO: 20952 - protein, 59 aa, Artificial Sequence
  Synthetic
SEKVRRLVDKVRETVTDIVRRVTRLLEESEESVRRLIEKVKKLNEESRRIVEKIEKDAR

SEQ ID NO: 20953 - protein, 57 aa, Artificial Sequence
  Synthetic
SELERVEEDVKRVNKEVNDTLEKVIRDSKRVLDEVEERTRKVKRDSERLLERVERAV

SEQ ID NO: 20954 - protein, 59 aa, Artificial Sequence
  Synthetic
EEVVERVLEESRRSVETLIRDVERVNKKSREAVERNIRRSTAANERSKKIVKEIIDTAK

SEQ ID NO: 20955 - protein, 59 aa, Artificial Sequence
  Synthetic
DEAEDVVRRVREEVERLIRRSREVAEESKRTVDKLRRELEELLRRSRETVERIKKLIDE

SEQ ID NO: 20956 - protein, 55 aa, Artificial Sequence
  Synthetic
DKVREDIERVLREVEEVDKEVKERVRKVDEDSKKEIKEVKDEIRRVDEESRERAE

SEQ ID NO: 20957 - protein, 59 aa, Artificial Sequence
  Synthetic
DEAEKVLEKARDLVRRNIERSRRVLEENKKSVDDLIRRNEETNRRNEKSVDEVKKLVDN

SEQ ID NO: 20958 - protein, 55 aa, Artificial Sequence
  Synthetic
DDVLREVKRVLDEARRVSEEVEKESRRVLEEAKRVAEEVHKRSKKVVDDVKERAR

SEQ ID NO: 20959 - protein, 61 aa, Artificial Sequence
  Synthetic
SELEDVKRRIDKVVREVEEVVREVSERSKKVLEEVRRSAERVNREIERVLREAKDEVRRRT

SEQ ID NO: 20960 - protein, 56 aa, Artificial Sequence
  Synthetic
AKRVLEEARKIVDRLRKIVEEVVRRSEELIRRLKKINEDSLRRVEELVKDLIREVS

SEQ ID NO: 20961 - protein, 60 aa, Artificial Sequence
  Synthetic
KEAEEVVERVRELIERLRRRVTEMLRESKRLVEENIKRSEDALKESERLVDKLRELVKRT

SEQ ID NO: 20962 - protein, 55 aa, Artificial Sequence
  Synthetic
DKVLRTIEKLLDDVKKEVEKVNEDSKRLLRDVERVSKEVNDESRRVLEEVKREAK

SEQ ID NO: 20963 - protein, 59 aa, Artificial Sequence
  Synthetic
SELEKIVEKIKRIIDESRRTVEESVRKSEKIVEEVKKRLEELVEEVRKIVEEIVRIIRN

SEQ ID NO: 20964 - protein, 58 aa, Artificial Sequence
  Synthetic
EELEKVKRMVDKVVDDVRKVNDTSRKRSKETLEEARRKVEEVKRRIDKVLRDVKREID

SEQ ID NO: 20965 - protein, 60 aa, Artificial Sequence
  Synthetic
DEVEEVVKRVKEVVEKIVRELEKLVEESKKIVEDAVREDERLVEKIERVVRRLVEEVRRS

SEQ ID NO: 20966 - protein, 55 aa, Artificial Sequence
  Synthetic
EEVKKLVDEVVKEVEEVIKRVEDLDRRVLEENRESTRDVERRVREVVKRVREALK

SEQ ID NO: 20967 - protein, 59 aa, Artificial Sequence
  Synthetic
SDAERVVREVERLVDTTRKLVKKVVEDIRRVVETAKRDLDRVVKRSEDVVREVKKLIEE

SEQ ID NO: 20968 - protein, 55 aa, Artificial Sequence
  Synthetic
DRVIKLVRKLNKDSERKLREVRDRVERVIEEVEKRLREVKERSKETIEDVERARK

SEQ ID NO: 20969 - protein, 59 aa, Artificial Sequence
  Synthetic
DEAEKVVEEAKRRVKEVVERLREVADRNRRSIEELVKELRAVVEDSRKSVEDLVRRVRN

SEQ ID NO: 20970 - protein, 55 aa, Artificial Sequence
  Synthetic
EEVKKLVEDVIEEVRKVVKEVEDISRRVIEDLKRVLEEVEKRSRKLIKEARDETR

SEQ ID NO: 20971 - protein, 59 aa, Artificial Sequence
  Synthetic
DELREVVKRVRRLIEEVRRLVKELVDRVRKVIEELKRRSEDSARESERVVREIKKLVEE

SEQ ID NO: 20972 - protein, 58 aa, Artificial Sequence
  Synthetic
EELEDVDRDIERVREEVKRVVDEVRKRIRDVLEDARRESKRVLDRSRESLREVREAVR

SEQ ID NO: 20973 - protein, 59 aa, Artificial Sequence
  Synthetic
DELEELVKRVEDVIREIEERVRRLVRESERVVKEILKKSRKSVEKVKEVVDRAVDLVRK

SEQ ID NO: 20974 - protein, 58 aa, Artificial Sequence
  Synthetic
ERLKDVEREIRRVLRRAEKVVDEALKRSRDTLREVRKVSKEVREDIERVVKEADEAAR

SEQ ID NO: 20975 - protein, 56 aa, Artificial Sequence
  Synthetic
SVVDRVREELEKVLRHSKKVVEDVKREIDKVLKRSEDALRRVEEESKRVLEEVERD

SEQ ID NO: 20976 - protein, 59 aa, Artificial Sequence
  Synthetic
KDTLKKLVEEARKVSEDSRRRLERIVEEMRRVSEDSRRRLEEIVRENRKVVEEVRRRAT

SEQ ID NO: 20977 - protein, 56 aa, Artificial Sequence
  Synthetic
SVVERVREEIKRVLENSKRAVDKVREDIKRVLDESRKAIKEVEDEIRKVLEEVERG

SEQ ID NO: 20978 - protein, 59 aa, Artificial Sequence
  Synthetic
SDTVRRIVEEIEKVSRESVKRLEDIVREMKKISEESKETVDRIVEKIREVVKRLLEAAK

SEQ ID NO: 20979 - protein, 56 aa, Artificial Sequence
  Synthetic
SAVETVRKTIEDVLRNSERVLKKVREDSKKVLENSERVLKEVEDRSKEVLKEVEDG

SEQ ID NO: 20980 - protein, 59 aa, Artificial Sequence
  Synthetic
KKELDEIAEEIKRVSEDSVRKARELAERNKKVSDESVKRVKKIVRENEKVVEELLKAKK

SEQ ID NO: 20981 - protein, 60 aa, Artificial Sequence
  Synthetic
SEVDEIVRRIKEISKRSVDDLEKLARDNKKAVEEVLEELRKLLEENEKMVREVLEEVRRS

SEQ ID NO: 20982 - protein, 55 aa, Artificial Sequence
  Synthetic
ERLDRMLKEVIKHSEKVVRDVEETSKTVLKEIEDALKKVEEASKRVVDRLEEATR

SEQ ID NO: 20983 - protein, 60 aa, Artificial Sequence
  Synthetic
RRVDEIAKKIKRISEESVKTLDKIMEDARKIVKDVLDELRKLAEDNKRVVREVLERVRRS

SEQ ID NO: 20984 - protein, 55 aa, Artificial Sequence
  Synthetic
ERLRRTVERVIRHSREAVKRVKDEVEKVVKELEDVVRKVKEDSERVVKEVEEAKR

SEQ ID NO: 20985 - protein, 59 aa, Artificial Sequence
  Synthetic
SEAEDVVRRSKRSVERLKKELDDVVRESKESVERLVRRNDEVVKRSRESVDELTEAVKR

SEQ ID NO: 20986 - protein, 59 aa, Artificial Sequence
  Synthetic
KDLVERVERTVRTTLKELEDALREVKRMVEDTLKKAEDVNRRVAEEVKKSEKRLRDVAK

SEQ ID NO: 20987 - protein, 59 aa, Artificial Sequence
  Synthetic
DEVDDVVRKSEKSVEELVRKLETVVKRSEESVRELLEKNREVVERNERSVRELLERLEK

SEQ ID NO: 20988 - protein, 59 aa, Artificial Sequence
  Synthetic
KDLLKRVEDTARRVNREIEEALDRVRKAVEKTLKKLKDVNDEVRKESEKVLKELRDATK

SEQ ID NO: 20989 - protein, 61 aa, Artificial Sequence
  Synthetic
SDEDRVREMVRTVIEKLDRVLEEVERDSAKTDRDNKKSAEDVRRESKRTDDELKDVVRKAG

SEQ ID NO: 20990 - protein, 56 aa, Artificial Sequence
  Synthetic
VDEVVERAKKLVKRLEDRLREVVKESRRLVRRVVERNREVAERSKDLVRRLVEDTR

SEQ ID NO: 20991 - protein, 60 aa, Artificial Sequence
  Synthetic
SKEEEVERRVEEVIKELEEVLRRVEEEIKRVIDDNRRSARDVEEKSKRTDEELKDVVRKA

SEQ ID NO: 20992 - protein, 56 aa, Artificial Sequence
  Synthetic
VDEVARRVKEMVERLRKLAEEVVREAERVVREVVDENRKVVEESKRLVKELLERVK

SEQ ID NO: 20993 - protein, 60 aa, Artificial Sequence
  Synthetic
SDEERVDEEIKTVIEELKRSLKEVEDTIRKVIKENKDSAKRVKETSEKTDREIEDVVRKA

SEQ ID NO: 20994 - protein, 56 aa, Artificial Sequence
  Synthetic
VDTVAKEVRDLVRENVERNKEVVKRAKKVVDDVVRENRKVAEDSKKLVKEVKDRVR

SEQ ID NO: 20995 - protein, 61 aa, Artificial Sequence
  Synthetic
DDEERVKELIKEVIRELEESLRRVKEDSKRTDEKNKKSMEDVERKIERVRRRLDEVVKEAG

SEQ ID NO: 20996 - protein, 56 aa, Artificial Sequence
  Synthetic
VDEVAKRATDIVKRNAELNKEVVDESRRLVEEVVDRNEKVAKRAEEIVDELERRTR

SEQ ID NO: 20997 - protein, 60 aa, Artificial Sequence
  Synthetic
DEFKEVVDRVKRLVTENVRENRRVVEESERLVKEALKRLEDLVRRAKEIVDRLDDLVRKI

SEQ ID NO: 20998 - protein, 59 aa, Artificial Sequence
  Synthetic
KDLLKRVRDSIETVKKELDDSMKKVSDDDERSKKELEDVLEEVRKRIEKVMKELRDTSR

SEQ ID NO: 20999 - protein, 60 aa, Artificial Sequence
  Synthetic
DEVREIVREVKRLVEENVRRNDDVARKSRKLVKENKDRNKEVVDRLRELVKRALDEVRRI

SEQ ID NO: 21000 - protein, 59 aa, Artificial Sequence
  Synthetic
EKLLKEVEDMIRTVKKELKDSARRVSEEDKRSKEDLKRSAKEVEETIKDVLRKLDTETT

SEQ ID NO: 21001 - protein, 60 aa, Artificial Sequence
  Synthetic
DEAEEVVRRVERLVKENVKLNKEIVKRSRDLVKELEERLREIVKRVEEIVKRAKDLVEEI

SEQ ID NO: 21002 - protein, 59 aa, Artificial Sequence
  Synthetic
KDLLKRVREVIERVDRELDKSMKEVHDENEKSVRRLREVLERVKKRIKDVTKELEDRTR

SEQ ID NO: 21003 - protein, 60 aa, Artificial Sequence
  Synthetic
SLVEEVVRRVEDLVRKNVRLNEEIVRRSEDLVRRNVELNEELVRRAEDLVRRIEELVKKI

SEQ ID NO: 21004 - protein, 59 aa, Artificial Sequence
  Synthetic
EELLRKVEKMIERVVRELKKSAKRVHDENRRSDEDAERSMERVERVIERVERDIDRRLR

SEQ ID NO: 21005 - protein, 60 aa, Artificial Sequence
  Synthetic
DEAREVVTEVKRLVRENEERNKEVVKRSKKLVEDLKDLARKLVDRAKKLVDTLRDLVRKI

SEQ ID NO: 21006 - protein, 59 aa, Artificial Sequence
  Synthetic
ERLLEDVERKIETVIRELRKSMEEVKESSRRSNEELKKVADDVERTIRKVERELEKEST

SEQ ID NO: 21007 - protein, 60 aa, Artificial Sequence
  Synthetic
SDAERVVDDLERRVRENLEDLRRAVREVREVVKKNLETITRVLEEVERVVDRLSKLVKEG

SEQ ID NO: 21008 - protein, 55 aa, Artificial Sequence
  Synthetic
REVDKVLKDVARKVEEANEKSRRVLEEVEELVERVNRELHETLKRVAERVKRDAT

SEQ ID NO: 21009 - protein, 60 aa, Artificial Sequence
  Synthetic
SDEERVTKVLEEVKERIERANRTLEKRVREVTDRVREVNERSDKVNRDSERKIREIIKRL

SEQ ID NO: 21010 - protein, 55 aa, Artificial Sequence
  Synthetic
EKLVRDLRKIVEENERKNRDLLRKIEKIVEEIERRNRDVVRRSKESVERLREEVR

SEQ ID NO: 21011 - protein, 60 aa, Artificial Sequence
  Synthetic
DADRELRRVAKEVTDRSRRVLEDSERVVRESHEKSKRVLEDLRRVVKEVAERIDEVLKRV

SEQ ID NO: 21012 - protein, 59 aa, Artificial Sequence
  Synthetic
EEVARDVVRKLKRIVTENLKKNTKVVRDSEDLVRRDLEEVDRVVKKVKKDVDEIERDVK

SEQ ID NO: 21013 - protein, 59 aa, Artificial Sequence
  Synthetic
DEVREVVKELKRIVDELLDELRKVVEELEKIVTDDLRRIEEAVKRSKDSVEDLERRLKS

SEQ ID NO: 21014 - protein, 59 aa, Artificial Sequence
  Synthetic
KDLLRELEEVARRVEEKIKKAVRELEKVMREVNRKSTEVLKRLEKVVRDSEKRIDDATR

SEQ ID NO: 21015 - protein, 59 aa, Artificial Sequence
  Synthetic
SDVDEVVKEVKAIADDSTRLNKESAEKSRELVDRDTKKNKRSVEELRRLVTEILKVVES

SEQ ID NO: 21016 - protein, 59 aa, Artificial Sequence
  Synthetic
DELLRKLEEVVEKVRRDDERSHRESERVSRESTKRSRDSHRESREVVTEVKKEVDRAAK

SEQ ID NO: 21017 - protein, 60 aa, Artificial Sequence
  Synthetic
DEAEEVVDRARKLVKESEDLNRRSVEESEKLVTTSTELNKRTVDRLREIVEEVKDLVRKT

SEQ ID NO: 21018 - protein, 59 aa, Artificial Sequence
  Synthetic
EDVLRKVKKTLEEVKRRDDEAMRRSHKKDDDSRKRDEESMRRSDEVVREVIEEVREAER

SEQ ID NO: 21019 - protein, 59 aa, Artificial Sequence
  Synthetic
DEIEDVVRKVEEMVKESKDRVDRNVEESRRIVTESREKVKDSVRRVEEVVKEIKKLAEQ

SEQ ID NO: 21020 - protein, 59 aa, Artificial Sequence
  Synthetic
DKVVKKVDDALKRVEKKDRDAIREVERVNREVEKDDERVLRDSERVLEEVRKRVEEVTT

SEQ ID NO: 21021 - protein, 59 aa, Artificial Sequence
  Synthetic
SEIDEVVERVRKAVEDSRKVVEDLIKTVEDAVREHERLVRRVVEEVDKLVEDIRKLLER

SEQ ID NO: 21022 - protein, 59 aa, Artificial Sequence
  Synthetic
ERMLRKVDEVIKRVAREDERVVKKLEDVLRDVKRRVDEASKEVDRRLKEVKKRVEKEAE

SEQ ID NO: 21023 - protein, 59 aa, Artificial Sequence
  Synthetic
KEAEEAAKRAEEAAKRHEDLAREAAKEAKRAADESRKAAEEAAKRAEKAARDIADLARK

SEQ ID NO: 21024 - protein, 59 aa, Artificial Sequence
  Synthetic
EKAARKAEDALRRAREIAKKASEDAKRALDEARKADEDAARKAEKALKEAEDAAREARR

SEQ ID NO: 21025 - protein, 63 aa, Artificial Sequence
  Synthetic
DEEEELKEVVREVAERVEEVNRKSERELDKARKDSERALEKLERVLREVAERVKRVLDEASKR

SEQ ID NO: 21026 - protein, 56 aa, Artificial Sequence
  Synthetic
VKDVIRELEEVVRRNTDLVRKVEEEIRKVVEESKRSIEEVIKRLRKLVDDIRKAIK

SEQ ID NO: 21027 - protein, 63 aa, Artificial Sequence
  Synthetic
DEREKLAEVVKRVAEDVKRMNKESREALKRVKEEVKRVNEKSEKVTREVKKEVERVIEEAKRT

SEQ ID NO: 21028 - protein, 56 aa, Artificial Sequence
  Synthetic
VEDVIRELEKVVEDNKRLVEKVVRDARKVVEDNKELVDRNVKRLEEVVREITKEIK

SEQ ID NO: 21029 - protein, 60 aa, Artificial Sequence
  Synthetic
RDVDELVRELRDVVRKVLETARDSVRELKRIVTESLRRAEDLVKEITDVVREVLDAVRRA

SEQ ID NO: 21030 - protein, 59 aa, Artificial Sequence
  Synthetic
REVVKKLRDVIREVKEDVERVLKEVRDVNREVNKIDKEAVERIRRVLDEVRKRVDEAAR

SEQ ID NO: 21031 - protein, 59 aa, Artificial Sequence
  Synthetic
KEIDDVVRELKEIAKRDEDKVRRVVEDLERVAREDLRKVREVVKELRRVVKTLLDLVRR

SEQ ID NO: 21032 - protein, 55 aa, Artificial Sequence
  Synthetic
KRLDDVLREVADIIRRSIRDLERVLEEVKRIIETSNDELRKVLKEVRETITEAER

SEQ ID NO: 21033 - protein, 60 aa, Artificial Sequence
  Synthetic
SEIDEMVRKLKEMARRDLETVRRVVERLRKLAEDDLRRVRKVVKKLKELAKDIVRLVEEG

SEQ ID NO: 21034 - protein, 55 aa, Artificial Sequence
  Synthetic
ERLRKVLKEVKDIIRKSNKELDEVLRDVERIIRESIEELRRVLEEVKKIIKEARD

SEQ ID NO: 21035 - protein, 59 aa, Artificial Sequence
  Synthetic
DEVDEAVRRLEEIVTRIEKDVDDVARRSEESAKEVEKAVRKVVEEHKKVAEDIRKLVED

SEQ ID NO: 21036 - protein, 59 aa, Artificial Sequence
  Synthetic
REVKERLKKVLDKVRKRIKRVVERLEEAARKSRKIIRDAKEELERVSREVEKVIRDVRR

SEQ ID NO: 21037 - protein, 60 aa, Artificial Sequence
  Synthetic
EEVKELVERLRDLVRESEKRVDEVVKRLEDLVRRNEELNRELVTRLRDLVRKLEEKVKDT

SEQ ID NO: 21038 - protein, 59 aa, Artificial Sequence
  Synthetic
KEMVREIKRVVDEVRKRDKEALDRLKKVIEEVRRKVKRSEDEARRVVEEVKRIVDRVET

SEQ ID NO: 21039 - protein, 60 aa, Artificial Sequence
  Synthetic
REVDDLVRRLEELVRRNEKKNEDVVRESKELADRSRKLVKELVKRLRELVKTVVRLVEET

SEQ ID NO: 21040 - protein, 59 aa, Artificial Sequence
  Synthetic
KELVRKLKKVVDEVRERIDRSTEEVRRVSKESKDIDKRAKEEIEEVLRDVEKKLRETAT

SEQ ID NO: 21041 - protein, 60 aa, Artificial Sequence
  Synthetic
DEFRDVVRKLEKLVEDITREAEEVVKISKALAEENKRLNDELVDRLRRLVEEVRKKVEDT

SEQ ID NO: 21042 - protein, 59 aa, Artificial Sequence
  Synthetic
KEVVKRVKDVVDRVRDEVRRVAEKVDRVSKESKRIIDESTKRAREVLERVRKRVEDERK

SEQ ID NO: 21043 - protein, 60 aa, Artificial Sequence
  Synthetic
SEVDDIARKLRDLVRRNKELNDEVVRRSEKLVKENKELNEELVRRLKELVDRLEDEVRRT

SEQ ID NO: 21044 - protein, 59 aa, Artificial Sequence
  Synthetic
KEMVKKLRKVVEEVRREIDDSMRKVKKVSEDSKRRIERSTEEIEEVAKRVADKVTDVER

SEQ ID NO: 21045 - protein, 60 aa, Artificial Sequence
  Synthetic
RELEEVVRELRKLVTEDLDRVRKSVEESERVVREDERRVDESVKRTREIADEVRRLKEEG

SEQ ID NO: 21046 - protein, 55 aa, Artificial Sequence
  Synthetic
EELKKVLKEVRKVVTDSERRDKEANRKVEEVIRRSKKKDEDAHREVRKVVEDVRT

SEQ ID NO: 21047 - protein, 60 aa, Artificial Sequence
  Synthetic
SKDEKLEKVIREVKRVIERVSKESEDVLRKVRKVIEDVSRESRRVLEDSRRVLERVAREG

SEQ ID NO: 21048 - protein, 56 aa, Artificial Sequence
  Synthetic
VDEVVDRARRIVDDVDRLNREVVKRLKDLVEDLRRLNEEVVRRNKELADTVRKDVR

SEQ ID NO: 21049 - protein, 60 aa, Artificial Sequence
  Synthetic
SEDEKLKEVVDEARKILEDADRELKRVVKEVEDVIRDVSKKSTEVRKEVKEILKEAADKG

SEQ ID NO: 21050 - protein, 56 aa, Artificial Sequence
  Synthetic
VDKVVDDLRKLAEDLLRENKEVVDKLRELVERVKKLNEDVVREARRLADEVLKRVT

SEQ ID NO: 21051 - protein, 60 aa, Artificial Sequence
  Synthetic
SEVERLEERLKRIVEDIKRLVKKSVEDSRKIVEEIRKLVKDSVEKNKRSVEEVEDIVRKD

SEQ ID NO: 21052 - protein, 55 aa, Artificial Sequence
  Synthetic
ERVKRVLREVEERVKEVKKENEKAHEEVRKDVERVLEDDDRALRESRERAERVKK

SEQ ID NO: 21053 - protein, 60 aa, Artificial Sequence
  Synthetic
TEVDELLDSLRKIVTEIEKLVEESEKRLREIVKTIEKLVKDSVRTLKKIAREIEELAKDR

SEQ ID NO: 21054 - protein, 55 aa, Artificial Sequence
  Synthetic
ERVEKVLREVRDRVKKVNKRNEDALREVDKKVKDVNKENEDVLEEARRVVEEVRR

SEQ ID NO: 21055 - protein, 60 aa, Artificial Sequence
  Synthetic
REDEKIKKVVEEVRKKLEDVDKNSRDAIEDDKRVNKEVDRNSERAFKENEDEIRKVKEAG

SEQ ID NO: 21056 - protein, 56 aa, Artificial Sequence
  Synthetic
ADEVVKELERIVAEVEKLSREVVKRLKENVKRVRDLSKRVVEYLKEDADRLKEDVR

SEQ ID NO: 21057 - protein, 59 aa, Artificial Sequence
  Synthetic
DEERKIRKAVEDVRRVIKEVEENSKRVFDENKKVIDDVRKEVEKVLKENRDVIKEVRDK

SEQ ID NO: 21058 - protein, 56 aa, Artificial Sequence
  Synthetic
ADEVLKELKKLVEELEKLSREVVKYLREDAKRLKDLVRKVVEYLKEDARRLDEEVR

SEQ ID NO: 21059 - protein, 57 aa, Artificial Sequence
  Synthetic
SVVEKLLEDARRVVEKVREAVERNLKKVRDLVKKLREDVKRSKDHLEEVVRKLEEAK

SEQ ID NO: 21060 - protein, 59 aa, Artificial Sequence
  Synthetic
EEVERRVEEVIRDLERVLREVRERVRRINEESRRMLEDVERESRKALRDLEEVLDRVRR

SEQ ID NO: 21061 - protein, 58 aa, Artificial Sequence
  Synthetic
SVVEELRKRVEDVVDEVREVVERNRDLMRRVAEESKKIVDDSLRHIKEVVDEVRRAKN

SEQ ID NO: 21062 - protein, 59 aa, Artificial Sequence
  Synthetic
ERVKKRVRDVLRKLREVLERVAEEVKKVNKRSREVNKRVEEKSEEVLRDLERVLREVET

SEQ ID NO: 21063 - protein, 59 aa, Artificial Sequence
  Synthetic
SEVEEVVERLRRKAEEDLRRVEEAVKEHRRVVKEDLDRVRDAVERHREVVETIRKLKED

SEQ ID NO: 21064 - protein, 55 aa, Artificial Sequence
  Synthetic
EKLKRVLKEVEEVVRESKERLREVHEEVRKVIEDSKRILKTVHDDVRRVIEEVKK

SEQ ID NO: 21065 - protein, 59 aa, Artificial Sequence
  Synthetic
DDVERVLKELDELLKRDETEVREVEKRHREVLETIERRVREVIERHKEMLRRLAELVRS

SEQ ID NO: 21066 - protein, 55 aa, Artificial Sequence
  Synthetic
EELKKVRDKVRRVIEESKRRLEELHEEIRRLITELKRRLEEVTEEIKRAIDELRR

SEQ ID NO: 21067 - protein, 59 aa, Artificial Sequence
  Synthetic
DEVEDVVRRLRKIVEDIRRDVERVVEEHDRVVRKLKRRVEEAVEEHRKVLEEIKKVKEN

SEQ ID NO: 21068 - protein, 55 aa, Artificial Sequence
  Synthetic
EDLKRVLKEVEDVVREVDKILTDATERVKRVITEVKDILRRVHEEVREVIKRVKE

SEQ ID NO: 21069 - protein, 59 aa, Artificial Sequence
  Synthetic
DEVEEVVRELREILKRDLDEVRKAVEDHERLLREITKDVKRVADRHRDLLRKIRELKEN

SEQ ID NO: 21070 - protein, 55 aa, Artificial Sequence
  Synthetic
EKLKRVLKELEDVIRESEEILERVTRKAERVIERVRKILEEATKEVERVIREVRR

SEQ ID NO: 21071 - protein, 55 aa, Artificial Sequence
  Synthetic
EEDERIEKVTEEVKKVIEDVTRLTETVMRESEKVIEDVTRDSDRVRKEVKKVLEK

SEQ ID NO: 21072 - protein, 56 aa, Artificial Sequence
  Synthetic
VDEVVKRLKELVTRLAEENKRAVDTNRKLAEDLKELNRKAVEELKELLRRVDERDR

SEQ ID NO: 21073 - protein, 56 aa, Artificial Sequence
  Synthetic
SEDEEIDRVDKDVKRVSDTSNKILDDVEKEVDKVIREVTAESKKVLDEAKKVLDKV

SEQ ID NO: 21074 - protein, 56 aa, Artificial Sequence
  Synthetic
VEEVVRRLEKLVDDDRKLVEKVVKELRELLKELRDKNKEVVDELRRLAKTVDEEDR

SEQ ID NO: 21075 - protein, 60 aa, Artificial Sequence
  Synthetic
SAEEIAERVLRELRKVTKEVAEEDERVLREDEKVTDEVRKEDKRVLDEARKVIDDVRKKG

SEQ ID NO: 21076 - protein, 55 aa, Artificial Sequence
  Synthetic
EEVVKRVRENVKRTRELSKRSVEKNEENVRRTREMSKRTVKEIRDVVKELRDRVK

SEQ ID NO: 21077 - protein, 59 aa, Artificial Sequence
  Synthetic
SKREKAEEVLKEAKKVIDDVREKDRRALEEDKRVTDEVARIAEKVLKDLRDVIEEVRER

SEQ ID NO: 21078 - protein, 55 aa, Artificial Sequence
  Synthetic
EEVVRRVRKVVTELEELSRRSVEENRRNAEETERLIREIVERARRVVETLKETVR

SEQ ID NO: 21079 - protein, 59 aa, Artificial Sequence
  Synthetic
SVEDILRKVAKEAEDVAREVTRILEEANRRVEEVVKRVKEENERANEKVERVVREVKAR

SEQ ID NO: 21080 - protein, 59 aa, Artificial Sequence
  Synthetic
EEVVRRVVETVKDIVKRLRDIVREVLKKNERIVEELKKTSDESKKRNDDIVRELDERAR

SEQ ID NO: 21081 - protein, 59 aa, Artificial Sequence
  Synthetic
SVEEILEEVLRRAEKIVKEVKDLDRRALEENKKAIKEVADELRKVDEEVKKVVDEVRRE

SEQ ID NO: 21082 - protein, 59 aa, Artificial Sequence
  Synthetic
EDVVRKVVRDVEDIVRRMREEVRRSVEDLKRNADENRDEVRKVVKENKDIVREMRERVR

SEQ ID NO: 21083 - protein, 59 aa, Artificial Sequence
  Synthetic
REKEKLEKAVRDARRVIERVERKDREALKEVERVVRESHKTLEDVLREIRKVATEVRRE

SEQ ID NO: 21084 - protein, 56 aa, Artificial Sequence
  Synthetic
VDKLMKTIEDLLRRVEELVDRSVKELKRLLDENRKLVKRVLEEIRRILKELRDEVK

SEQ ID NO: 21085 - protein, 59 aa, Artificial Sequence
  Synthetic
DEEEKLRKVKKEADDVIRRSHEEDERVLREVEKVVRESHEELKRVADEIRRVVEEVKTR

SEQ ID NO: 21086 - protein, 56 aa, Artificial Sequence
  Synthetic
VDKVMETIRRLVTKNRELVKRSVDELRDLVDKNRKLVERVVERIEEIAKKARDDVK

SEQ ID NO: 21087 - protein, 60 aa, Artificial Sequence
  Synthetic
KVVEEIEKEVRRSVEELERLVTEDLRKVKEVVKRAEEVAEEDERKVDEVVKELKRAAKEG

SEQ ID NO: 21088 - protein, 59 aa, Artificial Sequence
  Synthetic
EEMERRVREVLKRNEDVTDEVKKKIEESNRDLEDALRKVEKKIRESNERLRRVLEEVRK

SEQ ID NO: 21089 - protein, 60 aa, Artificial Sequence
  Synthetic
KEVEDVLDDVRRVVEKLEREVKKVEDTNERVVETLDEIVKEIRDRNRKVVETLKEIMKSN

SEQ ID NO: 21090 - protein, 55 aa, Artificial Sequence
  Synthetic
DKLRKAEKDLRDVAKEVRDKIRRADERLKRVIERVADEIRKVNTDLKRVADEVRK

SEQ ID NO: 21091 - protein, 60 aa, Artificial Sequence
  Synthetic
SEVEDVEREIEEVVEELRKIAEDDLRRNDTVVKEVRELVKRDREKNRKSAEELKKLKEEG

SEQ ID NO: 21092 - protein, 55 aa, Artificial Sequence
  Synthetic
EELKRVMEKITRVVEKVKEDVDRSKKKAEEVIREVEERLKRSLDESRKVLEEVKK

SEQ ID NO: 21093 - protein, 59 aa, Artificial Sequence
  Synthetic
REVEEVKKRVDEVVKRLRKLAEDDDRKNKESADRLRAIVDRDKKENTRSMETLRRLRER

SEQ ID NO: 21094 - protein, 55 aa, Artificial Sequence
  Synthetic
ERLEDAKKKLEDVIDEVRRRLEESNKRSRDVMEEVRKEVRRSLRESEEVVKDVEK

SEQ ID NO: 21095 - protein, 60 aa, Artificial Sequence
  Synthetic
DEVREIKRLVDELVKRLKELAERSRRLVDEVAKRSKELAKENLDLNEDIVRRLDEVAKRG

SEQ ID NO: 21096 - protein, 55 aa, Artificial Sequence
  Synthetic
KELKDVAREIERVLKEVEEEDDDALRKIEEVSKRSKEIIDESMEKVKKVMEDVTR

SEQ ID NO: 21097 - protein, 59 aa, Artificial Sequence
  Synthetic
SEVETVKKLIEDIVRESRRLVRENEELNKDVIRRSEELVRRSKEAVKRLVDKLDELRKR

SEQ ID NO: 21098 - protein, 55 aa, Artificial Sequence
  Synthetic
RELERAVEEIERVSRDSKREIKRSTEEVRKASERSRKEDEELERRARRVVEEVKR

SEQ ID NO: 21099 - protein, 59 aa, Artificial Sequence
  Synthetic
SELEKVVEEVEEIVRRSERHVTEVVKTSKKSVEDSNRHVAKVVEDVKKKVTELIEAARE

SEQ ID NO: 21100 - protein, 55 aa, Artificial Sequence
  Synthetic
KVLERVKRELKKAADRSRDIIRRVARETEEALRTSREIAKRVEDELRRVLEEVRK

SEQ ID NO: 21101 - protein, 59 aa, Artificial Sequence
  Synthetic
KELEDVVKRVREEVRRSLEHVAKAVKESEDSVRELKEEVDRVVKESEDIVRELEKLKRE

SEQ ID NO: 21102 - protein, 55 aa, Artificial Sequence
  Synthetic
KRLKEVDKELKRALEESRKIIKKVKEETKDVLRRVRDILRRSVRTSEKVLKEVKD

SEQ ID NO: 21103 - protein, 59 aa, Artificial Sequence
  Synthetic
SKVERVVEESRENAKRDLDRVDKVVKDSRRSVEEDLKEVRDVVKEVDDMLREAEELMRR

SEQ ID NO: 21104 - protein, 56 aa, Artificial Sequence
  Synthetic
EKVIREVAKESEDAFRESERRLREVLKRSAEALKRSRDILKTVRERVKRVIDEVRR

SEQ ID NO: 21105 - protein, 60 aa, Artificial Sequence
  Synthetic
REVEEVVKRSEKSVKEMEDKSRETVKKSRKSAKEDIDKVEEVVRRVEKVLREAKKLADDG

SEQ ID NO: 21106 - protein, 56 aa, Artificial Sequence
  Synthetic
KDVIEEVRKKSDEVLKRVRKINKEVTEESERAFDESRRILETVAREVKRVIDEVRR

SEQ ID NO: 21107 - protein, 59 aa, Artificial Sequence
  Synthetic
DAVEREVRKAEKIVEDDLRRVAKVVDESRKSVEKNEEDVRRVVEELRKILEEIDRLKRN

SEQ ID NO: 21108 - protein, 56 aa, Artificial Sequence
  Synthetic
ERVLRRVKKKLEDAVEDSRRILTELAEEVKTVVERSKRILDTVRDELKKALERVKK

SEQ ID NO: 21109 - protein, 60 aa, Artificial Sequence
  Synthetic
DEVDEVVEKLRRLLEDTIRLVREAVDYLRRNLEDLRRKIREIVERLKRLLEELRKLVKDT

SEQ ID NO: 21110 - protein, 56 aa, Artificial Sequence
  Synthetic
EKRVRDAADEVRRMNEEVKKIIDDARKELERVHRDVKREIDRVARELDEEIRRVEK

SEQ ID NO: 21111 - protein, 60 aa, Artificial Sequence
  Synthetic
DEVREMVKTLTDLLRRNRELVKRVVEELRKLLEETRKLVEDMVKELEDLLRELEKLARDT

SEQ ID NO: 21112 - protein, 56 aa, Artificial Sequence
  Synthetic
EKVVEEVARKVARANEDSNRILDEARKEVEKVNEEVRRIIKEVTDRLEKKVREVEK

SEQ ID NO: 21113 - protein, 59 aa, Artificial Sequence
  Synthetic
SKAERLDEEVDKIVRDLRRLVDELEKRIEKIVRDNRELVKRVRESNKRIVETLRRLKEN

SEQ ID NO: 21114 - protein, 56 aa, Artificial Sequence
  Synthetic
KREVDKIEKKLRDVVREVEEIVTRVDKRLKDVLKESREILKEVNDETKKVLDEVKT

SEQ ID NO: 21115 - protein, 59 aa, Artificial Sequence
  Synthetic
SEAEKVVRDVREIVERLRDIVRKVVEENEEIVKRLRKLVTDLVEENKRTVEALRDLKRR

SEQ ID NO: 21116 - protein, 56 aa, Artificial Sequence
  Synthetic
EEILRRVEEEARRAAKEVEERIRTVNRRTEKVLEEVRKIVKDATDTSEKALREVRE

SEQ ID NO: 21117 - protein, 59 aa, Artificial Sequence
  Synthetic
SRVEEVLRKVEEIVKRNEDLARKVVDESRKTVDKLRTLVEKVLRESRETVKRLIDLVRR

SEQ ID NO: 21118 - protein, 56 aa, Artificial Sequence
  Synthetic
EDLLTRVTDVLRKLRDRSREIIKRVVDETRRVLEEVKELIKRVLEETERVLREVRR

SEQ ID NO: 21119 - protein, 59 aa, Artificial Sequence
  Synthetic
SEVDEVVDRSRKTVKKMIDDVREVLERSRKNVKEDIERVRKVVRESEETVKTARRLKEE

SEQ ID NO: 21120 - protein, 56 aa, Artificial Sequence
  Synthetic
EEVLRRVREVTERATREVEELLKRSDEESERALKTSTDVLREVLERSDKVEEEVKT

SEQ ID NO: 21121 - protein, 60 aa, Artificial Sequence
  Synthetic
KEVEEAVRRVEESVRRLEEEVDRVVKENRKLVKDLIELAEEVVRRVKELVDRLRETVRRA

SEQ ID NO: 21122 - protein, 56 aa, Artificial Sequence
  Synthetic
KDVVTEVKKRAEDVDRRVERVIEEAEEVSREALKRVRDIIDTVRKVAETVLKEVKD

SEQ ID NO: 21123 - protein, 59 aa, Artificial Sequence
  Synthetic
KEKEVMDEVERVLEKVKEDNRRVVREVEDVLRRVEKENKEIVDEVKDVARKVLEEVRRR

SEQ ID NO: 21124 - protein, 55 aa, Artificial Sequence
  Synthetic
ERVLEKVKDVVRRSRDIVRRILEDAKDVVRKSREIAKKILEEVTEVVKRAREKVK

SEQ ID NO: 21125 - protein, 60 aa, Artificial Sequence
  Synthetic
SKLEELLKRSEKSVREAKRLVEELKRRSEETVRRNKELAERLEDESRKTVELLKRIVDSN

SEQ ID NO: 21126 - protein, 55 aa, Artificial Sequence
  Synthetic
KLLEEVEKESRKVVEDVRRVIEDVKRRSDEALKESEDIIRDVRRKSEKALRDVEK

SEQ ID NO: 21127 - protein, 60 aa, Artificial Sequence
  Synthetic
SELEDLLRRSKESVDRLRELIRRLEDESRKTVETLRDIVKKLKEENKKTVDDLRDIVRRR

SEQ ID NO: 21128 - protein, 55 aa, Artificial Sequence
  Synthetic
ELLERVREVSDKVLEELKKIIDEIRKRSEKVAEEVKDVIRKVNELSKKVLKDVKK

SEQ ID NO: 21129 - protein, 60 aa, Artificial Sequence
  Synthetic
RKLEELLKRSERSVEELRRKVTRLLEENDDTVRRLRELVTKLTDDSRKTVTRLRDIVRKD

SEQ ID NO: 21130 - protein, 55 aa, Artificial Sequence
  Synthetic
KLLEEVTKVSEKVAEEVRRVIKTVNDKSTEVLREVKRVIETVRRESEDVLEKVEK

SEQ ID NO: 21131 - protein, 60 aa, Artificial Sequence
  Synthetic
SKLEDLLRRVTEIVKRLEEIVRKLEERSRRTVKRLEELVDTLRKENEDTVRRLEKIVRDR

SEQ ID NO: 21132 - protein, 55 aa, Artificial Sequence
  Synthetic
ELLKEVRDVLETVVKRVREIIEKVRKESEDALRKVDKDIREVNRRSEKALEDVKT

SEQ ID NO: 21133 - protein, 59 aa, Artificial Sequence
  Synthetic
SEAEKIEREVDKVVEDHRRLVRADLERVERVVEEHRRLVKEDLDRVDEVVKRLRKLKED

SEQ ID NO: 21134 - protein, 56 aa, Artificial Sequence
  Synthetic
EDVLRRVRELLKTVHEEVKKVIKTSDDILRTVHDEVRKVIKTSEKILREVAEEVER

SEQ ID NO: 21135 - protein, 59 aa, Artificial Sequence
  Synthetic
KELEDATREVETVADEHRRVLEEDKRDVKEVVERHRRLLEDLRRKLEKVVRDLRKLLKD

SEQ ID NO: 21136 - protein, 56 aa, Artificial Sequence
  Synthetic
EDVLRRIEKKLKDVTDDLRRVIKESKDRLTKLHKEVEDALRRLRDRLRELEDEIRR

SEQ ID NO: 21137 - protein, 61 aa, Artificial Sequence
  Synthetic
RELEEAVKEVEKKIRELRERLKEVVERSTKKMDDLRKENEKVMRESSELVTELVKEIKDRA

SEQ ID NO: 21138 - protein, 56 aa, Artificial Sequence
  Synthetic
LKDLRKKVDDVARKVDKILEDLERESDTVLDRVKKVLERSRRDSEDVARRVEEKVR

SEQ ID NO: 21139 - protein, 60 aa, Artificial Sequence
  Synthetic
SELDELRKMVKEVLDRVRDLLKKLEDEARKVAEDNKRLLERNKREIEAALRRVEEIIRRR

SEQ ID NO: 21140 - protein, 58 aa, Artificial Sequence
  Synthetic
KRVREVLREVEKRIKELEDLVRKVLDKIRELIERLKRETDKVLEESKKLIKELSERLE

SEQ ID NO: 21141 - protein, 59 aa, Artificial Sequence
  Synthetic
DELEDVRKEIEDVRKENEDTVRESKDEIRRLEDTNRKTLKESRDDIEKARERVKKERRD

SEQ ID NO: 21142 - protein, 59 aa, Artificial Sequence
  Synthetic
EKDVRKVLKEVEEEARELVKLNRDVLEELRRRVRKLVEDNKDVTREVEDILKKLEEELK

SEQ ID NO: 21143 - protein, 57 aa, Artificial Sequence
  Synthetic
SMDETIRKLAEDNRRRSDETVERIERLAKKLDEDNRRVVEKSERLAKEVADKVRRVK

SEQ ID NO: 21144 - protein, 55 aa, Artificial Sequence
  Synthetic
ERVIKEVEDISRDLERKNKEVVERARRIVEKVKETNKRVLEEVEKIVRKLKEELK

SEQ ID NO: 21145 - protein, 60 aa, Artificial Sequence
  Synthetic
SVEEVVEEVRRVAEKVEEDVTRVIKEDEDIARELEKRIDDVIKESKTVADELLERLRRAG

SEQ ID NO: 21146 - protein, 59 aa, Artificial Sequence
  Synthetic
EEELERLLREVEELIERVKERHKRLVEDSKRLLDEVDKRLKDSNREVRERIEEIKRRVD

SEQ ID NO: 21147 - protein, 56 aa, Artificial Sequence
  Synthetic
DELEKIREEVREIVERSKREAKELLDRNKEIVKDLERKAREILRENRDRVRRLAEK

SEQ ID NO: 21148 - protein, 56 aa, Artificial Sequence
  Synthetic
SEVLDELRRIIETSEKLNRDVLRESKEVNRDLTRKLEEVLRRSKEDNKRLSEKIKE

SEQ ID NO: 21149 - protein, 56 aa, Artificial Sequence
  Synthetic
DELEAIKDEVRRIVRESEERAKKILRDVERMLDEIRKKLKEILDRNREVVDELKRQ

SEQ ID NO: 21150 - protein, 56 aa, Artificial Sequence
  Synthetic
SEVLKELRRIIEESKRRNKRVLDEIRKRAEDLRRVIKEVLDRSREINKRLSDEIRK

SEQ ID NO: 21151 - protein, 56 aa, Artificial Sequence
  Synthetic
DELEKIVREVREIVKESKEEARRILEENKKIVEELRRRLRKILEENEDMVRKLEKK

SEQ ID NO: 21152 - protein, 56 aa, Artificial Sequence
  Synthetic
SRVLEELERIIRESEEANKKVLEDSRRVNKKLSEELKRVLDESRRRNEELSKRIKD

SEQ ID NO: 21153 - protein, 60 aa, Artificial Sequence
  Synthetic
DELRDLEREIRRIVEESERHLKEVLERNHEASKRNRDDLKRMVDDIRRKVEEVRKLREEG

SEQ ID NO: 21154 - protein, 60 aa, Artificial Sequence
  Synthetic
AETVDRVLEKLKRIVEDSERRVKEVLKELEENSKRIKDETKDVLRKVEEIVERLRKEIER

SEQ ID NO: 21155 - protein, 60 aa, Artificial Sequence
  Synthetic
DELEELKEEVKRAVDENRETNKRALDRNHEISKDSEDHLRESSERIRRRIEELARLVEAG

SEQ ID NO: 21156 - protein, 60 aa, Artificial Sequence
  Synthetic
RETVKKVLKELREEIERVKRESEKVVKAVRDNSKRSEEKVEEVLERNKRIVDDVLRKIKK

SEQ ID NO: 21157 - protein, 60 aa, Artificial Sequence
  Synthetic
DELKEAEDRVREVVRENEERLRKALEENHKISRDSEKHLRDLERTIKEIVKRVRDLRRRG

SEQ ID NO: 21158 - protein, 60 aa, Artificial Sequence
  Synthetic
KDTVEKVLRDLRRIIKEVKERSREVLKRVRENSDRSLKKVEEVLKRLEDIIRTVKEEIKK

SEQ ID NO: 21159 - protein, 60 aa, Artificial Sequence
  Synthetic
EDAERALKKIEEIVRRLTEELKRVLDANRESVDRLRRELEEVLKRNRELVRKLEKILEER

SEQ ID NO: 21160 - protein, 56 aa, Artificial Sequence
  Synthetic
REVVERLKKIIADLDRVVEEVIRTSRKVIKELEDTVRRVIEELKRVSDELKKKVED

SEQ ID NO: 21161 - protein, 59 aa, Artificial Sequence
  Synthetic
DKLEELLKRVEELVERLKEESERVLRRNHELSEKLRRILEEILKRNHDLSRDLEDRLRK

SEQ ID NO: 21162 - protein, 56 aa, Artificial Sequence
  Synthetic
DEVVKRVEDIIEKVREDLERSDEKLNDNVRRLEREVREVLKAVEDNARRLAEKTKT

SEQ ID NO: 21163 - protein, 59 aa, Artificial Sequence
  Synthetic
SEAEKLLEEVKDLVRRLKKDLERVLRDNHRLSEELRRRLREILEENKKLIDTLREIREK

SEQ ID NO: 21164 - protein, 56 aa, Artificial Sequence
  Synthetic
KEVAEKMRKIVEELRKEVEEVLKALKENLDRLRREVEKVVERIEDTLRELKKRATD

SEQ ID NO: 21165 - protein, 60 aa, Artificial Sequence
  Synthetic
SEAEKVLEEVKRLVEDIERKLREMLRRDNEISRKVRDDLRKILEENNELSRRVEEEIRRI

SEQ ID NO: 21166 - protein, 56 aa, Artificial Sequence
  Synthetic
EEVVEALEKVVRDVARRLEDVIRRVAENAKRLEDDLRKVEEELKENADRLEERAKK

SEQ ID NO: 21167 - protein, 59 aa, Artificial Sequence
  Synthetic
SEVEKLLEKLRELVERVEREARRILEENKELIKESLKRIRDLLEDNKRLIREVKEILRR

SEQ ID NO: 21168 - protein, 56 aa, Artificial Sequence
  Synthetic
KDVVKRIRDIAEKVRRDLKRVIDAVRDTSRESDRRLRDVIREVDESSRELVREIER

SEQ ID NO: 21169 - protein, 59 aa, Artificial Sequence
  Synthetic
SDMERLLRELEELVKELRERLRRLLEENKDLIRRSLDRARKLVRRIEELVRKVKEDLDR

SEQ ID NO: 21170 - protein, 56 aa, Artificial Sequence
  Synthetic
EDVLRKIEETARRLVKEIEDVIREVERTSRESDKKLEDVIDKLRKIVRKVLEELRT

SEQ ID NO: 21171 - protein, 59 aa, Artificial Sequence
  Synthetic
SEVEDLVRELERLVREAKKALDDLRRKLEELVRDSLRKAEELLKENHDLSREVKKLLED

SEQ ID NO: 21172 - protein, 56 aa, Artificial Sequence
  Synthetic
KKVADELRRIAKRLVEELERVIRELEKIAKESDERLKEVIDRLRENVERLVRELRR

SEQ ID NO: 21173 - protein, 60 aa, Artificial Sequence
  Synthetic
KELEDLDRDVRRVVEELREELRRLEEEDKRSVEENEERLERLERRLRKKVKELEEKRKRI

SEQ ID NO: 21174 - protein, 60 aa, Artificial Sequence
  Synthetic
REEVRRVLEELREKIKRVLEEIEEVLRRSREINKRLRDRTRTVAKRLKEIVDDVLRKVET

SEQ ID NO: 21175 - protein, 60 aa, Artificial Sequence
  Synthetic
RELEELLKEVEKAVRENTKLLKDLLDKDKKSVKENEETLRDLERKLREVVERLKRELKDI

SEQ ID NO: 21176 - protein, 60 aa, Artificial Sequence
  Synthetic
EKRVRDVLKRLREIIDTVKKVTKEVMERSEEINRRLLKRTKDVLRELEKIVKTVLDEVRK

SEQ ID NO: 21177 - protein, 56 aa, Artificial Sequence
  Synthetic
SEVDKVREDVKRLIEDAERVSDDVDRRVKRLAEALKETSDKVKEDVERLVRDIKRE

SEQ ID NO: 21178 - protein, 59 aa, Artificial Sequence
  Synthetic
EETLRRVLRKVEDVIRRNKEDNEKVLKDAKRVVEEDKRENEKALERIERIVRKLKEDTR

SEQ ID NO: 21179 - protein, 56 aa, Artificial Sequence
  Synthetic
SEAEEVVRRVEKLAEDIKRVIDKSLEDVERLVRDAKRRSREVLREVEKLVEDITRR

SEQ ID NO: 21180 - protein, 59 aa, Artificial Sequence
  Synthetic
EEILRRALEKVERVITENKKENEDALRDAKRKIDKDKEDNKKVLDDVRRIIEELKEETR

SEQ ID NO: 21181 - protein, 61 aa, Artificial Sequence
  Synthetic
DEVDRVAEEVKKLIDDVKRVSDEMLKRSEDLIREVKKTSDDVLETVERLIRDVERKVEERV

SEQ ID NO: 21182 - protein, 59 aa, Artificial Sequence
  Synthetic
DEVLKRLLDKIREDAKRNKDDNKRNLDESKKEVDRNKDENRRVLEKVKETVKRLKDEVK

SEQ ID NO: 21183 - protein, 61 aa, Artificial Sequence
  Synthetic
KEVEEMLKEVKKLIEKVKRRSDDVLRRSEELARDLKKMSDDVLREVKKLIDDVKRTVDERV

SEQ ID NO: 21184 - protein, 59 aa, Artificial Sequence
  Synthetic
REFLKEVLDRVRERVEENERRNDENLKKSKKRIDENKEKNERVLRKIREIARRLKEELR

SEQ ID NO: 21185 - protein, 61 aa, Artificial Sequence
  Synthetic
SEVDRVLKTVEELIRRVKRISDRVLTEVKKLVDDVRRVVEKSRRDVEELVKEVKRSVDERV

SEQ ID NO: 21186 - protein, 59 aa, Artificial Sequence
  Synthetic
KEMLERALKEIKEEVKRNEDDNRRMLREIEELAKRNKEENKRVLDEVRDIVRRLAEEVK

SEQ ID NO: 21187 - protein, 61 aa, Artificial Sequence
  Synthetic
EEVERVREEVDKLLKTLKEVSDRVLKASKDLLDRVKEIVEKSLRDVKRLIDDVKRKVDERV

SEQ ID NO: 21188 - protein, 59 aa, Artificial Sequence
  Synthetic
KEVLERLLKKAEEIIRKNKKENDDNLEESRKEIEKNEEDNRELVKRIEDEVRRLKKEVE

SEQ ID NO: 21189 - protein, 61 aa, Artificial Sequence
  Synthetic
SEVEEVLRRVRELIERVKRIVDESEKEVRRLIEEVKKIVEESLKRVEELLRDVKRRVDERV

SEQ ID NO: 21190 - protein, 59 aa, Artificial Sequence
  Synthetic
RKMLREVLEKIKKIVKDNEDDNRRALTEVRERVRENVEENKKVVDRVRKIAEDLRKEVE

SEQ ID NO: 21191 - protein, 61 aa, Artificial Sequence
  Synthetic
SEVERVLEEVKKLIEDVKRVVKESEEEVEKLIRDVEREVERSKRTVDELVKDVKRAVDRDV

SEQ ID NO: 21192 - protein, 59 aa, Artificial Sequence
  Synthetic
REVLTKVLREVEEAVRRNKERNKRALEEVKKTVDRNREDNKRMVDKVRETAKRLKDEVR

SEQ ID NO: 21193 - protein, 56 aa, Artificial Sequence
  Synthetic
SSIEKVREDVKELIRDVERAVKRVKEESKKLVDDLRRAVKRVEEESRKLLKDLERN

SEQ ID NO: 21194 - protein, 59 aa, Artificial Sequence
  Synthetic
DDDVRRVLREIERIVKEVKDDLKRVLEESERSIRRVKEELRRVLEDNRRLLKEVKDRAR

SEQ ID NO: 21195 - protein, 60 aa, Artificial Sequence
  Synthetic
SEVEAVLREVEERVDRVRKESEKTLREVERLVREAKRRSKKSLDDVKKKVEEVKKKIRDI

SEQ ID NO: 21196 - protein, 55 aa, Artificial Sequence
  Synthetic
EEVKREIEKLVEDVRRVSDRVVEEIKELVKDVERMSRKVVEDIKRLAEDVRREAE

SEQ ID NO: 21197 - protein, 60 aa, Artificial Sequence
  Synthetic
DEVERVLEEVKERVDRVKRESEKSLKEVEKLVRTNERLSERTLKEVRDLVEDAKKKIDDI

SEQ ID NO: 21198 - protein, 55 aa, Artificial Sequence
  Synthetic
EEVRREIEKLVEDVKRVSDKVVEDIRRLAEKLRRDNKRAEDEIRKLVRDVERRAK

SEQ ID NO: 21199 - protein, 60 aa, Artificial Sequence
  Synthetic
DDLERVLEEVRKLVKELKERSRKSLEDVRRSNERNETESRRTLREVRELVKKVKEVIDRT

SEQ ID NO: 21200 - protein, 55 aa, Artificial Sequence
  Synthetic
EKVKEDIRRLVEEVERVSREVVERIKKLADESRKKNKKVIDEIKELVKRVRDRAK

SEQ ID NO: 21201 - protein, 60 aa, Artificial Sequence
  Synthetic
REMEEVLKEVEKRVRDIEDESRKTLERVDKLVKKNKRDSERTLKEVEDLVREVKKEIRRI

SEQ ID NO: 21202 - protein, 55 aa, Artificial Sequence
  Synthetic
EEVKREIKKLADRVREVSERVVREIEKLVRDIKRRNEEVIDEIRKLVEDVKREAK

SEQ ID NO: 21203 - protein, 60 aa, Artificial Sequence
  Synthetic
KEVEDVLEEVKELVKELKRVSEETLRRVEKSNRENEEKSKTTLKEVEDRVERVKEEIKKT

SEQ ID NO: 21204 - protein, 55 aa, Artificial Sequence
  Synthetic
EEVKREIKKLVEEVRRVSEEVVREIKKLVDKSRRVNEKVIEDIKELAKEVEEAAR

SEQ ID NO: 21205 - protein, 60 aa, Artificial Sequence
  Synthetic
SELEEILERVRKMAEDAERISEETLRRSEELIRRVKDLSRESLERVERLIRKVKKEIEEI

SEQ ID NO: 21206 - protein, 58 aa, Artificial Sequence
  Synthetic
EEVLRVIKAIEDLLRRVERVSREASKTSEELLKDITRVSEKSKEDIKRLLDDVRRKVK

SEQ ID NO: 21207 - protein, 60 aa, Artificial Sequence
  Synthetic
SELDEVLKTVEELVRRIKEKLKEILDRSRKLVEEARKLSEDSLREVKRVIDEIKREAERQ

SEQ ID NO: 21208 - protein, 58 aa, Artificial Sequence
  Synthetic
EEVLKLVEDVRRLVEDVDRTVERMSRESKKLAEDIKRVSEKSKRDIERLLADVERTVR

SEQ ID NO: 21209 - protein, 60 aa, Artificial Sequence
  Synthetic
DELDEVLKEVEELIKRVKRESERTLKENRDMVREIKRRSEESLREVRELIERVKDELRRT

SEQ ID NO: 21210 - protein, 58 aa, Artificial Sequence
  Synthetic
ERVARVVRRVEELLEDVERRSREVLKEMDKTAKEVKKASEKSEEDIKRLLEDVERTVR

SEQ ID NO: 21211 - protein, 60 aa, Artificial Sequence
  Synthetic
KEAEDILKEVEDIIREAKKLSERTLDENRKVIRKAKEDSRRSLEEVRKIIEDVKEELDRI

SEQ ID NO: 21212 - protein, 58 aa, Artificial Sequence
  Synthetic
ERVLRVIREIEKLLEDVKRVSERSVKEMKKTLDDVRRASKRSEEEIERLLRDVERRVT

SEQ ID NO: 21213 - protein, 60 aa, Artificial Sequence
  Synthetic
RSLEEVLKEVEELIRRAKEESKRTLDDVRKLIEEVKRESERSLRDVREMIERAKDRIRRI

SEQ ID NO: 21214 - protein, 58 aa, Artificial Sequence
  Synthetic
EEVRKVVEDVERLLRDVERMSKEVEKRIRELLDDIRRVSERSRREIERLLEDVERTAR

SEQ ID NO: 21215 - protein, 60 aa, Artificial Sequence
  Synthetic
DELEEILKRIEDRIREIKERSKKTLDDIRKVAERVEERSRESLKEVREVVEEIKDRIRRI

SEQ ID NO: 21216 - protein, 58 aa, Artificial Sequence
  Synthetic
REVLKVIRDIEELLREVAEVSERSRREIEKLLEDVERVSREAIKRIKDLLRDVERTVK

SEQ ID NO: 21217 - protein, 60 aa, Artificial Sequence
  Synthetic
KEIEELLDEIRRLMERSKENVRRSLKKSKDLIEEAKRRLEKSLEDSRELIRRIEDRIRRI

SEQ ID NO: 21218 - protein, 55 aa, Artificial Sequence
  Synthetic
KEVLEEIRRLLEDLRRMNEKSIEDSKRLLEDVARAVKRSIDESRKLLEKIERDVD

SEQ ID NO: 21219 - protein, 60 aa, Artificial Sequence
  Synthetic
KEMEDLLREAEELIRRSVENVKRSLEESEKLIRESKKNVERSLRRSEELAKEIKDEIRRI

SEQ ID NO: 21220 - protein, 55 aa, Artificial Sequence
  Synthetic
ERVLREIRRLLRELEEINEKSIRDSKRLLEEIERVNRDSIRRSKELLEDVERTVR

SEQ ID NO: 21221 - protein, 60 aa, Artificial Sequence
  Synthetic
SEVEDLLRRAEELIRRAKERLERSLRRVEKLIDDVRRKLERNNETVKRLVEEIKEKIKRI

SEQ ID NO: 21222 - protein, 55 aa, Artificial Sequence
  Synthetic
EEMLKEIERLLEDIERVVRETIDTTRRLLEKIEREVREVIKSNRELVADLERTVT

SEQ ID NO: 21223 - protein, 60 aa, Artificial Sequence
  Synthetic
DEVERLLEEVKRLIDRAREELKKSLDRVRRLVRENEEAVRKNNEDVADLIRKIKEKIEKI

SEQ ID NO: 21224 - protein, 55 aa, Artificial Sequence
  Synthetic
KKVLDDIRRLLKDIKDIVDKTIRDTKELLRDIEEKNRRATKSNKDLLEEIRETVR

SEQ ID NO: 21225 - protein, 59 aa, Artificial Sequence
  Synthetic
DEVEKLLRRVEKEVDRIKRELEDNLRRVEKLVKEIHEENEKLMRKARKLVEDIKRIIDR

SEQ ID NO: 21226 - protein, 59 aa, Artificial Sequence
  Synthetic
SEEVKKAEKEIRRLLDELRRVVEEVTKKTKELLRRLKKSSDELRKTIKELLRELEEKVR

SEQ ID NO: 21227 - protein, 59 aa, Artificial Sequence
  Synthetic
KEVDEILRELEELVKEIKKRLEELTREVKRLVDKIHKDNEDNLRDMARLVEEIKEIIRR

SEQ ID NO: 21228 - protein, 59 aa, Artificial Sequence
  Synthetic
SKEVERVERDVERLLDELRRVVKEVLDRIRRLLEELERSSKRVKEETERLVKEVREAAK

SEQ ID NO: 21229 - protein, 59 aa, Artificial Sequence
  Synthetic
SEVDKILEDLRELVERIHKKNKRIVEEDRELVKEIHRKNEENLKTMERLVEEIEKIIRR

SEQ ID NO: 21230 - protein, 59 aa, Artificial Sequence
  Synthetic
SEEVKRVRKDVDRLLKELEDSSREVKERSRRTLEELERSSREVKERTERLLRKLEKAVE

SEQ ID NO: 21231 - protein, 59 aa, Artificial Sequence
  Synthetic
DRLEEILKELRELVETIHRRNEEIVRKVAELVKRIHDHNEENTRRVEELVRRIKDIIRR

SEQ ID NO: 21232 - protein, 59 aa, Artificial Sequence
  Synthetic
SEDVERAKRDVDRLLKELEESSERVLRTIEKLLKELRESSKRVRDETKRLLDELREAVR

SEQ ID NO: 21233 - protein, 59 aa, Artificial Sequence
  Synthetic
SELDEILKRLEKLVEDIKRKLEKLVRDLERLVKRIHDHNEENLKTVKKLVDEIKDIIRR

SEQ ID NO: 21234 - protein, 59 aa, Artificial Sequence
  Synthetic
SREVDRVREDVRRLLEDLKRVAERVKRDIERLLKELKESSDEVKKRTEELLEELERAVR

SEQ ID NO: 21235 - protein, 59 aa, Artificial Sequence
  Synthetic
DEVDDILRRLRELVERIKKHLEDNLRELEELVKRIHDHNKRNVEEVKKLVEEIKKIIAD

SEQ ID NO: 21236 - protein, 59 aa, Artificial Sequence
  Synthetic
SEEVRRVKEEVERLLEEVRRVVRKVKEESKRLLEELRRSSDRVKKETERLLEELERAVK

SEQ ID NO: 21237 - protein, 59 aa, Artificial Sequence
  Synthetic
SEAEALVEEVKRIVEESKRRLEKVVEESRKLVEEVKKRLRDMLKTIEDLVKEVKELLDN

SEQ ID NO: 21238 - protein, 55 aa, Artificial Sequence
  Synthetic
EEVKRKVERLLEEDRRVLEEVKESAKRTSKEVRDELREVSKRVEKLLKDVRDAAR

SEQ ID NO: 21239 - protein, 59 aa, Artificial Sequence
  Synthetic
DEAEDLVRRVRDIVRKSREELKRVVEESDRLVEEVKRRLKKVVEDSKRLVDEVRKLREG

SEQ ID NO: 21240 - protein, 55 aa, Artificial Sequence
  Synthetic
EEVKREVERLLEDDERVLREVAKRSRETLETVRKVLEEVERRSRKTLEEVEKTAR

SEQ ID NO: 21241 - protein, 59 aa, Artificial Sequence
  Synthetic
SEMDELVDRARRIVEESRRLLEEVVKRSKDLVKDVKKKLEDALRRVEEIVRRLDEELKG

SEQ ID NO: 21242 - protein, 55 aa, Artificial Sequence
  Synthetic
EEVKDEVRKLIEEDKKVLDDVRRKSERTLREVEDVLRRVEEEVEKLLRKVEESAK

SEQ ID NO: 21243 - protein, 59 aa, Artificial Sequence
  Synthetic
DEAEKLVEDVRRIVEKIRKELEDVVEESRELVERIRRELERVVEESERLVEELRKELEK

SEQ ID NO: 21244 - protein, 55 aa, Artificial Sequence
  Synthetic
EEVKEEVKKLLEEVRDVLRKVKKASEETLRDVRRVLEEVKRRSEETLKRVREEAT

SEQ ID NO: 21245 - protein, 60 aa, Artificial Sequence
  Synthetic
SEVEDIVRDVKRLVEENHRRNEEIVRRDEDLVRRNNELNKRILEEVEELVRRLEDVARKI

SEQ ID NO: 21246 - protein, 55 aa, Artificial Sequence
  Synthetic
EEALRTAEELIKRLEDSLREVKDRSKRSLDEMKKSADDVRREIERLIKRVRDTTK

SEQ ID NO: 21247 - protein, 60 aa, Artificial Sequence
  Synthetic
SEVEKIVREVEEVVERIRKKSEDSLREVRRLVEEIKRRSEKTVEDDEKLVKDAKDELRRI

SEQ ID NO: 21248 - protein, 55 aa, Artificial Sequence
  Synthetic
EDAKRRIEELMKEVRDVSRRALKEIKDLLREVEEVSKKALKRSKDTVDEVREEVR

SEQ ID NO: 21249 - protein, 60 aa, Artificial Sequence
  Synthetic
DEVEEIVKEVARVVDEIRRLSKESLDRVRKLVEDIERELRKIVKTDRDLVEEAKRVLKDI

SEQ ID NO: 21250 - protein, 55 aa, Artificial Sequence
  Synthetic
REVEKEIRRLVEEVKEVSRKVRKEIEELMRRVEEVVKTVKEESKKTVREVEETAR

SEQ ID NO: 21251 - protein, 60 aa, Artificial Sequence
  Synthetic
DEADEIVKRVEEVVRRAKETLERILKRVEEMLDRIRKESEKTVREDEKLVEEVKDRLRKI

SEQ ID NO: 21252 - protein, 55 aa, Artificial Sequence
  Synthetic
ERLLREIKRLLKEVEDEVRRVEKAIKELVDRVKEVSDRALERSKRTVREVEERVR

SEQ ID NO: 21253 - protein, 56 aa, Artificial Sequence
  Synthetic
SEVEEVKEDSKRTLKELKDVAKKVDDDSKRLLEELERVARKSIEDSKRLLDELRER

SEQ ID NO: 21254 - protein, 59 aa, Artificial Sequence
  Synthetic
EKELRRLVEDDRRLVEEVKRDSERLLDEIRKLVEEIKERLRRSVEELRRRVEEIKKTTT

SEQ ID NO: 21255 - protein, 56 aa, Artificial Sequence
  Synthetic
SSVEKVKRDSERTLREVEKVIEKVDRDSERLLRDVERVITEADERSKDLLRRLEES

SEQ ID NO: 21256 - protein, 59 aa, Artificial Sequence
  Synthetic
DTDLRRLVEEDRKLVTRVKEESKRLLEELRRLVETVRKRSEDLLREIKKRVDEILRRTK

SEQ ID NO: 21257 - protein, 60 aa, Artificial Sequence
  Synthetic
DEIKEVIDRITKVLEDNERVVRKLSEENKKVLDDIRRRAEEIIRRNEEVLRRIKELAKRN

SEQ ID NO: 21258 - protein, 55 aa, Artificial Sequence
  Synthetic
EELKKALDDILRRLEESNRKNIEDSRRILEDVERIVRRVVEVSKDIVRKAEEDVR

SEQ ID NO: 21259 - protein, 59 aa, Artificial Sequence
  Synthetic
SEVEEVIDELRKVLEENKRRVEELSRENDDVLRRIEERLKKIEDELEKILKDVRDLKDN

SEQ ID NO: 21260 - protein, 55 aa, Artificial Sequence
  Synthetic
ERLKEEITRILEELTRINEENKRRSEEILDRVRKDVERVLKRVEDILKEIEDELR

SEQ ID NO: 21261 - protein, 60 aa, Artificial Sequence
  Synthetic
SSVEELEERLRRVLERSERHLRKLEKKVEEVLDESRKNLTRLLRDVERVLRDVEETVRRE

SEQ ID NO: 21262 - protein, 59 aa, Artificial Sequence
  Synthetic
ERKARELKRTVKRLAEESRKILREVEEKVRKVAEDSERILEEVERTVKRVVEEIDRTVR

SEQ ID NO: 21263 - protein, 60 aa, Artificial Sequence
  Synthetic
SKVEKLLRELEEVLKDSERHVREDSDRLRRVLEDSERHVRKVLRDVEKVLREVEDMVRKR

SEQ ID NO: 21264 - protein, 59 aa, Artificial Sequence
  Synthetic
EEKARRLEERVEEIVRESERTSRENNKKSRDIIKTSEDILREAADRVREVVERIRRTLT

SEQ ID NO: 21265 - protein, 60 aa, Artificial Sequence
  Synthetic
KEVEEVIERSKKSNEENERRLRKILEEARRINEENEKLLRKILEEAKRVVEEVRRILKDN

SEQ ID NO: 21266 - protein, 59 aa, Artificial Sequence
  Synthetic
KEELDKLREESKKILRHSERLLKEVEEEVKRILEHSEELLRRVEDKVRRLLKEIEDALR

SEQ ID NO: 21267 - protein, 60 aa, Artificial Sequence
  Synthetic
DEVEEVEKKVDKIDKENEDLLRKVIRDAERINEENTRLLEDILRKAKKMVDDVREILKDR

SEQ ID NO: 21268 - protein, 59 aa, Artificial Sequence
  Synthetic
EEEVRRVAERVKEVVKHSRELLKRVEDMVRRIVEHSKRLLDEVRERVKDLLRKIAEARK

SEQ ID NO: 21269 - protein, 59 aa, Artificial Sequence
  Synthetic
DEVREVVRRLEEIVRDVNKKNRESVREAERLVDRLREILEETSRRLKELVDRVKELIKG

SEQ ID NO: 21270 - protein, 59 aa, Artificial Sequence
  Synthetic
EKEARELEDAVRKLIERLKRSAEEVKKRVEELDEEIRRVVEEDRRTIKELKEEIDRADK

SEQ ID NO: 21271 - protein, 59 aa, Artificial Sequence
  Synthetic
DEVEEAVKRIEDLVERLRELLEKTSREIEKILKESEDKLRESSDRIRRLLDELKKLIEN

SEQ ID NO: 21272 - protein, 59 aa, Artificial Sequence
  Synthetic
EEKLRKAEDTVRRVIKDVRKMLEDDRRTVEEVIRRDREALEKDRKTVDDVIEDVKRVAK

SEQ ID NO: 21273 - protein, 59 aa, Artificial Sequence
  Synthetic
SEVDEAVEEIKRILEESKKRLDETSEEIKRILEDSERRLRESSKRIRELVKELKKRIDG

SEQ ID NO: 21274 - protein, 59 aa, Artificial Sequence
  Synthetic
KDKLTRIREVVDKVVKEDEDALREDERTVREVIKRDRDLLEEDRRTVEDVIRKVRETAR

SEQ ID NO: 21275 - protein, 59 aa, Artificial Sequence
  Synthetic
SDAEKVVKRIKEIVEDSTRKVRDTSRDIRRILDESRKMLEDVVREIKDLVRRLEELIRG

SEQ ID NO: 21276 - protein, 59 aa, Artificial Sequence
  Synthetic
KDTLDKVREDAERVLEEDKKVADDDRKTVEDVIREDKRLLKRVEEEVKRVIKEVDDAAK

SEQ ID NO: 21277 - protein, 59 aa, Artificial Sequence
  Synthetic
SEVDRAVETIRRILEESEKIIRKVVREIEEILDRSRRLLEKSSEEIEDLVRRLKELIEG

SEQ ID NO: 21278 - protein, 59 aa, Artificial Sequence
  Synthetic
ERLLREAEKDVRRVVEEDEKVLRDVARRVEEVIKADKKLLREDEKTVREVIERVKETAR

SEQ ID NO: 21279 - protein, 59 aa, Artificial Sequence
  Synthetic
DEFREAVRRIKEIIDDSRRKLEKNVKENEELLKRSDDELRKSSEDIKKLLEELRRLIEG

SEQ ID NO: 21280 - protein, 59 aa, Artificial Sequence
  Synthetic
EKSLREVEERVERLLEDDRRLLEENARRVEDLIRKDKEALDRDRKTVEDVKREVEKDAR

SEQ ID NO: 21281 - protein, 59 aa, Artificial Sequence
  Synthetic
SEVDEVVKRIAEIVKTSKDELREAVKRIEDIVRRSEKMVRDNLRENERLVRELDKLAKG

SEQ ID NO: 21282 - protein, 59 aa, Artificial Sequence
  Synthetic
KEKLDRVTETVRRLIEEDKRALEDVERKVEDVIRRDREVLERNRREVERLIKEIEDKRR

SEQ ID NO: 21283 - protein, 59 aa, Artificial Sequence
  Synthetic
KDAERAVEEIRKILEDSKEKMERNVRENEKLVRDSRRKLEENVERNEKLVRDLKRLKEG

SEQ ID NO: 21284 - protein, 59 aa, Artificial Sequence
  Synthetic
KDTLKRVTDEVRRVVEEDKRVLEENRRRVEKLIEEDKRALDENRERVRKLIEDIDKDAT

SEQ ID NO: 21285 - protein, 59 aa, Artificial Sequence
  Synthetic
DEVEDAVEKLKRLVDELERLLREAVRRIEKILEDSTRKVRKNLEENKELVKRLRELIKN

SEQ ID NO: 21286 - protein, 59 aa, Artificial Sequence
  Synthetic
KDLLRKVAEVVRRLEEEIRRLLEEAKRVVDEVIKKDRTVMERNREEVERLIREIEETAR

SEQ ID NO: 21287 - protein, 59 aa, Artificial Sequence
  Synthetic
SEVDEVVERIRRIIKKSKEELDKAVRDIEEILRRLEKELRDNVRENEKLVEDVRRAIEG

SEQ ID NO: 21288 - protein, 59 aa, Artificial Sequence
  Synthetic
KDKLERVSREAKRVLKEDEEALRDVEKKVTDVIEAVKKMLEDNRDRVRRLIEEIKRRAT

SEQ ID NO: 21289 - protein, 59 aa, Artificial Sequence
  Synthetic
DEIREAVKRIRRLLEESHRENKEIVDRLRKLVEESHRKNEKLKRELEELVKKLKEIIDK

SEQ ID NO: 21290 - protein, 59 aa, Artificial Sequence
  Synthetic
SEDLKRAEEEIRKVSEDNKRSVDRVREVVKRLSDENRRSLEEVREVVKRLIREVEEARR

SEQ ID NO: 21291 - protein, 59 aa, Artificial Sequence
  Synthetic
DEIRKVVKEITDLLKKSNDKNRKVVEEIRDLLRKSKKLADELVERLRKLVEDLRRRIDK

SEQ ID NO: 21292 - protein, 59 aa, Artificial Sequence
  Synthetic
SEDLKRVEERAREVSRRNEESMRRVKEDADRVSEKNKEVLDRVREEVKRLIEEVRETLR

SEQ ID NO: 21293 - protein, 59 aa, Artificial Sequence
  Synthetic
DRIRDVAREIRELLKRSNDENRKVVEEVRRLLKESNDTNKRVVDEVRELLERLKEIARR

SEQ ID NO: 21294 - protein, 59 aa, Artificial Sequence
  Synthetic
SEDLKRIRREVEKVSEDNKRSAKEVEDEARKVSEDNERSVRDVKEKADRVIKEVEDEDR

SEQ ID NO: 21295 - protein, 60 aa, Artificial Sequence
  Synthetic
DEERKIKRVLDEVDKHSKRVIAEAKRVVDEVLREVEKVVRRNKEVLDEILREVKRILDEG

SEQ ID NO: 21296 - protein, 55 aa, Artificial Sequence
  Synthetic
EELIKTIRKVNKEIEDRVRDLIKTVRDILRRIEEEVRKSIEDSKRLLRELEARAE

SEQ ID NO: 21297 - protein, 57 aa, Artificial Sequence
  Synthetic
SVVEDLKRTVEEVVKKSEEILKEDRKTVEKVVEEVKKSDKEDRDDVDRVVKEVRKRI

SEQ ID NO: 21298 - protein, 59 aa, Artificial Sequence
  Synthetic
KDLADKVKKDAEEVLKRSKEHVDRSIDRTREILKRLRETNEESIKRTRDILRKIAEEAR

SEQ ID NO: 21299 - protein, 57 aa, Artificial Sequence
  Synthetic
SVSEELKKKVEKVARDVERSLERDATEVTKVVEEVKKSDRKDEETVKRVVKRVDELI

SEQ ID NO: 21300 - protein, 59 aa, Artificial Sequence
  Synthetic
REVAEKVIRDAEKVLDDIRRMNEESIRDTRRVLEENKRKNEESIRKTEEILRRIEEESR

SEQ ID NO: 21301 - protein, 60 aa, Artificial Sequence
  Synthetic
SEVDEVLKELERINRENHREVEELLRRLERILRESKKHIKEVIEDLRRRLKELEDEVRRR

SEQ ID NO: 21302 - protein, 59 aa, Artificial Sequence
  Synthetic
EKKVRELEEEARRVKRSTEEVIKRLRDSVEKLVKDSERVLRELKKEVERVVEEIDKMIK

SEQ ID NO: 21303 - protein, 60 aa, Artificial Sequence
  Synthetic
DEVEKALEESKKSNEENHRKVKKVLESAKDINRRNHDLVRDVIRKLEEILRRIEKVVREG

SEQ ID NO: 21304 - protein, 59 aa, Artificial Sequence
  Synthetic
DKEVTELRESSRRSIESTREAVRTLEEAVREVIKSTDEAVKRLEATVKRIEEEIRKSMK

SEQ ID NO: 21305 - protein, 60 aa, Artificial Sequence
  Synthetic
DDVERVLKKSRDSNRENHEKVKRVIEKSDRSNEDNHRLVEDAIRKAEEILEEVERLVTAG

SEQ ID NO: 21306 - protein, 59 aa, Artificial Sequence
  Synthetic
KEEVDELRKSSEDSIRSTEDVVRKLEETSKRSIRSTEDVARKLEEAVRRIERRIRERTR

SEQ ID NO: 21307 - protein, 59 aa, Artificial Sequence
  Synthetic
SEVEEVLKRSKESVERVDRDVRRVLRELEDLNRKNHKRVEEVIRDAERILREVEDMVRR

SEQ ID NO: 21308 - protein, 59 aa, Artificial Sequence
  Synthetic
DKEVDELRKSSEKSVEDIKRVVDRLRDSARKIIKSTEDVVKELERRVREVIKRIKEEAT

SEQ ID NO: 21309 - protein, 58 aa, Artificial Sequence
  Synthetic
SEIEEIIKRIEKLLRDDEKKIRDSIKRSEDLLREANRENKESIDRVRELLEKVKRLRE

SEQ ID NO: 21310 - protein, 61 aa, Artificial Sequence
  Synthetic
KAEEEVRRLEKRVRDVLRELEKTLKRVTEVHKETTKENEKSARRVKREVEKVIEEVERTRT

SEQ ID NO: 21311 - protein, 58 aa, Artificial Sequence
  Synthetic
SEIEEIIRRIEELEERLKRELDRSIRTSEKLLEDAREINKESIRRVEKLLEEIRRVVD

SEQ ID NO: 21312 - protein, 61 aa, Artificial Sequence
  Synthetic
KAEERVRALEKAVKDVLESLKRLLDEVRKRHKESSEDNERSLKRSKEEAEKVIKAVEDERR

SEQ ID NO: 21313 - protein, 60 aa, Artificial Sequence
  Synthetic
SEIEDIIRRIRKLLEEDKEKIERSIRESRRLLEEAKRINEKSIEDVKRLLREIEDVVDKI

SEQ ID NO: 21314 - protein, 59 aa, Artificial Sequence
  Synthetic
REKVERLREDVDRVRKELEKTLETVTRSHKRSSEENKRSLEESERTARKVIEDIRRRDR

SEQ ID NO: 21315 - protein, 60 aa, Artificial Sequence
  Synthetic
KDIEEVLKRIKDLLEDIRRRLKESEERSRKLLEEAREINERSIERVRRLLEEIRRLKEEI

SEQ ID NO: 21316 - protein, 62 aa, Artificial Sequence
  Synthetic
EEMERKVRELERAVREVIKEVEKLLTDVARKHKKVSRDNKESLRRSEEEARRVIRAVEETDR

SEQ ID NO: 21317 - protein, 57 aa, Artificial Sequence
  Synthetic
STLETVEKKVEEVIRENEKSMRESEEKVDRSTKRIEDVLRRLEETIRKTSDDIAKDV

SEQ ID NO: 21318 - protein, 59 aa, Artificial Sequence
  Synthetic
REDATRVIEEAKRILDEARKLNEETIRRSEELVRRIERVIEEIIKRSEKLLEDVRRESK

SEQ ID NO: 21319 - protein, 57 aa, Artificial Sequence
  Synthetic
SVLDDVRKKVEEVLDRNRELADRSRRTVEEVLRENERVMEESKRTVDEVIKRVAEKL

SEQ ID NO: 21320 - protein, 59 aa, Artificial Sequence
  Synthetic
REDAERMIERLKRILDRVEEENRRAIEELREVLERVRDDNRRTIEELERILKRVEEESR

SEQ ID NO: 21321 - protein, 57 aa, Artificial Sequence
  Synthetic
STVETVREEVERVLKHSDDLIKEVEDVNRRVEEEIKRVIRELEEENERLVREVRKKV

SEQ ID NO: 21322 - protein, 59 aa, Artificial Sequence
  Synthetic
EEEAREIIKRLREVNKRTKEKLDELIKHSEEVLERVKRLIDELRKHSEEVLEDLRRRAK

SEQ ID NO: 21323 - protein, 57 aa, Artificial Sequence
  Synthetic
DEVERVAKEVEDVLREVEKLIRDVRRKVEEVLKHSEEVAKRVRDTNRELVKEVERDI

SEQ ID NO: 21324 - protein, 59 aa, Artificial Sequence
  Synthetic
EKELRDIIRRLKEVLDKLKKDLEDIIRRLEEVNRESERLAREAIRHSEEVLDKLRKDSK

SEQ ID NO: 21325 - protein, 60 aa, Artificial Sequence
  Synthetic
REVEEVKKRIREALEESERVIRENKKKNEELLDRVRKEIERNKKKNEEVLKRAKEVTKAG

SEQ ID NO: 21326 - protein, 55 aa, Artificial Sequence
  Synthetic
EDVKRKIDRMVEESRKLVEDLKRESDRVEEEVRKLVKTIKDEITRSLDEVRKDAE

SEQ ID NO: 21327 - protein, 60 aa, Artificial Sequence
  Synthetic
SEVDEVRKDIERILRKSERDIRRNKEENKRLLDEVRRRIEENRKENEDLLKRIEELRRAG

SEQ ID NO: 21328 - protein, 55 aa, Artificial Sequence
  Synthetic
EEVKKEIDKAVEDSKRLVEDAERVSDEVRERVRRLVERLKEESDRVEREVEKRTT

SEQ ID NO: 21329 - protein, 60 aa, Artificial Sequence
  Synthetic
SEVEEVLRRAEKLSEDNKRENDESLERLRRIVEKVREENEESVKTLEKILKEVEEVVRRN

SEQ ID NO: 21330 - protein, 59 aa, Artificial Sequence
  Synthetic
KEVIKRLEDEVRRLEEDNKRSIKKSEDEIRKLVERLKRSAERSDEVIRKLEKDAEDLIR

SEQ ID NO: 21331 - protein, 59 aa, Artificial Sequence
  Synthetic
DEVERILEDSKRLVDELRERVERVIEESKRLLDDLRRKVEEVVRRLEKIVEDLKRMIEG

SEQ ID NO: 21332 - protein, 59 aa, Artificial Sequence
  Synthetic
EDKVRELKETADRSNEEIKRVLEKIKRMIEDTNRKIKKLLEEIRDVARRVLEEVREVAR

SEQ ID NO: 21333 - protein, 59 aa, Artificial Sequence
  Synthetic
KEVEDVLRESKRLVEDLERRSERSIEESKRLLKELEDLVEEVIRRSEESIDRLRELIKG

SEQ ID NO: 21334 - protein, 59 aa, Artificial Sequence
  Synthetic
EKKVRDAEREARDSNDKIRRSLEKVERVVRETNRRIKELLEKIERVIRDTDRKIAEEAK

SEQ ID NO: 21335 - protein, 59 aa, Artificial Sequence
  Synthetic
SEVEKIVRDSEKLLEDLKRELEKVIKDSDDLVRELKKRVTEVLERLRRIVEELRKLIEG

SEQ ID NO: 21336 - protein, 59 aa, Artificial Sequence
  Synthetic
EEKVRRLEKEARRTNEEIRKLLEKVDEVARRSNERIKAVLEEIKREIEKLKREVEKDAK

SEQ ID NO: 21337 - protein, 59 aa, Artificial Sequence
  Synthetic
SEIEEVLKKSKKLVDDLRKEVEETIRESKKTVDDLDKEIKEVVRRSEESLDRLKKLIDG

SEQ ID NO: 21338 - protein, 59 aa, Artificial Sequence
  Synthetic
ERKVDEIRRAVEETNEEIKRVVDEDNKAVKRSLEEIERVAEEIKRVAEETLKAIEDARR

SEQ ID NO: 21339 - protein, 59 aa, Artificial Sequence
  Synthetic
DEVEELVRRLEELVKRSRDTNRKIIKEIRELSERLKRELEKIARELEKLVEDLKEEVKR

SEQ ID NO: 21340 - protein, 56 aa, Artificial Sequence
  Synthetic
VEKIEDVVRRLLEENERVLRRTEEEARRVLETNRDLLRKIREVVDRLEKEIREAEK

SEQ ID NO: 21341 - protein, 58 aa, Artificial Sequence
  Synthetic
SDADRVAEELKKLVEDSRRENERVIEESKRLVKENEDRNRELIERLKKLVDKLRDILE

SEQ ID NO: 21342 - protein, 56 aa, Artificial Sequence
  Synthetic
VDKVRETVKRLLEENKRVMEKTEEVAKKSSEDIKRVADETRRRAEELLKEVDELRK

SEQ ID NO: 21343 - protein, 59 aa, Artificial Sequence
  Synthetic
SEADEMLRRLKELVDRSRDTNRKILKRSEDLVRDSKKKNDDIIRELRRLLEELRELARR

SEQ ID NO: 21344 - protein, 56 aa, Artificial Sequence
  Synthetic
TDDVRREVERLLRDNKRVLDETRKAAEESTRRNKKVLEESREVVKDVLKKIEDTDR

SEQ ID NO: 21345 - protein, 59 aa, Artificial Sequence
  Synthetic
DEVREVAERLRRLVDESRKRNEEVIKESEALVDRVRKTNEEVMKRLRELIDKLEKDIRR

SEQ ID NO: 21346 - protein, 56 aa, Artificial Sequence
  Synthetic
VETIERVVRELLEENKEVLRKTEEMVKRSTETNKRLLERSKEVADRLRERIKEAAK

SEQ ID NO: 21347 - protein, 59 aa, Artificial Sequence
  Synthetic
DEVDELLKRLRKLVDEVRKENDKMVKESKRLVEDLKRKIDEIIERIERLLEELEKILKD

SEQ ID NO: 21348 - protein, 56 aa, Artificial Sequence
  Synthetic
VEDIEREAERLLRENEELLRRSEEVIRRSTEKIKKVLRDAEERAREILKRVEDAAK

SEQ ID NO: 21349 - protein, 60 aa, Artificial Sequence
  Synthetic
DEVEEVKKKLREIVKRDRDLIERVREELKEILDRNREINRRAIEDLKRILEEVDELVKRG

SEQ ID NO: 21350 - protein, 59 aa, Artificial Sequence
  Synthetic
EELIRDVERVVREVLRRIEKSIRDLDRVIRDVLDKSRELIKRSEDVAKRVVDTLREKAR

SEQ ID NO: 21351 - protein, 61 aa, Artificial Sequence
  Synthetic
DEVETVKKELKELADEVKERNERSIRDSERLLEEVKRRNEKSIRDLERLVEELEDVLRKRG

SEQ ID NO: 21352 - protein, 59 aa, Artificial Sequence
  Synthetic
EKKVKEVTDEVKKVLDEIRELDKRSRDAVRRTNEEIKRLDKESKDVVDRVKKKVEDAVR

SEQ ID NO: 21353 - protein, 61 aa, Artificial Sequence
  Synthetic
REVEEIIERLKKLLKEIAERNTESIKELEELVRRIAEDNKRIIEELRRLLEELADVVRKKG

SEQ ID NO: 21354 - protein, 59 aa, Artificial Sequence
  Synthetic
EKKVREVRKVAEEVLRAIEELDKRSRDAVRRVTKRVKDLDEETKRVVEDVLRRIEELMK

SEQ ID NO: 21355 - protein, 61 aa, Artificial Sequence
  Synthetic
SRVEEIIEDLRRLLEEIRKENEDSIRRSKELLDRVKEINDTIIKELERLLKDIEKEVREKG

SEQ ID NO: 21356 - protein, 59 aa, Artificial Sequence
  Synthetic
EDKVRKVREVAEKVLRDIDKLDRESKEAFRRTNEEIRKLDEDTRRVAERVKKAIEDLAK

SEQ ID NO: 21357 - protein, 61 aa, Artificial Sequence
  Synthetic
SEVEEIIRRLEELVREVAKRNEDIIKRSRDLIRKVKEDNRRSEEELRDLSRRIADIVRKKG

SEQ ID NO: 21358 - protein, 59 aa, Artificial Sequence
  Synthetic
ERKVREVRRVAKKVLEDVKTLDDKTREVARRTNEDIKRLDEKSRKVIEEVRREIEELKR

SEQ ID NO: 21359 - protein, 61 aa, Artificial Sequence
  Synthetic
SEVDEIIKELERLLREIARENERIIRESRKLADEVRKRNEDAIRKLEELVRRLADMVRRKG

SEQ ID NO: 21360 - protein, 59 aa, Artificial Sequence
  Synthetic
KDKVTKVKKVADDVLREIKKLDDETRRVIEDTNKKIKDLDKKTRDVVRKVLEEVKKLEK

SEQ ID NO: 21361 - protein, 61 aa, Artificial Sequence
  Synthetic
SDVEDVIRKLETLVDDLRRKVERIKERSRELIKRIAEENRKVIEELERLLEELADVVRRKG

SEQ ID NO: 21362 - protein, 59 aa, Artificial Sequence
  Synthetic
EKKVRDVRRVAEKVLREVRRLMEEVERVARKTNRDIERLDEETRRVVEKVRKEIEDLRR

SEQ ID NO: 21363 - protein, 57 aa, Artificial Sequence
  Synthetic
SAKDKIAEVAKRVLTENKKLLEESEEVARRTSEESKRLLKESEDVVRRVLDEIRREI

SEQ ID NO: 21364 - protein, 59 aa, Artificial Sequence
  Synthetic
ERLIEEVIRRLEELLKEVKKKNEEVIRRSKELIDRDRDLNRRSIEELERLIREVRKESK

SEQ ID NO: 21365 - protein, 57 aa, Artificial Sequence
  Synthetic
SAKEKIKEVAERVEKRNKELLEESERVIKEVSERSERLLDESRKVVKRSTEEIRDKI

SEQ ID NO: 21366 - protein, 59 aa, Artificial Sequence
  Synthetic
EELIREVIERLKELVDRVEKENRKAIETSRRLLKEDEDLNRESIKRSEELVKDVRRRST

SEQ ID NO: 21367 - protein, 57 aa, Artificial Sequence
  Synthetic
DARKELEEVVRRVEEEIRRLLKDIEDVAREVNRRSEKLLRETEEVIRRSTEEIKRDV

SEQ ID NO: 21368 - protein, 59 aa, Artificial Sequence
  Synthetic
RERVKEIIERLRRLVEELKKLVDEVRKRLEDVVRELKERNKKVIDDSKDLVRRAREESR

SEQ ID NO: 21369 - protein, 59 aa, Artificial Sequence
  Synthetic
DFSERLDEVLRKVRTDIKKLVEKVRRVVEDSRRRVEKLVEDVRRSSEEVLKTVKELLDR

SEQ ID NO: 21370 - protein, 59 aa, Artificial Sequence
  Synthetic
DEVVRRLEKRLRDALKEAEDKVRRDEERNREVLERLEKIVRDLHRENEKAVEDVADRAR

SEQ ID NO: 21371 - protein, 59 aa, Artificial Sequence
  Synthetic
DLSEEVKRVIEEVRKRIEELVDEVRKSTEEVIKRVRRLVEEVERVVEDSRRKVDKLLKE

SEQ ID NO: 21372 - protein, 59 aa, Artificial Sequence
  Synthetic
EEVVRRLKEELEKALRDAERIVKELHEENRKVLEDVKRMVDEDKKKNERVVDEVRRDAK

SEQ ID NO: 21373 - protein, 60 aa, Artificial Sequence
  Synthetic
SLSEEVKKVIREVEEDVKRLVRELRESSERVLKEIKKLVDEVRRVLEESKERVKKLEREG

SEQ ID NO: 21374 - protein, 59 aa, Artificial Sequence
  Synthetic
DEVVRRLKKRLKEALDRLRDIARKLDKENKEALDEARRIVEENKRRNEKVVEDVERRAE

SEQ ID NO: 21375 - protein, 60 aa, Artificial Sequence
  Synthetic
DEVEELKKDLKRVLEEVRKIVEDIHRTNEEVLREVEKIVEDIHRENKEVLEKVEKIMREL

SEQ ID NO: 21376 - protein, 59 aa, Artificial Sequence
  Synthetic
EELVREVKRVVDELEKEVRDLLRRLKESTDKLREDVRRLAERLRDSLREMERDVREKTR

SEQ ID NO: 21377 - protein, 60 aa, Artificial Sequence
  Synthetic
DEVERLKRELETVLRDVERIVEEIHRENKKNLDKVKKIVEEIHKENREVLEKVRKIMEEL

SEQ ID NO: 21378 - protein, 59 aa, Artificial Sequence
  Synthetic
KKLVEEVEEVVKRVEEAVEELARRLEKSTRDVVEESKKLARELEKSLEEVKEEVRKLIT

SEQ ID NO: 21379 - protein, 60 aa, Artificial Sequence
  Synthetic
KELEELIKRLKRVLEENRDIVRKIHEDNERNLDELRKIVERIHKENKRVLEEVKKIFEEL

SEQ ID NO: 21380 - protein, 59 aa, Artificial Sequence
  Synthetic
ERVVREVERVIKKLEDDSRKTVRDLEESTKEVEKRSKELADELEKSIEDLERRVDEDTK

SEQ ID NO: 21381 - protein, 60 aa, Artificial Sequence
  Synthetic
REVEELKKELERVLKKVADLVEENERRNRKNLEDLRRIAEEIHRRNEEVVKRVRDTLERL

SEQ ID NO: 21382 - protein, 59 aa, Artificial Sequence
  Synthetic
EKLVRDVERVVEKVERDVKRLADRVREVLKESSDRSRELVERLRESLRKAREEVRKAIE

SEQ ID NO: 21383 - protein, 59 aa, Artificial Sequence
  Synthetic
KDVDEVLKRLRELIDELRKTNERVKRELKKLVEDLERKNKDVERRLRELIRTLEEIARK

SEQ ID NO: 21384 - protein, 59 aa, Artificial Sequence
  Synthetic
KDMVKKVRDVIEDLKREVERLDRETKEVVERVKRKIEKTNRDSKKVIDDLRREVERLRK

SEQ ID NO: 21385 - protein, 59 aa, Artificial Sequence
  Synthetic
SEAERIVEELRKLIEDLRRKNEEVKERLKRLVREDEKRNEEVLKELEDRADELRKLVEK

SEQ ID NO: 21386 - protein, 59 aa, Artificial Sequence
  Synthetic
KDVVDRLRRVIEDLKRTVEKSNEDSDRVIKEVKKRIDDSLKRVEDVIRRVKETIDRLEK

SEQ ID NO: 21387 - protein, 59 aa, Artificial Sequence
  Synthetic
SDVDRVAKDLEKLIRDLEKINRDVSRENKELIEKDKKINEDVLRELDRLVEELERLVRE

SEQ ID NO: 21388 - protein, 59 aa, Artificial Sequence
  Synthetic
KEMLEKIRKVAERLRREVERSNEESKKSADEAEKTIRKSLKEVEERIREVEKKIRDLKR

SEQ ID NO: 21389 - protein, 59 aa, Artificial Sequence
  Synthetic
SEVDRVLKELDELIRTLEELNKKVSRENRELIKEDKKRNDEVVKRLEDLIRELKERVDK

SEQ ID NO: 21390 - protein, 59 aa, Artificial Sequence
  Synthetic
KDALKKVREVIERLKEEVERLDRETKKSADEAKEAIKRSLEEVEDVVRKIREKIKKAEE

SEQ ID NO: 21391 - protein, 59 aa, Artificial Sequence
  Synthetic
DEVERAKEELEKLVRKDEEDNDRVRKRLEELIRRLKEENDRVLEELRRLSEELDRLAKE

SEQ ID NO: 21392 - protein, 59 aa, Artificial Sequence
  Synthetic
KEALDEVRRVIEEVKREIERSLRESREVIKELKERVKELDERTREVVRKVKEEIDELER

SEQ ID NO: 21393 - protein, 59 aa, Artificial Sequence
  Synthetic
SEVDDVLRRLDKLVKDDKRTNDRIVTRDRETVKRVKEVNREIVERLERLVDRVREIVER

SEQ ID NO: 21394 - protein, 59 aa, Artificial Sequence
  Synthetic
EDALRKVREVIRRVEEDIKRSLRDSERVIEEVVTRNEKVDRETKKVVDEAKREIDERAK

SEQ ID NO: 21395 - protein, 60 aa, Artificial Sequence
  Synthetic
SELEKLIEELERVLKRIEEVSRELDKELETVLDEIRRASKRLNDELRRALEEIARAATEN

SEQ ID NO: 21396 - protein, 58 aa, Artificial Sequence
  Synthetic
KLLERAEDVIRRVREALEELVRTNRESLERVERAARELNRRNEESLERARREVEKLRR

SEQ ID NO: 21397 - protein, 60 aa, Artificial Sequence
  Synthetic
DEVRELIDRLRKALEEITRESRRLDEELRKVLEEVERRVEELSRRNKEMLDRVREKVTRR

SEQ ID NO: 21398 - protein, 59 aa, Artificial Sequence
  Synthetic
SRLLEELKRVIDEVRREVERLNKKNKESLDRARRRVEDLLRRLEESVRRVEEELKKLST

SEQ ID NO: 21399 - protein, 59 aa, Artificial Sequence
  Synthetic
SELERVIRESERTVEESHKHVREVIRKLRDIVRRSHEHVREVIERSKESVERVRDLVRR

SEQ ID NO: 21400 - protein, 59 aa, Artificial Sequence
  Synthetic
EELVRRLKKVLDESEKAVTRNIEEIKKVLEDVVRKAEKNIREIAEVLERSTRAAKKDTD

SEQ ID NO: 21401 - protein, 60 aa, Artificial Sequence
  Synthetic
ELEKRIDEVLKRVEDEIRKSIRENEEVLKDVERAVKELIKENERVLEEVREEVRKIIERV

SEQ ID NO: 21402 - protein, 59 aa, Artificial Sequence
  Synthetic
EDIVREVEKELEDILRDNRRLVRESIESLKDVVRRVAELVERSIRELKKMVDEIRKEAE

SEQ ID NO: 21403 - protein, 60 aa, Artificial Sequence
  Synthetic
KLEERIEKVLEDAERDVRRSEEEIRRVLKEVEDRVRRLLRENEDALRRVEEEVKKIIDRV

SEQ ID NO: 21404 - protein, 59 aa, Artificial Sequence
  Synthetic
EKIVKRVIETLRELLKENRKLVKDVIEDLKRIVKEVEELVRESIERLKDMVRRISEKAK

SEQ ID NO: 21405 - protein, 59 aa, Artificial Sequence
  Synthetic
KEVEEIIETLKRLSEDLERKVREIIERLKRLSERLERENKEVIKELERLIDELRKLVED

SEQ ID NO: 21406 - protein, 59 aa, Artificial Sequence
  Synthetic
SEDLRKLDRVVKESERTIRDLLRKLDEVAKRSDDTIERVNDETAKVIERVKRKIEELEK

SEQ ID NO: 21407 - protein, 59 aa, Artificial Sequence
  Synthetic
REVEEMIKELEELLKDLKEKNERASKRNRELVRRLEEENKRVIEELKKLVKELEDLVRS

SEQ ID NO: 21408 - protein, 59 aa, Artificial Sequence
  Synthetic
SEKLKELRDVIKEVKKRIDELDEYTRESIRRAKKEIERLNRETKKVIEEVVKRIEEERK

SEQ ID NO: 21409 - protein, 56 aa, Artificial Sequence
  Synthetic
SEKEEVRRVIEELRRILKRVLEDLRRVVKENEDRLRELKKENEKSLRELEERARRI

SEQ ID NO: 21410 - protein, 56 aa, Artificial Sequence
  Synthetic
VEDLKREIDRVAKEVEEVLEENRRRNEKSVEELRRDSKRNHERNEEVVKEAEDAAR

SEQ ID NO: 21411 - protein, 56 aa, Artificial Sequence
  Synthetic
SEEERVRKALEELKRELDKVHENNKRSLRENEETLKKLLEDNERSLRELEEEMRRV

SEQ ID NO: 21412 - protein, 56 aa, Artificial Sequence
  Synthetic
VEELIKTLRRVAKEVRERSEENDRRNKKSVDELREDSKRNHDENDKVLKKLEKAAE

SEQ ID NO: 21413 - protein, 56 aa, Artificial Sequence
  Synthetic
DEVEKLEEDSERSLEELRKTVEEVKKRSEDSLRDLERKSRENEKESRRTLRELREK

SEQ ID NO: 21414 - protein, 59 aa, Artificial Sequence
  Synthetic
ERVRKRVKDAAEKSRRVIEDLLREIKRVADDSRREAKRLLDRNKEVLERSKETADREKK

SEQ ID NO: 21415 - protein, 56 aa, Artificial Sequence
  Synthetic
DEVEKLAEDSKRSLEKLRREVEKVKRESRESLKRLKEESEKNVRDLRRLLEELRRR

SEQ ID NO: 21416 - protein, 59 aa, Artificial Sequence
  Synthetic
ERLLKRVKDVMDESRKVIRELLELIKEVIRESKETVKRLLDENKRVADEVRKVVDELRK

SEQ ID NO: 21417 - protein, 60 aa, Artificial Sequence
  Synthetic
SEVEEVEREVKEVIEELDEIVKRVKEENDDSVRKSKRSLDEIEAEVRRVLKELTDRVTKR

SEQ ID NO: 21418 - protein, 59 aa, Artificial Sequence
  Synthetic
EEVLERLTRLIEKLKDVIRRLRERLKKSADDSRDVIRRTLEAIKEIIERLKEVIDRLDK

SEQ ID NO: 21419 - protein, 60 aa, Artificial Sequence
  Synthetic
DEIEKLREDVKKTLEESRKSVEDLERRSEDSIRRSRESVERLKREVKEVIDRLRDARRRG

SEQ ID NO: 21420 - protein, 59 aa, Artificial Sequence
  Synthetic
KRVLDEIKKLADEDNKTVTDSLKRIRDSAKKVDEVVRESLERIRKVAEEITKVVEDVKR

SEQ ID NO: 21421 - protein, 59 aa, Artificial Sequence
  Synthetic
SELETLEKSLRDVLKESRDSVEKLRKEVEDTIKESEDSVTKLLKEIEDVIRRLEDLRRR

SEQ ID NO: 21422 - protein, 59 aa, Artificial Sequence
  Synthetic
EDVLRRIRRAAEEVRKVAKESVDRIRDLAARDNEVVERSLKKIEEVLRRIKKVADDVAR

SEQ ID NO: 21423 - protein, 60 aa, Artificial Sequence
  Synthetic
SEIERLEREVREVIKESEESVRRLKKRVDDTVRENEELVKRLEDRVRRMKERLEDARRRG

SEQ ID NO: 21424 - protein, 59 aa, Artificial Sequence
  Synthetic
DDVKRKIRKVMEEIKKRADDSRRKIEDVARKDNKAVERSLRRIERLLEEITRVVEEIKK

SEQ ID NO: 21425 - protein, 60 aa, Artificial Sequence
  Synthetic
SELEKLDKESRDSIRKSEDSVRRLEEESEESIERSKRLVEELKRLADEVIRRLEDMARRG

SEQ ID NO: 21426 - protein, 59 aa, Artificial Sequence
  Synthetic
EDVLRAIEESMKRARKAVEDSLRRIRESLEKVKEEVRRSNEKIKKIVKEVREVVERIAD

SEQ ID NO: 21427 - protein, 60 aa, Artificial Sequence
  Synthetic
DELEDLEREVREVIEESKRLLEELEKRVKEVIKTSRDSVRRLKERVDRVIKELRDAKRRG

SEQ ID NO: 21428 - protein, 59 aa, Artificial Sequence
  Synthetic
EDVLRKIRELLEEIRRVIEETNRRIKKLLEEIKRVADDSRRRIRKVAREVEEEAKEIEK

SEQ ID NO: 21429 - protein, 60 aa, Artificial Sequence
  Synthetic
SVRERIDELEKKIKRVVEKVLKENKDSLKRVEERVRRLLEENKRSLDEVREAVERVLSEV

SEQ ID NO: 21430 - protein, 56 aa, Artificial Sequence
  Synthetic
VEKLERDVEKVIEDARRTSEEVKRENDKALKDLDRLSEEVEKENRKALEDLKRTSD

SEQ ID NO: 21431 - protein, 60 aa, Artificial Sequence
  Synthetic
SVRETIDKALKKIRDVAEDLKRRNDELLKEIEEVARDSSEKIRRALEEVERRVREVLKRV

SEQ ID NO: 21432 - protein, 56 aa, Artificial Sequence
  Synthetic
VEKLKKDIERIIRELEELSDRLKKIIEEVIKKSEDLVRRLRESLERVLREIDKTTK

SEQ ID NO: 21433 - protein, 60 aa, Artificial Sequence
  Synthetic
SVREEIDRILREIEEVVKTSSERIKRLLEKIEEVVKRLIEENRRVLKRTDEEADRLLKEV

SEQ ID NO: 21434 - protein, 56 aa, Artificial Sequence
  Synthetic
VDTLRKEVKEVIDTSEDLVRRLEEEVRKAAKRLKDLVDDSRRLNTEILRTLRERRR

SEQ ID NO: 21435 - protein, 60 aa, Artificial Sequence
  Synthetic
DDLKRLEEDVRRIIEENDRIVKDIAEKSKKSIEDNRRLLKRLRDESERTIDDIRRLKEEG

SEQ ID NO: 21436 - protein, 55 aa, Artificial Sequence
  Synthetic
EEIRRLLKEITDVVRESNRRIKRINETAHEVVRRSNTETTKVNKKAHDVVEEVKR

SEQ ID NO: 21437 - protein, 60 aa, Artificial Sequence
  Synthetic
SLIEKIREIVKEIIKRSDDSVEEVKRRNEESIRRSEESVKDNRRRIEDIIRKLKRLKEEG

SEQ ID NO: 21438 - protein, 59 aa, Artificial Sequence
  Synthetic
DDMLRKIEALAREVTEVSKRALEEIRKLMEESTEVSKRALERIEASVEEVRRVAEEVKR

SEQ ID NO: 21439 - protein, 59 aa, Artificial Sequence
  Synthetic
SLLEEIEKEVREIIKRSRKSLEEVKRRNDDSIRKSEKLVEDNKREIEEVKERARKLKED

SEQ ID NO: 21440 - protein, 59 aa, Artificial Sequence
  Synthetic
KRVLEEIDRLAKDVKRVSDEVLEEIKRLAKESKEMADRSNEEIKKSVEEVRRVVEEVEK

SEQ ID NO: 21441 - protein, 59 aa, Artificial Sequence
  Synthetic
DEIEELEKLIRKAIKDSRDLVRKLEEENKRSIDTSRELLKELERMLDEVRRRLEDLKRK

SEQ ID NO: 21442 - protein, 59 aa, Artificial Sequence
  Synthetic
EELLREIKKLLDTIRRVIEESSERIKKLAEDSREVVKESSTEIKRLLETITEVVDRVTK

SEQ ID NO: 21443 - protein, 59 aa, Artificial Sequence
  Synthetic
DEVEEAEKLIRKVIKDSEKLLRDLADLNRKSIRRSEKLVEDDRRANEDVIRKLEELRRN

SEQ ID NO: 21444 - protein, 59 aa, Artificial Sequence
  Synthetic
EELLRRIKKLLDEIKKAIEDSSREIKRLLEESERVAKRSSEDIKRTLDDTRRVVEEVRR

SEQ ID NO: 21445 - protein, 60 aa, Artificial Sequence
  Synthetic
DVEETVRKLIEDVKRVMERVRKSNTDLIRRSKEVLKDARRLHEELTKEVKDVLRRLEEEV

SEQ ID NO: 21446 - protein, 59 aa, Artificial Sequence
  Synthetic
REVVKRVEEDVRKKLEESTKDSKRVERESEENLRRAKEKSKRVLKKLKDDLRRLEEESR

SEQ ID NO: 21447 - protein, 60 aa, Artificial Sequence
  Synthetic
SVKETVKDLEREVREVLKKLRDDVRKLIEESDKALKRLKKIHDDLSRDVRRVLEDLRRRV

SEQ ID NO: 21448 - protein, 59 aa, Artificial Sequence
  Synthetic
KKMIDDVVRRVRKKLKEIDEKVKDVERKSRENLKRLKEKSDRVAEDLKKILDELREEVR

SEQ ID NO: 21449 - protein, 60 aa, Artificial Sequence
  Synthetic
SVEETITELIKEVRKVAEEVKKSNKEVIEESEEALKELERTHTELSEEVRKVLRELEEEV

SEQ ID NO: 21450 - protein, 59 aa, Artificial Sequence
  Synthetic
KEVVTEVVKEVKKRLEESKDDSRRVMEESRRNLKKLREESKRVVEELRRELRRLKEEVR

SEQ ID NO: 21451 - protein, 60 aa, Artificial Sequence
  Synthetic
DVEETVRKLIEKVKRVLERLEEEHKRLSDDSRRVVKKLKDDVEDLIRRVEEVLKELERRV

SEQ ID NO: 21452 - protein, 59 aa, Artificial Sequence
  Synthetic
RKAVDEVRKEVDRRLEELKRDSERVVKKSEENLRRLEEEVRKVEEKVRRTLKRLKEEAK

SEQ ID NO: 21453 - protein, 60 aa, Artificial Sequence
  Synthetic
DKLEKVLEEIKRRLEENERLLRKVERDLKRLSKENEDRLRKMLEDLRKLSEDLLRSVEKD

SEQ ID NO: 21454 - protein, 55 aa, Artificial Sequence
  Synthetic
EKVDELLKEVEEIIDRSRKEIDRTRKDNERSVKRSEDAIRKTLDENEKSLREATR

SEQ ID NO: 21455 - protein, 60 aa, Artificial Sequence
  Synthetic
SDVEEMEKRIRDRLRENRRIVEDVAKKLRDLSRRLEEEVKKVAEELRRLSDELRKRVTRR

SEQ ID NO: 21456 - protein, 55 aa, Artificial Sequence
  Synthetic
ERVKDLLREVKRVIDESKKTIRDTLEENEDSIRRLRERIDETLKENEKSIKELKD

SEQ ID NO: 21457 - protein, 60 aa, Artificial Sequence
  Synthetic
SSVEEVKKELDKILEELKEKSERSKEEVERVLKKLREKSDRVEREVRKAEERLRRKVKDI

SEQ ID NO: 21458 - protein, 56 aa, Artificial Sequence
  Synthetic
DETVERLLKKLKDVLEELRRRHEEVSKRLEKVLKELVDRHKKVTEDLKRVLDELRK

SEQ ID NO: 21459 - protein, 60 aa, Artificial Sequence
  Synthetic
SLEETLKKLIEEVEEVLRRSEEIAREAIRRSERVLEELERRHKKVTDEIKEMLRELRERI

SEQ ID NO: 21460 - protein, 59 aa, Artificial Sequence
  Synthetic
EELVERVLDKVRRDLEDSRRHLEEVKRKSEESLKKLKKETKDALDTIREKLKRIADELR

SEQ ID NO: 21461 - protein, 60 aa, Artificial Sequence
  Synthetic
SMEEKVKRIIKKVDDVLKDSERRITELIKKSRDVLRELEKRHEELTKRVKDVLDDLRRKI

SEQ ID NO: 21462 - protein, 59 aa, Artificial Sequence
  Synthetic
DRAVDTVRKEVEKALEENRKTVRDVEEESDRSLRRLREKTDEVRRRVEEILKRLKERVD

SEQ ID NO: 21463 - protein, 60 aa, Artificial Sequence
  Synthetic
ELEERIKELIKKVRDVLRKSKEEVDKVIRKSEEVVRETEKLVEDIIRRVEKVLDEVRKRI

SEQ ID NO: 21464 - protein, 59 aa, Artificial Sequence
  Synthetic
KELVRTLERRVEEVLRRNEELVKRVREESDRSIDRSRRSLERAEEDVDRVLKEVKDRTT

SEQ ID NO: 21465 - protein, 60 aa, Artificial Sequence
  Synthetic
DLEKKVEDVIREVEKVLRELRRRHEELTKRSEDAVKETKDRVKEIEDEVRRVVDKVRKDI

SEQ ID NO: 21466 - protein, 59 aa, Artificial Sequence
  Synthetic
DELVKELKRDVERVLKRLKERSDEVRKESEKSIKKSKDSLEKAEREVREMLRDLDRETK

SEQ ID NO: 21467 - protein, 60 aa, Artificial Sequence
  Synthetic
SMEERVKELIRRVRKVLEDTERRAKEIIEDVERVLEELKKRHEDLTRKVDKVLKELKKEI

SEQ ID NO: 21468 - protein, 59 aa, Artificial Sequence
  Synthetic
EKLVTKVEEDAERALRESEESLRKVEREVKRVLEELKRKTEKVARELDKILKELKDRTR

SEQ ID NO: 21469 - protein, 60 aa, Artificial Sequence
  Synthetic
SLEDELRKLIEDVKRVAKETEDRVREILKRSKDVLDELKKEHDKLTREVERVLDELAKEI

SEQ ID NO: 21470 - protein, 59 aa, Artificial Sequence
  Synthetic
EELVKKVKKEVEDVLRRSKESLKKAEEDSRKSLEELKKKTEDLKREVKEILDRLKERVR

SEQ ID NO: 21471 - protein, 60 aa, Artificial Sequence
  Synthetic
SELEKLKREVDEVLKRNKELVDELRKRVRKALEESRRSVEEVERRVEEVLKRLEDDLRRE

SEQ ID NO: 21472 - protein, 59 aa, Artificial Sequence
  Synthetic
EELKEKVRRILKEVRRVLDESRRDVERVLREVEKVMRESIKKARDAIRKVEEVLRELER

SEQ ID NO: 21473 - protein, 60 aa, Artificial Sequence
  Synthetic
RELDDARRKVEEVLKTNKDLVDKIRKEVEETLERLDRSSRKVREIVRRVLEELTRRATER

SEQ ID NO: 21474 - protein, 59 aa, Artificial Sequence
  Synthetic
EELKRLVEKLIKEVEDVLEESRKAVEDVIREDKRRMEESKREADELIREVKKVLDDLRK

SEQ ID NO: 21475 - protein, 60 aa, Artificial Sequence
  Synthetic
KELEDLEREVREVLKRSDESLKRLEEEVRRVLDENDKEVKRVKEKVKKVLDELREIVTRR

SEQ ID NO: 21476 - protein, 59 aa, Artificial Sequence
  Synthetic
EELKREVERLIREVEEVLKKSEEAVRRLIEEVDRALKRSREEFTKAREEVKKVLEDART

SEQ ID NO: 21477 - protein, 60 aa, Artificial Sequence
  Synthetic
DEIDKARKDIEDMLRRLRDLVRKLEDLNRKVVEELKDLVRKDRKLNEDIVRRLERLVRER

SEQ ID NO: 21478 - protein, 59 aa, Artificial Sequence
  Synthetic
EEVKRRIEELLRRVDKVADEVRREVERTNRESEEVVREVEEDVRRSLEEIDKVIKDVRT

SEQ ID NO: 21479 - protein, 60 aa, Artificial Sequence
  Synthetic
SEIDELRKRVEEVLRRLDELVKRLKEENDRVVKKAEDLIRRLEETNREILKKLRKLVKDD

SEQ ID NO: 21480 - protein, 59 aa, Artificial Sequence
  Synthetic
RDVLEKIKDLLRRVKEVADEVEKKIRELNKKTEDVVRELEERVRKLDEDVKRVIEEVKR

SEQ ID NO: 21481 - protein, 60 aa, Artificial Sequence
  Synthetic
SELDEIRERIERIEKDLERLVEEVKRVNDTIVERIKKLIDEVRKENEKVIKTLRDLVREV

SEQ ID NO: 21482 - protein, 59 aa, Artificial Sequence
  Synthetic
EKVEREIRRLLERVKEVIERVKDRVRRVDKKSRDVVREARRAIEEVDRRVRKVVREAEK

SEQ ID NO: 21483 - protein, 60 aa, Artificial Sequence
  Synthetic
DEIKKLEDEVKKILDDLRELIRKLEETNRDVERRLRELIAELRKRNDEVVKRLRDLVRRS

SEQ ID NO: 21484 - protein, 59 aa, Artificial Sequence
  Synthetic
EDVKRKIEEILRRVEEEIRRLKKEVERLDRESKRVIRELREDVKRTNTDVKRVVDEVRK

SEQ ID NO: 21485 - protein, 60 aa, Artificial Sequence
  Synthetic
SLVERLEERVKRIIDELRRILEENRRRVKKVSDENRDLLRRLEEENKKIIEDLRDLKRKG

SEQ ID NO: 21486 - protein, 59 aa, Artificial Sequence
  Synthetic
EKAKDKLRRLEEEIRKVAKEVEDELRRSTEYVKKSLEDAKRKLEELTKRTEDVAEEVER

SEQ ID NO: 21487 - protein, 60 aa, Artificial Sequence
  Synthetic
DLVERVEEKVEDIKRKLRRILEEVDRRNKEVSKENKELLDRLEEENERIIRELEKAKRDG

SEQ ID NO: 21488 - protein, 59 aa, Artificial Sequence
  Synthetic
DRAREKLKRLVEDIDRVAEEVKRTLEELSRYTDKSLEDAERSLERLTKETDEVLKRVTT

SEQ ID NO: 21489 - protein, 56 aa, Artificial Sequence
  Synthetic
SIVERLKKLAEDVIRRLERLSKELAKRNKEVIERLKELSKRLEDKNRRVIEELRRT

SEQ ID NO: 21490 - protein, 59 aa, Artificial Sequence
  Synthetic
EEVKRAIEELRDRIRKVIEDSERTIRKLNDDTRKVVEDSRRTIEELNRTTDKVIEEVRR

SEQ ID NO: 21491 - protein, 56 aa, Artificial Sequence
  Synthetic
RKVDELRKEVKRVIDELRELSERLRKENERVIKTLEDLVRRLEKLLERVERELERT

SEQ ID NO: 21492 - protein, 59 aa, Artificial Sequence
  Synthetic
EEVKKEIDRLRRELDRVIKESEDTIRRLNDETRKVIEKVRRAIEELLRRIEEVIKKVEK

SEQ ID NO: 21493 - protein, 56 aa, Artificial Sequence
  Synthetic
SIVEELRELVKEAIKRLKKLSDDLRRKNEEVIRTLKELLDRLKRKNEEVIKRLEDT

SEQ ID NO: 21494 - protein, 59 aa, Artificial Sequence
  Synthetic
EEVKREIEKLKRDVERVIEDSRRTIEELNRKTEEVIERVRRTIERLNEETKKVIDRVRT

SEQ ID NO: 21495 - protein, 56 aa, Artificial Sequence
  Synthetic
REVDELRKRVEEVIRELEKLSEDLAERNRRVSERNKELVETLARLNKRVIDELRRT

SEQ ID NO: 21496 - protein, 59 aa, Artificial Sequence
  Synthetic
EEVKKAIDDLRRELEEVIKRSKKTIDDLNRYTKKSIEDVREAIKKLNKETDDVAREVKK

SEQ ID NO: 21497 - protein, 56 aa, Artificial Sequence
  Synthetic
SIVEELKKLVEEAIRKLEKLLEELEEKNRDAIRRLKELSDELRKKNEEVIERLKRT

SEQ ID NO: 21498 - protein, 59 aa, Artificial Sequence
  Synthetic
EEVKRMIEKLRRDVEKVIREVRDEIRRLNDTTRRVIDKSRKTIEELNRTTEEVIERVKR

SEQ ID NO: 21499 - protein, 60 aa, Artificial Sequence
  Synthetic
DEEEVMRELKKEIDEALERSKEINDRLRKEIRDVLEKLERIVREVKERSERVLEDVRRKV

SEQ ID NO: 21500 - protein, 55 aa, Artificial Sequence
  Synthetic
KEAVDEIRRILREALEEDKKSVEDIRRDLDKIEKDVKKVLEDNERLLKRLREEVK

SEQ ID NO: 21501 - protein, 58 aa, Artificial Sequence
  Synthetic
DEEEVMKELEDRIREVDKKIEDRLRELKERSDRVLDRSRRINKKLKDEIEDALRRVRR

SEQ ID NO: 21502 - protein, 55 aa, Artificial Sequence
  Synthetic
KEAVDTIERKLRKLEEDLKKVERDNKKLLDDMERDDRRSLEEIKRILDELLEKVR

SEQ ID NO: 21503 - protein, 58 aa, Artificial Sequence
  Synthetic
REEEVMKELDREIEEVLERSREIVERLRREIEEVLKENKKIVETLKREIKKVLREVRE

SEQ ID NO: 21504 - protein, 55 aa, Artificial Sequence
  Synthetic
EEAVKRIRDILEKDERDVREVVRRIREILKASLEDSERSVEEIRRILDELRKEVE

SEQ ID NO: 21505 - protein, 58 aa, Artificial Sequence
  Synthetic
REEEVMERLRREIEKALRESHEIDDRLRKRIEDVLRDSERKLEELRRRIKKVMDDVRR

SEQ ID NO: 21506 - protein, 55 aa, Artificial Sequence
  Synthetic
EEAVRKIREELERMKEENDRVLKEIDKDLKDDDRKIEEVVERIERILRELRERVR

SEQ ID NO: 21507 - protein, 60 aa, Artificial Sequence
  Synthetic
DEKEVADELERKIDEALKESHEIDKRSDDHDKEVLKKSEKRLRELDEEIKDVLRKLEKKV

SEQ ID NO: 21508 - protein, 55 aa, Artificial Sequence
  Synthetic
REAVETIERILKRMIERNRAVVETNKKLNKEDEDKIREVVKRIREKLRKADEEVR

SEQ ID NO: 21509 - protein, 60 aa, Artificial Sequence
  Synthetic
ETEDKVRELLKRIRDVAEKAREKVEELVRRNEEVLKRARETVERLVRKNEEVLREVAERA

SEQ ID NO: 21510 - protein, 56 aa, Artificial Sequence
  Synthetic
KKELEDTVRKVLEDLERKLERLEEESREVERRVKKVLDELKRKSEESEKRLEEAAR

SEQ ID NO: 21511 - protein, 60 aa, Artificial Sequence
  Synthetic
DAEEVVRKLEEELKRLIDKLRKVMEESLKRVKESMDRSRKRIEELVRRLEKILRDLKRDR

SEQ ID NO: 21512 - protein, 59 aa, Artificial Sequence
  Synthetic
EDVLRKLKETVERVRRKVEEVIKKSRESVKRVEETNTRSLRELEETVREVEKRVREESR

SEQ ID NO: 21513 - protein, 59 aa, Artificial Sequence
  Synthetic
SEVEKLLKDLKELLEEVKRRAEESHRDLRRLLEEVRKRVEDSNRELERELRRAEDLVRR

SEQ ID NO: 21514 - protein, 59 aa, Artificial Sequence
  Synthetic
RKMERVVEEIRREVKKVLEDLRRILKESEDAARKVLRDLERLVKHSKDTAREVLKRLKK

SEQ ID NO: 21515 - protein, 59 aa, Artificial Sequence
  Synthetic
SEIEKLLRDLERLLEEVKRKAEKTNRDLEKLLEEVKRKVEDSHRKLKKVLDEVKDLVRR

SEQ ID NO: 21516 - protein, 59 aa, Artificial Sequence
  Synthetic
ERVKRLVEDVRRRVKEVLDDLRRIIEHSRRRAEKVLRELEKLVRESETKAREVLKDLKK

SEQ ID NO: 21517 - protein, 56 aa, Artificial Sequence
  Synthetic
SEAERLLEDSKRVLDEIREDLKRLLKESEDVMREIEKTLEKLVRDVERVLDEVRKS

SEQ ID NO: 21518 - protein, 56 aa, Artificial Sequence
  Synthetic
ERVLRTIKDLHRRLSEEVKRVLDEAEELHRRLSERVREVLEDIRRLVEELIEEVRK

SEQ ID NO: 21519 - protein, 56 aa, Artificial Sequence
  Synthetic
SEAEDLLRRSKERLDEVRKRLDELRRRSERVVEEIRRLLKELLDDVERVRKEVKEA

SEQ ID NO: 21520 - protein, 56 aa, Artificial Sequence
  Synthetic
DRVLRTIEDTHRRLSEDVKRVLKEAEELHRRVTEEVKDVLRKIRETAERLEEEVKK

SEQ ID NO: 21521 - protein, 56 aa, Artificial Sequence
  Synthetic
KEAEELLDTSRRVSEEVEKRLEKLLRESERVAEEIRKRLEELLRRVEKVLDELRKA

SEQ ID NO: 21522 - protein, 56 aa, Artificial Sequence
  Synthetic
EKVLKTIEDEHRRLSESVERVLRTAKRLHDEVSKEVRDVLEEIRRTVEKIIREVRT

SEQ ID NO: 21523 - protein, 60 aa, Artificial Sequence
  Synthetic
SVEEVLKTLEDLARESSEEVRRVAEEIERSNRRVVKEVEKVLREIEELNRKILEEVERDL

SEQ ID NO: 21524 - protein, 59 aa, Artificial Sequence
  Synthetic
EEVLRELLKEVAKVVEDTRRKLEELLKENEEMDRDLKRKLDELLERNREVLERLKRKVD

SEQ ID NO: 21525 - protein, 60 aa, Artificial Sequence
  Synthetic
SVEEVLKELEKLVRDSSREIKKVLEEIDKSNTDLLREVEDALRRIEERVKEALESVDRTV

SEQ ID NO: 21526 - protein, 59 aa, Artificial Sequence
  Synthetic
REMLERLLDTLRRRLEETRKELERLLTENKKKDDEVKEKLKRAEEELEDVRRRLEEKLR

SEQ ID NO: 21527 - protein, 60 aa, Artificial Sequence
  Synthetic
SAEEVLRRLKEAIKRLIRDSERVLEEIRRTNEELIKRTEEVLRRVREKAERLIDDVRRRL

SEQ ID NO: 21528 - protein, 59 aa, Artificial Sequence
  Synthetic
DEALRRIEKEVRDVEKRSKETLEDSKRDSERVRKKSEDTLREIETRVEDVRRKAEEEVR

SEQ ID NO: 21529 - protein, 59 aa, Artificial Sequence
  Synthetic
SESDRIRAIVKKVVDESKESLKRLKEETERVKRELDRVLKENKDKVRRLKEKAEEMKKL

SEQ ID NO: 21530 - protein, 56 aa, Artificial Sequence
  Synthetic
SDVLREVAERVTRLIRDSERVLEELAREHEKASRKVKKVLDESKKIVDDVIRRVDR

SEQ ID NO: 21531 - protein, 59 aa, Artificial Sequence
  Synthetic
SESEEIERTVEDVKRKSDKSLEESRRNVERLKEESEESLERNKDLVRRVAEKVEEVKRD

SEQ ID NO: 21532 - protein, 56 aa, Artificial Sequence
  Synthetic
SEAADRVREEVTKVIKKSEDVLRDSERLHREVIKTSRDVLDKSRRLVEEIIRRVRR

SEQ ID NO: 21533 - protein, 59 aa, Artificial Sequence
  Synthetic
SDVERVLREVEEIIRKARDRSREWLERVKKIIEKVKEDSKRWLDEVRKLIRDVEDIRRR

SEQ ID NO: 21534 - protein, 58 aa, Artificial Sequence
  Synthetic
ERVREVIDRIRKLLKDIIDEARDVNKKVRDLLKRIVEEVTEVNKRVKELVEEIVRRIK

SEQ ID NO: 21535 - protein, 59 aa, Artificial Sequence
  Synthetic
DELREALKRVADIVRTIEEAVRKSLEDSKRIVDDIRRASKEALEEVEKIVRTLVEIVRN

SEQ ID NO: 21536 - protein, 58 aa, Artificial Sequence
  Synthetic
KEVRDVIREVEKLLREVEKIVRDVNRESERLAKEVRDDATEVNERVKELLKRAEAAVR

SEQ ID NO: 21537 - protein, 59 aa, Artificial Sequence
  Synthetic
SVVEELRRTVKELLDEIKRRDDRLLKEVEEVAREVERKDDELRKKVEEILRRIKELRDR

SEQ ID NO: 21538 - protein, 55 aa, Artificial Sequence
  Synthetic
DRVLKELKELMDEAKKNSERVNKKVEDLLRRLDESSRRVNEEIEKRLTELLKAVE

SEQ ID NO: 21539 - protein, 59 aa, Artificial Sequence
  Synthetic
SVVEELLKRVRERLEDVDRVLRTWLEEVERLAEEVKRLDRELEKDVKRILDTIEELKRQ

SEQ ID NO: 21540 - protein, 55 aa, Artificial Sequence
  Synthetic
DKALEDIKRLLEELRKRVEDVSRRVNKLLRDLEENSKRVNDELRKRVETLVERVR

SEQ ID NO: 21541 - protein, 61 aa, Artificial Sequence
  Synthetic
REIEKVLKELRDIVRELEKLLEDVVRKIRKIVEETRKLLEDVVRESDKIHRDAKELMERAG

SEQ ID NO: 21542 - protein, 56 aa, Artificial Sequence
  Synthetic
EDELRKRIAELAERVKRMVKKLDEHAKRDFRRVEEEVRRLRENVKRVKDEVDEAVR

SEQ ID NO: 21543 - protein, 61 aa, Artificial Sequence
  Synthetic
SEIEKVLEELRRRVEELEERLKTVVDELKKIARRTEEKLDKVREEIERIYREAKDLLRRAG

SEQ ID NO: 21544 - protein, 56 aa, Artificial Sequence
  Synthetic
SDELRKAIAELERRVDKMLKELRDHITRDEDRVRRILEELRRHVERSLKRVREEVN

SEQ ID NO: 21545 - protein, 62 aa, Artificial Sequence
  Synthetic
SELEKVLEDVERRLRELKERNDRVLEEITKIHEDAKRENDEVLKEISRAHKEATEELERKIG

SEQ ID NO: 21546 - protein, 56 aa, Artificial Sequence
  Synthetic
LEELRRKLKELEERSERHLEELRRSAETVLRESREHLRRLEDSLRRVRKKVKEETD

SEQ ID NO: 21547 - protein, 62 aa, Artificial Sequence
  Synthetic
SEIETVLRDVKDKLEKLKRDNDKVLDEITKIHEEAMRRNDKVLEDIRRALEELKKRLEEKIG

SEQ ID NO: 21548 - protein, 56 aa, Artificial Sequence
  Synthetic
LEELKKELKKLEDESRKHLEELRRSLEEVTRRSDKHLKELKDRLEELRRKVEAATD

SEQ ID NO: 21549 - protein, 62 aa, Artificial Sequence
  Synthetic
SELEKVLEEIRRELEKLERANKKVLDDAKRIHDKAKEDLRRVLEEIKRRLEELEKRLEEAIG

SEQ ID NO: 21550 - protein, 56 aa, Artificial Sequence
  Synthetic
VEELRKELEDLRRESEEHLERLRDSARRVLEKVRRILKELRDRLRELAEEVKRATD

SEQ ID NO: 21551 - protein, 62 aa, Artificial Sequence
  Synthetic
DELETVLKRVEDLLRRLAEELRRVLEEARETLERLKAANEKVLEEITRTHEEAKRRLDRDIG

SEQ ID NO: 21552 - protein, 56 aa, Artificial Sequence
  Synthetic
VEELDKEAKDLVKEVDEILKRIREELKKLKEDNDKHLEELKESLKRVKDEVDEARR

SEQ ID NO: 21553 - protein, 62 aa, Artificial Sequence
  Synthetic
SELEDVLRDAERIIREAKEDNERVLRRLKETVEKLIKDNDEVLKKLTESHKKLTKELKDAIG

SEQ ID NO: 21554 - protein, 56 aa, Artificial Sequence
  Synthetic
VEELKEEIKDILRRNREHLEELKRRIDELRKENEKHLRDLEESIKEVEKEVRESRR

SEQ ID NO: 21555 - protein, 61 aa, Artificial Sequence
  Synthetic
SEIETVLEDAERKIRELKKRLEDVLRRLAEIYTRAKELLKRVLDELRKIYEDLKKKLEEKV

SEQ ID NO: 21556 - protein, 56 aa, Artificial Sequence
  Synthetic
VEELKKRLDEVARRVEKVLRENEEEIKESLKEVEKMLRRNRKEIKDSEKEVDDEVK

SEQ ID NO: 21557 - protein, 61 aa, Artificial Sequence
  Synthetic
DELERVLEDAETKIRDLKRKLKEVLDKLRRIYEELEERLKRVLEEIEEIYRRAAEALRRKV

SEQ ID NO: 21558 - protein, 56 aa, Artificial Sequence
  Synthetic
VEELKRELEEVAKRVEEILRRNEEEIKKSEEKIRKVLRDNREKAKRSLDRVREALK

SEQ ID NO: 21559 - protein, 61 aa, Artificial Sequence
  Synthetic
DELKKVLDDARETSDRLKKENETVFRELEEIYRRLEKELRRVLRELEEIYRRAEDKLTKSV

SEQ ID NO: 21560 - protein, 56 aa, Artificial Sequence
  Synthetic
VSELDKRIRELERRNRESVKENRDRLKESADDVKRALDRNREELEESERRVKKAVD

SEQ ID NO: 21561 - protein, 61 aa, Artificial Sequence
  Synthetic
SELEKALRDAEEIIKKAKKLLKEALDEAEKIYREAAKLLDDALREAEKIYREAADALDKKV

SEQ ID NO: 21562 - protein, 56 aa, Artificial Sequence
  Synthetic
AKELRDRAKEAADRAKRAAEENRKKARESLERAKRAAEDNRKKAEESLKRAEETAR

SEQ ID NO: 21563 - protein, 61 aa, Artificial Sequence
  Synthetic
SEIEDVLRRAKEISDRLKRENDRVLDELRRSYEDLERELEEVLRKLEETYRRAKEELRKKV

SEQ ID NO: 21564 - protein, 56 aa, Artificial Sequence
  Synthetic
VSELRERIERLKERNRKSLEKNKRDIARSEEEVRKALERNEDEIRRSEEEVKKALK

SEQ ID NO: 21565 - protein, 61 aa, Artificial Sequence
  Synthetic
RELEKVLEDIREISERLEKRNRDVLKELEDIYREAKKRLDDVLRKLKETYDRAEEELRRKV

SEQ ID NO: 21566 - protein, 56 aa, Artificial Sequence
  Synthetic
VSELRKDLRKLAEDNRRSLEENKKEITESLKEVEKVLERNKDEIRKSKERVDKALE

SEQ ID NO: 21567 - protein, 61 aa, Artificial Sequence
  Synthetic
SELERVLDEMRKIIERLEEELRKVLEDLRRIYEELKRKLDDSLRESERRVRELKEELDRKV

SEQ ID NO: 21568 - protein, 56 aa, Artificial Sequence
  Synthetic
VEELKDTIDKVKKRVEDALEKNRRDIDESRKEVDDELRKDEEKAERLAREVEKAKE

SEQ ID NO: 21569 - protein, 59 aa, Artificial Sequence
  Synthetic
SSDETVKEKVKKVARDVDRHVEKLRKALEEMEREVREHVKRLEDELRRMDEEVKRVREE

SEQ ID NO: 21570 - protein, 55 aa, Artificial Sequence
  Synthetic
EKVLRDAERIVRELERKLDKVDTEIAETVKRLEDTIRDVNRKIKDRVDKLRKELE

SEQ ID NO: 21571 - protein, 59 aa, Artificial Sequence
  Synthetic
DSDEKVKRVLEELRKEVKEHVERLRARAEDMSREVKDHVRKLKEDLERMERDVERVKRK

SEQ ID NO: 21572 - protein, 55 aa, Artificial Sequence
  Synthetic
EEVLERVRTEVERLKRELDKVNEDIRKRVEELKKELDEVDDEIRKEVDRLEEALK

SEQ ID NO: 21573 - protein, 59 aa, Artificial Sequence
  Synthetic
SSDEEVKKKLEEVKEEVKRHVERLKRALEKADRDVKDHVRRLKEVLKRMADEVEKVRRE

SEQ ID NO: 21574 - protein, 55 aa, Artificial Sequence
  Synthetic
EKVLKDVEEKIRRLEKELDEVNEDIERKVRELEKELRAVDEEIKRIVDRLRKELE

SEQ ID NO: 21575 - protein, 59 aa, Artificial Sequence
  Synthetic
SSSERVKTELDRMRKEVKRHVEELEKELKRLTEKVKRHVEESKKNAEEITRKVEDVRRK

SEQ ID NO: 21576 - protein, 55 aa, Artificial Sequence
  Synthetic
EEVLREVTREVTRLREELDEVNKRVEKRLEELERELDRSDEEVTRIVEELVDELR

SEQ ID NO: 21577 - protein, 59 aa, Artificial Sequence
  Synthetic
SSEEDVRRKLEKMRKEVDEHVRKLEEDLKRLAEEVKRHVEDLERVAKEVADRVEEVRRQ

SEQ ID NO: 21578 - protein, 55 aa, Artificial Sequence
  Synthetic
KKVLDTARDILRKLEKKLDDVDEKIERIVEKLKRELDEVNKRATETVERLIRELK

SEQ ID NO: 21579 - protein, 59 aa, Artificial Sequence
  Synthetic
RSDEELEKKLKELKEEVDEHVKRLEETARRLDKEVRRHVEESKRNLEEMDREVKEVRRR

SEQ ID NO: 21580 - protein, 55 aa, Artificial Sequence
  Synthetic
DKLLERAERTVRELERRLDEVNDRIRRIVEELKRKLDRSNEEVTRKVRELSKELE

SEQ ID NO: 21581 - protein, 61 aa, Artificial Sequence
  Synthetic
DELERVVEEVRKRIERLKEELRRVHERSREIVDRLRKELEKSLEEVRRIVEDLKRKLRERG

SEQ ID NO: 21582 - protein, 56 aa, Artificial Sequence
  Synthetic
EEDLERMADKLRKDVERAVRKNETDADKLRREVEEVVRRNKKTAKELEDEVRKELT

SEQ ID NO: 21583 - protein, 61 aa, Artificial Sequence
  Synthetic
SEREKVAKEATDIVEELKKTLKDVHRRSKEIVERLVKKLADVNKDSRDKAEELKKRLDDRG

SEQ ID NO: 21584 - protein, 56 aa, Artificial Sequence
  Synthetic
EEDVKRIAKKLEEDVRRVVRKNEEEIKKLAEEVDRVVEDNKRLVEELKRRVDEALK

SEQ ID NO: 21585 - protein, 59 aa, Artificial Sequence
  Synthetic
DADDELRKIVEEADRRSKESVREIEELLRKLEREVEDIVRRIKKLSDDTRKRIDDLRKE

SEQ ID NO: 21586 - protein, 55 aa, Artificial Sequence
  Synthetic
EEVLKRVEEIIKRLEEENRKVLEELERSVRKLEEDIRKVLEDNDRVVKELARRID

SEQ ID NO: 21587 - protein, 59 aa, Artificial Sequence
  Synthetic
SAVEKLEELVERVARRIDELVKKIKELLDDVERKSEKTVRDLERLSEETKRSIDDLRRE

SEQ ID NO: 21588 - protein, 55 aa, Artificial Sequence
  Synthetic
EEVLKRVRETLERLERKIKKVLDELKKRVEELRKKNEDVVRRNEEVVKKLVEDIR

SEQ ID NO: 21589 - protein, 59 aa, Artificial Sequence
  Synthetic
SVEDVIRDLRRVITESRELSERVLERIEETTRRSKEESKRVADKVKKSSDDLREAVERI

SEQ ID NO: 21590 - protein, 59 aa, Artificial Sequence
  Synthetic
DEKAKELLRRVKEVVDRNKEKLDRDLERNKRRIDENRRKLEEDLRRNRKVVEELRKRLE

SEQ ID NO: 21591 - protein, 59 aa, Artificial Sequence
  Synthetic
SVEDVAREIREVLRRLEESVRKVAEDNRRNNEELRRLVEEVLKRIRDSSDRLRKVVEDI

SEQ ID NO: 21592 - protein, 59 aa, Artificial Sequence
  Synthetic
DEVLERLLRRVREAVKELEDELERSSREDNRRSRELEEELKKDLKRNEDEIRDVERALK

SEQ ID NO: 21593 - protein, 59 aa, Artificial Sequence
  Synthetic
SVEEVLRRAEEILTRSKEESRRVFEEIRETTERSKEVSKDVARRNKEILDDLKRKIEEV

SEQ ID NO: 21594 - protein, 59 aa, Artificial Sequence
  Synthetic
DDVLRRLLEKIEEVVRDNERELKEDLDRNRKVIEENRKKLEDHLRRTEEEVDDIRRKLK

SEQ ID NO: 21595 - protein, 59 aa, Artificial Sequence
  Synthetic
KVEEVSKKLKDVLRELEELVERVLERNRENNERLRDKVRKVLEENKEVLDRLKKEVDDI

SEQ ID NO: 21596 - protein, 59 aa, Artificial Sequence
  Synthetic
EEDLRRLLEKIKREIDRLAKELEDSSRDDNRISRELDEELKRHLEETRRAVREISEKLR

SEQ ID NO: 21597 - protein, 57 aa, Artificial Sequence
  Synthetic
SRAEEVLKKVEEEVKKLEDELRRSSERNNRESRRLEDELKKVLDKNRKLVEDLRRAR

SEQ ID NO: 21598 - protein, 56 aa, Artificial Sequence
  Synthetic
KEVVDELRRVLERLRRVIEDVIRRNKEDTDRLEREIERVRKELKDINKKLEEDVRR

SEQ ID NO: 21599 - protein, 60 aa, Artificial Sequence
  Synthetic
DEAETLLRDVERKVEELKRRSEKLLRDVEELVRRLLRSNEESLKKVKEDLKRLKDLVRRG

SEQ ID NO: 21600 - protein, 56 aa, Artificial Sequence
  Synthetic
DEVLREVDRVIDDVRRALKKVNEEIEEVIRRLKRESERVNKEAEEIIRTLEDALRK

SEQ ID NO: 21601 - protein, 57 aa, Artificial Sequence
  Synthetic
DDLERVLEEIRREIERIRRELEESNEENKDIVRRIEEELKELLKDNKRIVETVTKAN

SEQ ID NO: 21602 - protein, 56 aa, Artificial Sequence
  Synthetic
REVLERLEKELDRLRKDIERVADENRKINDTLRKRIEEVMARLDEINTDLKDRVET

SEQ ID NO: 21603 - protein, 56 aa, Artificial Sequence
  Synthetic
SSDEVLKEIEEIIRRLEEEVRRVNKEVNKSTEDLRREVEEVLRRTNELIEELERRV

SEQ ID NO: 21604 - protein, 59 aa, Artificial Sequence
  Synthetic
EEALRKAIKDVRDIVKKVKDELKEWRDRNKELVDRLSEELKEWLKDVERVLKELTDKDR

SEQ ID NO: 21605 - protein, 56 aa, Artificial Sequence
  Synthetic
SLEEVLERIKRIIDELKREAKRVLDETNTLIREVKKRLEDVNRDVNRLIEELRERV

SEQ ID NO: 21606 - protein, 57 aa, Artificial Sequence
  Synthetic
MVRDLERRIREVVKRLKEDLERWKKEVEDEIKRLEDRLKEWLDRVREMLEKLREEDR

SEQ ID NO: 21607 - protein, 56 aa, Artificial Sequence
  Synthetic
SSEEVLKTIKDIIDELRKEAEEVLRRTNESTKELEERAEEVNKRVNDSTRELAKKV

SEQ ID NO: 21608 - protein, 59 aa, Artificial Sequence
  Synthetic
EEMLDEVKKRAEKVVEDLRRELRKWLEDNKRLVEKLEKELRDWLKENKELVKELEDRDR

SEQ ID NO: 21609 - protein, 56 aa, Artificial Sequence
  Synthetic
SSEEVLDTLRKLIEDLRRRAEEVLERTNRSTDELRKRVEKVLEETNRLIKKVEDDI

SEQ ID NO: 21610 - protein, 59 aa, Artificial Sequence
  Synthetic
EDMLREALERIKEIIDRLERELEEWIKTNEDLVRRLTEDLERWLRTVAEILKRLKDEDD

SEQ ID NO: 21611 - protein, 60 aa, Artificial Sequence
  Synthetic
DELERVEEEIKKLSDDSRRVIEEVRRRLEESNKDLERRLREVEKRLKELTDDIKRTAERN

SEQ ID NO: 21612 - protein, 59 aa, Artificial Sequence
  Synthetic
RELLRKLLDDVRRVVERNKRKLRKDLEDNKREIERVKREADKDLEDHERVIRKLKEDIR

SEQ ID NO: 21613 - protein, 60 aa, Artificial Sequence
  Synthetic
DELERVVEEIRELSRDSERAIEEVRRELKRTNDENRESAKRVAEELKKLTDKIKEEADRN

SEQ ID NO: 21614 - protein, 59 aa, Artificial Sequence
  Synthetic
RELLRELLKEVRRVVEENKRRLEEDLKKNRKKIDDSNKELRKDLEDHRRVIEKLEREIR

SEQ ID NO: 21615 - protein, 58 aa, Artificial Sequence
  Synthetic
DELEKVKEDIKRLLDDVRREVEKVNRDSRRLLEDLRRVVKEVSDRSKELAEDLERKVG

SEQ ID NO: 21616 - protein, 56 aa, Artificial Sequence
  Synthetic
VEDVLREVKRLAEEVKKETKRVLDEIKKLVEDVARELERILEDSERLIREVEKRAT

SEQ ID NO: 21617 - protein, 58 aa, Artificial Sequence
  Synthetic
DEIEDVLRRAKKLLDDLRRVVKKANDDSRRLLKKLKDKVEEVSRRSRRLAEDLERTVG

SEQ ID NO: 21618 - protein, 56 aa, Artificial Sequence
  Synthetic
VEDVLREVRKIIEDVKRASEKILEESRKLIEDVERRLEEILKRSEDLIRTVKERKR

SEQ ID NO: 21619 - protein, 60 aa, Artificial Sequence
  Synthetic
DELERVLEEIKRLLDDVHRESKRVNEESERLVKKLHDDSRRVLTEIKKLLDDVRRVVEEL

SEQ ID NO: 21620 - protein, 58 aa, Artificial Sequence
  Synthetic
EKVEEILRRVRELVKKWKTELERALEENEREVERWKRDLDRILEEVRRVVERVEREIR

SEQ ID NO: 21621 - protein, 59 aa, Artificial Sequence
  Synthetic
DELEKLLEDIRRELKRVREDDKRHNDKVKETLDRVRELIKRLLELIKKVADEIRSLKRR

SEQ ID NO: 21622 - protein, 58 aa, Artificial Sequence
  Synthetic
REVEEVKRRIEEILKEAEETNRRSHEKAKRVLEELKDIVRKVLEELRRLLRELEEEVR

SEQ ID NO: 21623 - protein, 59 aa, Artificial Sequence
  Synthetic
EELERLREEIKKILDEARERDETLLREIRREHEKNKRADEEHNRRVEETLERIERLAER

SEQ ID NO: 21624 - protein, 58 aa, Artificial Sequence
  Synthetic
EEVRAVERELRKILDEIRKTNKEVHDRIRELLERSKRSNDESHKKVEDVLRELKKRVD

SEQ ID NO: 21625 - protein, 59 aa, Artificial Sequence
  Synthetic
SETDEVRKELRKLLEDSRRAVEEVKKKLDDSNKEVRDRVRRIREELKKLEKEVREIKRK

SEQ ID NO: 21626 - protein, 55 aa, Artificial Sequence
  Synthetic
EELLKELEEVLKRLRELHKRTIDEVEKSAREVKDEIRRLEEELDRVLKKLEDALR

SEQ ID NO: 21627 - protein, 59 aa, Artificial Sequence
  Synthetic
SLDEDVERLIKELKDEARKLNEEMKEYVRDSERKVRRLNEEIRRLIEELKRKAEELKRG

SEQ ID NO: 21628 - protein, 55 aa, Artificial Sequence
  Synthetic
DRVKERLERVLDEAEKSNEETLRELDDVSRRIEESNRRTLAELEKVLRDIEKDVT

SEQ ID NO: 21629 - protein, 60 aa, Artificial Sequence
  Synthetic
SELEKLVEDLRRAAKESHERNEKLLDESRKTVEDVKRKLEEILRRSEEVVREIKKKKKDI

SEQ ID NO: 21630 - protein, 55 aa, Artificial Sequence
  Synthetic
EEVRRRVEKLIEENRRSSRRVEEEDKRLLKELKDAIKRVEEEDKKLVEELRRSEK

SEQ ID NO: 21631 - protein, 60 aa, Artificial Sequence
  Synthetic
KEVEDLVKEVKERIEESHKENKRILDKARRVVERVETDLRRILEESKRTVEDIERRKERI

SEQ ID NO: 21632 - protein, 55 aa, Artificial Sequence
  Synthetic
EEMKKAVDELIERNKRSSDRVREEAKKLIDRLEEVIEKVERDDEKLVRDLEEELR

SEQ ID NO: 21633 - protein, 61 aa, Artificial Sequence
  Synthetic
SSLETLEKIARDLLREVKETLDRVREESRRLLEEVRRVAEESRKEVERLLKELEEVIRREV

SEQ ID NO: 21634 - protein, 59 aa, Artificial Sequence
  Synthetic
DELLRELAERVRRVVKKIKDELRDDLRRTREEVERLKERHKELVKRVKEAVDKIREEIR

SEQ ID NO: 21635 - protein, 60 aa, Artificial Sequence
  Synthetic
KEVEEILRDVARLVEDNRRVLERILREVEKLIRDNEERLKEILERSKDLVRRIEELIRRG

SEQ ID NO: 21636 - protein, 55 aa, Artificial Sequence
  Synthetic
EEVRRAIEELLKDVERAYEEVVRRIEKLLDDLRRKYEEVKKENERLNRRVEEAAR

SEQ ID NO: 21637 - protein, 60 aa, Artificial Sequence
  Synthetic
DDVEDILRDVERLVEENRRRLEEIVRESEDKVRKNDETLKKILEDVKREVERVERAIERG

SEQ ID NO: 21638 - protein, 55 aa, Artificial Sequence
  Synthetic
KDVVRAIEELLKDVEEKYRRVSERNKELNKRVEDTYREVMKEIRRLLERVDRRAR

SEQ ID NO: 21639 - protein, 57 aa, Artificial Sequence
  Synthetic
TEVERLVERVKEIVEEHRKKLEELARRSEELVERHEKKLRDLLRESRELVERAKKEN

SEQ ID NO: 21640 - protein, 54 aa, Artificial Sequence
  Synthetic
EIKERLKELLREAEEVSRRVNKRNEDLLRRLEKVSREVNERNEDLLEELDRTVN

SEQ ID NO: 21641 - protein, 56 aa, Artificial Sequence
  Synthetic
DEVERLVEEVEKLVEEWIRDLERILDESRRTVEEWKKELKRLLDRSKRLVEDAKRK

SEQ ID NO: 21642 - protein, 54 aa, Artificial Sequence
  Synthetic
DIERRLERLMEELHRVSKEVLDADRELLKELHDVSREVNKRNEELLDELRKTVT

SEQ ID NO: 21643 - protein, 57 aa, Artificial Sequence
  Synthetic
DEVEETVKRVREEVERWKEELKRIADEVRRLVEKVKDDLRRLLDESRKLVEEVRREN

SEQ ID NO: 21644 - protein, 54 aa, Artificial Sequence
  Synthetic
EIKRRLEELLKELHKVSKDLDKILEELLREVEEVVRRVNETNKKLLKELDETVR

SEQ ID NO: 21645 - protein, 57 aa, Artificial Sequence
  Synthetic
SEVEELVKRAAELADEARKRLERIMEEVKRLVDEWEKELKKLLDESKELVEKVRREN

SEQ ID NO: 21646 - protein, 54 aa, Artificial Sequence
  Synthetic
KVREDLRRLLDTLRKVVEELKRRLRELLKKLHDVSRKVNEENERLLRELEETVR

SEQ ID NO: 21647 - protein, 57 aa, Artificial Sequence
  Synthetic
DEAEKLVDEVRELVRRHKETLKEILERVKELVKRWKDTLDKLLRDSEELVRRVKEEN

SEQ ID NO: 21648 - protein, 54 aa, Artificial Sequence
  Synthetic
RVKEELKRLLKELKEMSKRLTEELRRLLKELHDRSREVNERNKRLLEEVDRTVK

SEQ ID NO: 21649 - protein, 56 aa, Artificial Sequence
  Synthetic
DEIREVEERNRRSNEEMKKAVREVEKDIERVAREIRKRAEEVSKRNEDINREIRKT

SEQ ID NO: 21650 - protein, 59 aa, Artificial Sequence
  Synthetic
DETLRRVIRKSEELLKRLKDRLDEVRKRVEEILKRAEERLREVIKRSEELLEEVKRESD

SEQ ID NO: 21651 - protein, 56 aa, Artificial Sequence
  Synthetic
SLLEEVEKTLRKIVEDSDREIKRVSKKNKETVKRLEELMREVNRRSTEIVKRIRDS

SEQ ID NO: 21652 - protein, 59 aa, Artificial Sequence
  Synthetic
KEMLDRIIEEAKRLHEENKRKLEEVERRSEELLKELKRRLEELIKRNDDLLREVEERKR

SEQ ID NO: 21653 - protein, 60 aa, Artificial Sequence
  Synthetic
DEVEEVIRRAEELVKEVKKRLEELIRESEALLERVKRRLERLIEESRRRLEEVKKKVSSG

SEQ ID NO: 21654 - protein, 54 aa, Artificial Sequence
  Synthetic
EIKKRLRKLLEEIKKVVDDVRETNKRTLERLEELARRVNEENKKILDDLEEAVR

SEQ ID NO: 21655 - protein, 60 aa, Artificial Sequence
  Synthetic
KEVDEVVKRAEDLLREVKKRLDEVIEDSERLLREVRKRLEEIIRESEKLLEDVRKVVERG

SEQ ID NO: 21656 - protein, 54 aa, Artificial Sequence
  Synthetic
EIEKRLEEILREIKKLVEEVNRRNEDILRRLEREVEKVRRVNEKTLERIEETVR

SEQ ID NO: 21657 - protein, 60 aa, Artificial Sequence
  Synthetic
SLVEDIRRDVKRILKEIDKLVKDIEEENRRASRESERLVETIRREVKEVLDRIRKLVRDV

SEQ ID NO: 21658 - protein, 59 aa, Artificial Sequence
  Synthetic
RKLIEEIRRRLKKALEDIRRLIEESRKRVEESLTRSRKLAEDIRRELEDVLRKVDEDAK

SEQ ID NO: 21659 - protein, 56 aa, Artificial Sequence
  Synthetic
SRVKEVADRVRDIVRRIKDEIKEHVDRLRDVIRRIKEKLEEHSRRLREIVERIRAS

SEQ ID NO: 21660 - protein, 59 aa, Artificial Sequence
  Synthetic
EELLKRLEDIIRKLLEDIKRVVKELEEVSRTLLREIEELLEENRKSMEKLLRDIEEEAR

SEQ ID NO: 21661 - protein, 56 aa, Artificial Sequence
  Synthetic
SKVDEVVKRLEDAVREIKKEIDKHSKELADEVEKIKKELKDVSDRNREVVRRIREA

SEQ ID NO: 21662 - protein, 59 aa, Artificial Sequence
  Synthetic
EKKAEELRKRVDDLLEEIRRLLEENKRTVDKLLDEIKRVLEDHRRSVEELLREIDKDAK

SEQ ID NO: 21663 - protein, 56 aa, Artificial Sequence
  Synthetic
SEVDEVLREAKRIVDEVHKDNERATEESRRLVKKVHEENEEMVKDIERIVKEVKDA

SEQ ID NO: 21664 - protein, 55 aa, Artificial Sequence
  Synthetic
KELEREVEKLLKRIEESLRRHRKENKRLLEELDRSLRELAKIVKEVLDEIRERTR

SEQ ID NO: 21665 - protein, 56 aa, Artificial Sequence
  Synthetic
SEIEDAVRRIEKRVEEVHRENKKLTDESRKLVREVDEENKKVSRESKKLVEDARRR

SEQ ID NO: 21666 - protein, 55 aa, Artificial Sequence
  Synthetic
RELSEKVREVLEKIKKSLEDHRKANEDLLREIRDSLKKHRDENRRLLKELEETRK

SEQ ID NO: 21667 - protein, 57 aa, Artificial Sequence
  Synthetic
SDLDRVAKELTEIVERIIRELERLTEKSRDIVRKVHKENEDAVRKIRKIVEEVKRKK

SEQ ID NO: 21668 - protein, 55 aa, Artificial Sequence
  Synthetic
RELEKRVRDLLRRVEEALRRHKEENRKLLEDIKRSLEEVAKEVERVLKEIKDTAR

SEQ ID NO: 21669 - protein, 57 aa, Artificial Sequence
  Synthetic
SEMDDVLKKLAETVKRIIERLKKLTDDSRRLVEEVHRRNDKLSKESREAVRKAEERN

SEQ ID NO: 21670 - protein, 55 aa, Artificial Sequence
  Synthetic
RELSEEVKKLLDEVRKALKRHKDENDKLLKEIEDSLRRHKEENDRLLEKLKESTR

SEQ ID NO: 21671 - protein, 57 aa, Artificial Sequence
  Synthetic
DEAREILKEIRDIADELRKRLERLTERSERIVREVDKENRRVVEEIREIVERVKKAK

SEQ ID NO: 21672 - protein, 55 aa, Artificial Sequence
  Synthetic
RELKKEVERVLEEIRRLLEEHERANRKLLKEIRDSLRELKKRVEEVLREIKEATK

SEQ ID NO: 21673 - protein, 57 aa, Artificial Sequence
  Synthetic
SEAEEMLERIKRRVEEVNKENKKMTDESKKIAEDVDRDNREVLREIKRIVDEVRKRN

SEQ ID NO: 21674 - protein, 55 aa, Artificial Sequence
  Synthetic
KELEKEVERVLKEIKDSLRRHRKENEDILREIKESLDELDKEVKRVLKEIRDTAR

SEQ ID NO: 21675 - protein, 57 aa, Artificial Sequence
  Synthetic
SELEEVAKELRKTLEDSTRENKKHTDDVRRIVDEVDKRNRKAVEDIRKIVDEVRKRK

SEQ ID NO: 21676 - protein, 55 aa, Artificial Sequence
  Synthetic
RELEEIVKRLNERDKEVLEKDAEDVKRVLEEIKESLERVARDVERVLEDIKRATD

SEQ ID NO: 21677 - protein, 61 aa, Artificial Sequence
  Synthetic
SALEDLERKVEELIRRLDELLREHRETLERLIRELDKLLTDHHRRNRELLERIKDVVRKAG

SEQ ID NO: 21678 - protein, 59 aa, Artificial Sequence
  Synthetic
EDKLRKIVEELERLVDEVRRSLEKASKRLKDLVKEVKKRLEDITRESEELVRRVEERTR

SEQ ID NO: 21679 - protein, 61 aa, Artificial Sequence
  Synthetic
SALEELKKEIKRVIEELKRALERHHKENEELRKRIDEVLKEHHDANRRLLEEIKELVRRAG

SEQ ID NO: 21680 - protein, 59 aa, Artificial Sequence
  Synthetic
EEKLKEIVKEIRKKVEELKDDLRRMSEESRRLVEELEERLRRLTERSKRLVEDVRRRVT

SEQ ID NO: 21681 - protein, 56 aa, Artificial Sequence
  Synthetic
SEKEELDRKIEDVRKKVEETSRKLKRVNDESKKEVKRTSDELRKKSKEVNEAVERE

SEQ ID NO: 21682 - protein, 56 aa, Artificial Sequence
  Synthetic
VEEAIRRLKETLDRHREEVEDLIRKSREVLKRHEERVRELIKRHEDTLRELKKRAK

SEQ ID NO: 21683 - protein, 60 aa, Artificial Sequence
  Synthetic
SEVDELMKRLKDEAEDIKEKVERLIREWEEAARKIAERVEKLVRDWERVIETLRDLKKRV

SEQ ID NO: 21684 - protein, 59 aa, Artificial Sequence
  Synthetic
KDLAERLRRVLREVERLVRTVNKKHREVLEEIRKEVERVNDEHRRVLEEIKRRVEKDVK

SEQ ID NO: 21685 - protein, 60 aa, Artificial Sequence
  Synthetic
SAEEKLDTEVRRIAEEVKRIIDELRKVTEEVEKRIREINKTSEDTSREVKKTIREVLKRL

SEQ ID NO: 21686 - protein, 59 aa, Artificial Sequence
  Synthetic
EDTVEEVLERLRRALEKADKLVKDHIKRLKDVLRAIEEDHRRHLERLRRMLEEIKKEVT

SEQ ID NO: 21687 - protein, 60 aa, Artificial Sequence
  Synthetic
SVEEKLTREAERLLKRIEEVIRRLRDANRRSADRIRRIDEKTRREVEKLKKKIRELAKRV

SEQ ID NO: 21688 - protein, 58 aa, Artificial Sequence
  Synthetic
DLVEKVIKTMRKIVEDLERDVRKVIRDDEELVERLRRENEEVIKKLREIVKRLEDETR

SEQ ID NO: 21689 - protein, 60 aa, Artificial Sequence
  Synthetic
SLIERLREVAEDLKRRIRKVLEDLRRANEESAKRIRDIDRRTREANRESNERIKEIAKRV

SEQ ID NO: 21690 - protein, 58 aa, Artificial Sequence
  Synthetic
EKVKKVIDDMERIVREIEEKIKRVIERDKKLVKKLEEDNRRVIKKDKDLVRRLEERTR

SEQ ID NO: 21691 - protein, 57 aa, Artificial Sequence
  Synthetic
SLKERLRDDAKRLLDEDRKVLEDLERRAKEINDRNEEIVKKLRDKVREILERIDREV

SEQ ID NO: 21692 - protein, 59 aa, Artificial Sequence
  Synthetic
EEVIRRILEELRELVERSERTVRDIERELDELIDKSRRDVEEIIKDLERELEELKRKTK

SEQ ID NO: 21693 - protein, 57 aa, Artificial Sequence
  Synthetic
RVREELEKAAEEVRRRDRRVLEELEKEVRRINEDNKRVHETSREVVERILETIDRRV

SEQ ID NO: 21694 - protein, 59 aa, Artificial Sequence
  Synthetic
EDVIRKIVRELEELVRESKETVDDIIRRLEELIRKSREDNRKIVEELKKLLDDLTREEK

SEQ ID NO: 21695 - protein, 57 aa, Artificial Sequence
  Synthetic
SLKETLEEVVKRVLETDKRLLEKNDRTVREVNERNRRVHEESRRAVERILEEIDREV

SEQ ID NO: 21696 - protein, 59 aa, Artificial Sequence
  Synthetic
EDTIRRIAKEADDLLEDSRRKVEDNSRRLKRLLEESKKSNEEIVRRLEDLLRRLKKESE

SEQ ID NO: 21697 - protein, 57 aa, Artificial Sequence
  Synthetic
SLKEELEEDVKRINDRNEEVLKRLREVAKKLLDDDRKLLKELKKVVEDVLRDVDREV

SEQ ID NO: 21698 - protein, 59 aa, Artificial Sequence
  Synthetic
AEVIKKILEELEKLIKDSEDTAREIIKELKELVERSKRKVEEILKELEDLLEELKRRAD

SEQ ID NO: 21699 - protein, 57 aa, Artificial Sequence
  Synthetic
SMEEKAEEVIKEVDEENKRLIEEAEKVIEDVEREDRRLVDELRKVIEKVERTIERDL

SEQ ID NO: 21700 - protein, 59 aa, Artificial Sequence
  Synthetic
KDVIEEIIERLRRHVEDSEEKIRRIIRRLEEVLKRSKEDIERIIEELERLLDEMRERAR

SEQ ID NO: 21701 - protein, 58 aa, Artificial Sequence
  Synthetic
DMDRKLKEEIKRAERRDKELVKDIERVIEEVLRANKELIERIEKVIDDVRREIEKRLK

SEQ ID NO: 21702 - protein, 59 aa, Artificial Sequence
  Synthetic
KDVIEEIIERIKDILRESEREIRRIIKELREHLKKSADRIEKIRRELERLLEKLEDDAR

SEQ ID NO: 21703 - protein, 61 aa, Artificial Sequence
  Synthetic
SEIEKILRELEEHIKDSEREHRELVERLRDHIRRSKEEHRDLIRKLEERIREVERRVRKDG

SEQ ID NO: 21704 - protein, 59 aa, Artificial Sequence
  Synthetic
KELKDRLKRVSEEHKRRIEDLLRRTKRVSERHREEIRKLLETTERAIKKARETIERLRK

SEQ ID NO: 21705 - protein, 61 aa, Artificial Sequence
  Synthetic
SEIDRLLERLEDHIRKSAKRHRDLVEELREHAERLKRDIERLLEELEKTVRDIEKEVRERG

SEQ ID NO: 21706 - protein, 59 aa, Artificial Sequence
  Synthetic
EDMKRKLEKVSEEHERKIKELLDRTKRASEEHDERVKRLLDELRRVLKEAEERLRELKR

SEQ ID NO: 21707 - protein, 61 aa, Artificial Sequence
  Synthetic
ERIDRIIKELEDLVDESRKRNDDLVRELKKHIKESKDEHDRLVEELDRFVEEVRKRVEKDG

SEQ ID NO: 21708 - protein, 59 aa, Artificial Sequence
  Synthetic
EDAIRKLEDVLRKVRETHERLLDKSRDVSRKHREDIKELLKKTKTVIDRVRKRIKELRK

SEQ ID NO: 21709 - protein, 60 aa, Artificial Sequence
  Synthetic
SEVERIEEELRREIEKVDRDNKKIVDEARRSIDELRKDVEDILRDLRRLVDEVEKMARRG

SEQ ID NO: 21710 - protein, 59 aa, Artificial Sequence
  Synthetic
EELLKRVEDVVDEVRKRLERIDEKTRKAVKEVTDRNDELLKRVREVVKEVRARLEEIRR

SEQ ID NO: 21711 - protein, 56 aa, Artificial Sequence
  Synthetic
SEKEKVDKVVKKVAKRIKDLLDEIKRVADESNERLERLLRRLEEASKRSKKKLKDD

SEQ ID NO: 21712 - protein, 56 aa, Artificial Sequence
  Synthetic
VDTLIKELEDRIDEVEKRIRELIERDKRLVEEVERRIAELIRRDERLVEELKKREE

SEQ ID NO: 21713 - protein, 56 aa, Artificial Sequence
  Synthetic
SEKEKLKDVVRDVERLIKELMERLERVHERTNREITRLLEDARRAMERSNKKLTDL

SEQ ID NO: 21714 - protein, 56 aa, Artificial Sequence
  Synthetic
VDDLLRRLKELIERVRKLIEDSIKELRDIVKEVKDRIKTLIERDKELVKRLEDRAR

SEQ ID NO: 21715 - protein, 57 aa, Artificial Sequence
  Synthetic
SEVDKLVRDLERHIEEAKRRVEELLKEIKKLVEDTKREAKKLLDTLRKKVEDVEREN

SEQ ID NO: 21716 - protein, 59 aa, Artificial Sequence
  Synthetic
EEMLRKMREVSERHKKTIDELRKELKKVLDEWRRRSEKIFEELDEVLKRVEERVKEVER

SEQ ID NO: 21717 - protein, 57 aa, Artificial Sequence
  Synthetic
SEVDELVRRLREHIRRAKERVEELIKRIKTLAKETTDRARKLIEDLKRHIDDARRKN

SEQ ID NO: 21718 - protein, 59 aa, Artificial Sequence
  Synthetic
REVLKKIKEVSDEHRKEIERLRKRLEEVLREWEDTSREVLERLKEVSKRHRDEIREVAR

SEQ ID NO: 21719 - protein, 57 aa, Artificial Sequence
  Synthetic
SEMEDLIRRLREHIEDVRRKVEELIRELEDHIRRAEESVKKREDDLRRHIEEVRKRN

SEQ ID NO: 21720 - protein, 59 aa, Artificial Sequence
  Synthetic
KEVLDEARRVSKEHKDTLEKLLRKAEEASERHKREIERLLKELKEVSEEHRRRIDEVRR

SEQ ID NO: 21721 - protein, 55 aa, Artificial Sequence
  Synthetic
SEVEELIEDLKRHLKEVADRVEELERELRKHLEEHHRRVREIIRRLEDLLRKAEE

SEQ ID NO: 21722 - protein, 59 aa, Artificial Sequence
  Synthetic
EDLKRRIEKVSRDHERTVEKLVRDLERVSREHERTVKENKERIKKVLDDARKRVDEVKK

SEQ ID NO: 21723 - protein, 59 aa, Artificial Sequence
  Synthetic
SEVEKLVRELEDVLRKIERKVRELSKDNKRVLDENKKRVEDVSRDNERAMREIEELRRK

SEQ ID NO: 21724 - protein, 55 aa, Artificial Sequence
  Synthetic
EELKKVLEDVKREVEKLLEEIKRSLEEARKTVKESNDEIRESLERLEEKVRRIEK

SEQ ID NO: 21725 - protein, 59 aa, Artificial Sequence
  Synthetic
DEVKDLVKRLEEVIKRIDEVVKEVDRRNREVLERNRELVERSIRELREVLDRIRRRKKD

SEQ ID NO: 21726 - protein, 55 aa, Artificial Sequence
  Synthetic
SELDKVLEDVKRKVEEILRRIKRSLDEVERDVRRSNEENKKVTKEVREAAEEIKR

SEQ ID NO: 21727 - protein, 59 aa, Artificial Sequence
  Synthetic
DEVEELVRRLREVLEEIRELVERVNDRNRRVLEENRELVTRSIEELRRALERIERLSKD

SEQ ID NO: 21728 - protein, 55 aa, Artificial Sequence
  Synthetic
EKLKKVLEEVERRAKKLLRDIEESLRRVAREVERSNEENKKVTKEVADAVREIER

SEQ ID NO: 21729 - protein, 57 aa, Artificial Sequence
  Synthetic
DEEKKARDVLERWRKRSEDLLRKAEDVLREWRERSERSFKRLRDVLEEARKRVEELN

SEQ ID NO: 21730 - protein, 55 aa, Artificial Sequence
  Synthetic
DELVREIEEVVKETEKRVEELIKEIREMVKKNEREVREIERRLEETLEKIDRDRK

SEQ ID NO: 21731 - protein, 57 aa, Artificial Sequence
  Synthetic
SEEEEIEKALRDWREELKRLLETIERLLREWKRRVEELKKRIEEALKELKKILDDKG

SEQ ID NO: 21732 - protein, 56 aa, Artificial Sequence
  Synthetic
VEEVKKKLEKEIKKNRENVDRLRRRLEEEVKRNERSVEEIKRRLDEIARELDERKK

SEQ ID NO: 21733 - protein, 57 aa, Artificial Sequence
  Synthetic
SEDEEIKEALKEWRDEVRRLEEKIRRVLEKWERDVRRLKEEIKKSNEDLRRRLEEKG

SEQ ID NO: 21734 - protein, 56 aa, Artificial Sequence
  Synthetic
VEEVKKRLKRLIEENRKNVKRLEERIREAVKKNEKSVEDSERENRDIARELDEKRK

SEQ ID NO: 21735 - protein, 60 aa, Artificial Sequence
  Synthetic
EEVERLKERLERLSERSKEIAKRVHEENKKLSEESRKLVEDVHRENEEAAKRLEDVARRN

SEQ ID NO: 21736 - protein, 59 aa, Artificial Sequence
  Synthetic
RELLERLRRVLEEHREVNERILEEIKRSLDEHKDTNRKLLEEIEKSLRDLEEIVRRLEK

SEQ ID NO: 21737 - protein, 60 aa, Artificial Sequence
  Synthetic
REIEEIEKEVRDVSKESEDIVRTVHDENRRASERSRELVKRVDEENRKAVEDLERVAREN

SEQ ID NO: 21738 - protein, 59 aa, Artificial Sequence
  Synthetic
DELLRRVRKLLEDHKRVNERLLEEIEKSLKRHREENERLLEEIRKSLEDVERVVEEIKR

SEQ ID NO: 21739 - protein, 60 aa, Artificial Sequence
  Synthetic
SELEELEKRLRKAVRDLEEIVDRVRKDLERASDDSRRIVEEVHRENRKVAKELKEVRDRN

SEQ ID NO: 21740 - protein, 59 aa, Artificial Sequence
  Synthetic
EELLEALERLLRELEKIVRKLLRELEEMLRRHEKTNRELLERIRRSLEELAKIVEDLET

SEQ ID NO: 21741 - protein, 60 aa, Artificial Sequence
  Synthetic
DEIEEIKKELDELSKRSEKIVRDLERELREASKESERLVRKVHDDNRKALEELRDVRRRN

SEQ ID NO: 21742 - protein, 59 aa, Artificial Sequence
  Synthetic
DELLKEVRRALEEHERVNRELLERIRRVLEEHKRVNEELMREIDRSLKELAEIVKRLKD

SEQ ID NO: 21743 - protein, 60 aa, Artificial Sequence
  Synthetic
DELEELRKELKKMVDEIEEIVRRVDKENRDASRESEELVERIVEEVRKAVTELKELKKRN

SEQ ID NO: 21744 - protein, 59 aa, Artificial Sequence
  Synthetic
DELLKEVRKALERLKEEVKRVLEDIRRSLEEHRKVNERALRRIEEVLRDLERIVEEVKT

SEQ ID NO: 21745 - protein, 60 aa, Artificial Sequence
  Synthetic
SEVERLKDELRKASEELKKEVEEIEKRLREMSERSRKLVEELKRTLKEIEKELKDIVRKD

SEQ ID NO: 21746 - protein, 59 aa, Artificial Sequence
  Synthetic
DRLKEEVERVLREHEKSLERLRERLKELLERHHKTNEELLREIKEALERLEKIVKDLTD

SEQ ID NO: 21747 - protein, 60 aa, Artificial Sequence
  Synthetic
DEVEDAERRLREMSERIEDLVRRVEERLRRMSEESKKLVEDVKRENDKSVEELDRIVRRD

SEQ ID NO: 21748 - protein, 59 aa, Artificial Sequence
  Synthetic
DRLKERLEKLLRDHRRSVEEVIKKLDRLLKEHHKVNEKLLRDIDKSAKEVKKVVEDKTR

SEQ ID NO: 21749 - protein, 60 aa, Artificial Sequence
  Synthetic
SEVEEAEKELREMSKTSTRLVEELEERLRRASETLKKLVDDVKRELDKRLEDIDRRVARN

SEQ ID NO: 21750 - protein, 59 aa, Artificial Sequence
  Synthetic
DRLKERVDRLLEEHHKVNKRLLERIEEVLRRHETTLRELIKEIDKLLRDLKKRIDDVKK

SEQ ID NO: 21751 - protein, 60 aa, Artificial Sequence
  Synthetic
DEVREVKKELKKIAEELRKLIEEVREELRKMSKRSEELVRELKKRNEKSVRDLERIVRKD

SEQ ID NO: 21752 - protein, 59 aa, Artificial Sequence
  Synthetic
DKLKEELKEALKDLERELKELIEELKRLLDEHHKRNEDLLREIDKSVRKVEEDVRRLKK

SEQ ID NO: 21753 - protein, 60 aa, Artificial Sequence
  Synthetic
SEVDEVRKELERLVREIKKLVEDSKRNLDRLSKELEERVRDLERDARRLVKELRDLLKEN

SEQ ID NO: 21754 - protein, 59 aa, Artificial Sequence
  Synthetic
KEVRDDVRRLIREVDEELKKAKEDLDRAHEEHEKSTERLRERIKEVVDRVREDIERTKN

SEQ ID NO: 21755 - protein, 56 aa, Artificial Sequence
  Synthetic
DEERRIEKVLKEWEKRTRDLARELERVNREHKKTSEDVLKKLEEINREVRRVVKEE

SEQ ID NO: 21756 - protein, 56 aa, Artificial Sequence
  Synthetic
VEKLRRLIEEVIREDERRVERVKRNNKRLSEETEKLVEDVRRNNERLVKEVRDRSR

SEQ ID NO: 21757 - protein, 56 aa, Artificial Sequence
  Synthetic
SEEEEIKKVLDEWRRRTEELRKDLDRVLEEDRRSVEEVKRRLDKVNEELRRRIDEL

SEQ ID NO: 21758 - protein, 56 aa, Artificial Sequence
  Synthetic
VERAKEEIKKVIKEDEDLVRRVRKYIEENSDELRRLVEEARKNNTRIAKEAEDTSR

SEQ ID NO: 21759 - protein, 56 aa, Artificial Sequence
  Synthetic
SEKEEIDKVLKEWEEMTRRLVEELKKSHDEDRESVKRLLERLRDVNRELKEIIDRA

SEQ ID NO: 21760 - protein, 56 aa, Artificial Sequence
  Synthetic
VEKAKETVRKVIKEDRDLVREFKKYNEENSDRMRKLVKDIKENNRRIVEEARERSR

SEQ ID NO: 21761 - protein, 56 aa, Artificial Sequence
  Synthetic
SKEEKLREALKKVRKDVKDLERHIDRSVKRNKEEVDKAKRELERSLEELRRRLEEL

SEQ ID NO: 21762 - protein, 56 aa, Artificial Sequence
  Synthetic
VEELLERLERTLRRMREKVRKLDKENKDHTEKVKEDVKRVHDENDKVREDVDRKDK

SEQ ID NO: 21763 - protein, 60 aa, Artificial Sequence
  Synthetic
REVEELVKEIERVLEETKKRSEDTKREVEKVLEDTKRLVERLRKTLEELLRELDKRVRSG

SEQ ID NO: 21764 - protein, 59 aa, Artificial Sequence
  Synthetic
EELRRTLEKVLREWRDVNRKVNDTDRKVLEDWERVNRTVNEELKEVLERAKEDIDRVAT

SEQ ID NO: 21765 - protein, 60 aa, Artificial Sequence
  Synthetic
DEVERLVEEIKKRIDETRKLLEELKKRIRKVLEETKDLVRRLLKRLRELLKELEERRRRG

SEQ ID NO: 21766 - protein, 59 aa, Artificial Sequence
  Synthetic
EELRRELKRVLDEWKKANDEVRRAMEEILKEWEEVNRKVNKDLRDVLEEVKERLREVAK

SEQ ID NO: 21767 - protein, 60 aa, Artificial Sequence
  Synthetic
SEVEKLKKRLRDLLEELKRLSRRTKEDVRRVIKETRDRSKKTKEELEKLLREIRELRKRG

SEQ ID NO: 21768 - protein, 59 aa, Artificial Sequence
  Synthetic
EDLRTEIKKILEEVKREIDRVRETDEKVLRDWKKANDEVRETDREVLRKIREDLKEVAR

SEQ ID NO: 21769 - protein, 57 aa, Artificial Sequence
  Synthetic
RERETIEKVLDENRKSLEEVTETVKRVLDRWDETLKRLEEEVRRVNDKTRKVLEDLL

SEQ ID NO: 21770 - protein, 56 aa, Artificial Sequence
  Synthetic
VKELKKRVKELSEKLREVLEELERRVREIVKRNKETVDESRKRNEELIKRAEDAAK

SEQ ID NO: 21771 - protein, 60 aa, Artificial Sequence
  Synthetic
SEIDEVRKRVEKHSRDAKRLVDELREKNDRAIKTLERLLRELEKRNKKVIRDLEDVRTKN

SEQ ID NO: 21772 - protein, 59 aa, Artificial Sequence
  Synthetic
EDMVRELRRVLKENDESVRRLKREIEEVHKETERVVKEVLEEIRRVDEELKDVARKVET

SEQ ID NO: 21773 - protein, 60 aa, Artificial Sequence
  Synthetic
REIEEVIKELKRHSEELEKELDRLRRENKEAIRTSKKLVEDLRRENTRAKEELEDVKREN

SEQ ID NO: 21774 - protein, 59 aa, Artificial Sequence
  Synthetic
ERALERLRRVVRENEESVERVLKKIDDIHEETKRVSDRSEKEIEDVDRDLKRKVEEVEK

SEQ ID NO: 21775 - protein, 63 aa, Artificial Sequence
  Synthetic
REREKIKRILDELRKRVEELNRRNEELLRRLDKVVRDVNRTNKRLLEKLRKVADDVRRKLKDE

SEQ ID NO: 21776 - protein, 56 aa, Artificial Sequence
  Synthetic
VDKVERTVEEIEKELTRLVEESEKEVKRIIEELKELLERSRKSVEDIIREVRKLAE

SEQ ID NO: 21777 - protein, 60 aa, Artificial Sequence
  Synthetic
SEEEKLDRLLEELKKVAEEVNRENEKLLEDLERVVRDLNEKNKAALKKLEDAVRRLKEAI

SEQ ID NO: 21778 - protein, 56 aa, Artificial Sequence
  Synthetic
VDRVEERLREIIKTLRKLLEDSKESVRKIIEELKRLVDRSIEDLERIIKELEDKVR

SEQ ID NO: 21779 - protein, 60 aa, Artificial Sequence
  Synthetic
DRERRIETVLRKLKKVVEEVNRRNEKLLDDLRKVVTRLLEEDRRLLEKLRRAAERLKEEL

SEQ ID NO: 21780 - protein, 56 aa, Artificial Sequence
  Synthetic
VTRVKEKIEKIIEELKKLLKDSKKRVEEIIRELEKLVDDSRREVEEIIKELKDRSR

SEQ ID NO: 21781 - protein, 60 aa, Artificial Sequence
  Synthetic
DMREELERILKTLRDVSRESRRELKRLLDENEKTIREVKKRVDEILEKLRKVIDDVRRQG

SEQ ID NO: 21782 - protein, 59 aa, Artificial Sequence
  Synthetic
KKVVDEVDKEIRELIRKDEEIVKEVAERVKKNSEDLRRLLEKARREIEEIIKELEERRR

SEQ ID NO: 21783 - protein, 60 aa, Artificial Sequence
  Synthetic
DEDEIVRDVIRRLDEVLKKLEKTNTELDEELKRVVEELRKVNRTVDEELKRVLDELAKRI

SEQ ID NO: 21784 - protein, 55 aa, Artificial Sequence
  Synthetic
DKLVKDLKRVLDKLEESSRRMLKKLSDALRELEKSSDKVVKDLRKVLKELREEVK

SEQ ID NO: 21785 - protein, 60 aa, Artificial Sequence
  Synthetic
DEDERVEELLRELEEVLDRLAKLNKKLDERNKEVAEESKRLNETVDRELKEVLKRLEEKL

SEQ ID NO: 21786 - protein, 55 aa, Artificial Sequence
  Synthetic
SELVERIRRELERLKRSSEEVVKKLTEELKKDKKSSEEVVKDLRRALRELERAVD

SEQ ID NO: 21787 - protein, 60 aa, Artificial Sequence
  Synthetic
SELEKVKEDIRRLLKRLKEDIKRIKDEIDRLLEELKRHLKEVEEEVDRILEELKDLKRRG

SEQ ID NO: 21788 - protein, 55 aa, Artificial Sequence
  Synthetic
EKLERVKEDVERVLEEYRKRSEDLARRVEKVLREYKKRSDELEKRVEDVIKEVAD

SEQ ID NO: 21789 - protein, 60 aa, Artificial Sequence
  Synthetic
KELEEVARKIDEELKKLDKNIRDIADEIRRILEELEKDLREIEKRIRDILRRLEDLKRRG

SEQ ID NO: 21790 - protein, 55 aa, Artificial Sequence
  Synthetic
DELKTVEDKVRKALREYEEKTRKVKKDVDEVIKKYKTDSDRVLDEVEKALREVER

SEQ ID NO: 21791 - protein, 59 aa, Artificial Sequence
  Synthetic
RVEEKLKRVSDELKRAVDESNKKIEELLERLKRVHDETNKEITEILRELKEVVDKARED

SEQ ID NO: 21792 - protein, 59 aa, Artificial Sequence
  Synthetic
DELVEDIERKIEELIRRDDDLVRRAEEEVEKSIRELRRLVDEVRKEIKKIVKKIEDDVR

SEQ ID NO: 21793 - protein, 60 aa, Artificial Sequence
  Synthetic
SREDKARELLRELEKVDDDHRRRVRELLERLKKVLEDHRRAVKDIIKRLDDELKRIKEED

SEQ ID NO: 21794 - protein, 55 aa, Artificial Sequence
  Synthetic
EEVAKEVKDIVREVEDHLRRVEEEVRRIIREVEEHIRDLERRVRELLEELKRRSK

SEQ ID NO: 21795 - protein, 60 aa, Artificial Sequence
  Synthetic
SEEEKVRRLKEELRRVIEKHKKDVKEIEDRLREVDDRHRREVKKLIEELKKVLEDAKRRK

SEQ ID NO: 21796 - protein, 55 aa, Artificial Sequence
  Synthetic
EEVAKRVKEIIEKVERHITEVKKRAEELVEEVERHIRELKKRVEDLVEEIERDTK

SEQ ID NO: 21797 - protein, 61 aa, Artificial Sequence
  Synthetic
DEKETAEELLRRIEKVIKRLEDTMRKLNKKLKEAIERHHRTAKKLLDDIERVIREVEKDRG

SEQ ID NO: 21798 - protein, 56 aa, Artificial Sequence
  Synthetic
REELEDDVRRIIEEIDRLLRESEEDHEDLIRRLKRSLEELKRLAEDIIRKLSEDRK

SEQ ID NO: 21799 - protein, 61 aa, Artificial Sequence
  Synthetic
REKEAAKRILDRIEKVIRDHHREAKRLNDELEKVIREHHETVKELLKRIKEVIDKFKKDKG

SEQ ID NO: 21800 - protein, 56 aa, Artificial Sequence
  Synthetic
VEELEETARRIIEKLKKSLEDSKRDHERLKKEIEDSLKRLTELVKKIIEEIERDRK

SEQ ID NO: 21801 - protein, 61 aa, Artificial Sequence
  Synthetic
DEDEEARRLLEEIRKVIEEAEEEAKRLNERLRRVIKEHHRKVKELLDEIERVIEKVLRARG

SEQ ID NO: 21802 - protein, 56 aa, Artificial Sequence
  Synthetic
VDELRERVREIKEKLRKDLKDSEDDHRRMEEEIKKSLERLERLVREIIKDLEEKLR

SEQ ID NO: 21803 - protein, 61 aa, Artificial Sequence
  Synthetic
KDEERAKRLLDEIERVIRRHHKTARDLNRELERVLKEHHDTARKLLEDIKKAIDDLKRTRG

SEQ ID NO: 21804 - protein, 56 aa, Artificial Sequence
  Synthetic
AKELEDKVKEIIDRIEKSLEESDKNHKKLIRELEKSLDDLRREAKEIIDDAREKAK

SEQ ID NO: 21805 - protein, 60 aa, Artificial Sequence
  Synthetic
SAAERAEEVLRKLRESLERHKKVNKDLLEEIERSLREVAKDVDRVLKDIKRVLDELKRRR

SEQ ID NO: 21806 - protein, 55 aa, Artificial Sequence
  Synthetic
DEVEELVRRVHRENEKFSKESEDLVREVHERNKELVKRIRKILEDATRELEKAAK

SEQ ID NO: 21807 - protein, 60 aa, Artificial Sequence
  Synthetic
DMKEEAEEVLKEIEEVLKEHRDINRRLLEEIKKSLEDLSREVERVLDEIRRLLKRAVEER

SEQ ID NO: 21808 - protein, 55 aa, Artificial Sequence
  Synthetic
EEVRKIVEDLKKRLKELSEKSERIVRKVHRDNERVVREIRDIVRRLKKRLEDATR

SEQ ID NO: 21809 - protein, 60 aa, Artificial Sequence
  Synthetic
SAKEKVDEVLRRIKELLDRHKKVNEEILEEIRRSLEEHREVNERLLETIDRLLKELKRSR

SEQ ID NO: 21810 - protein, 55 aa, Artificial Sequence
  Synthetic
EEVEEIMRRAEEELRKLSKESRELVKRLHERNEEMSRRSKKIVDEAKKELEDAER

SEQ ID NO: 21811 - protein, 60 aa, Artificial Sequence
  Synthetic
SAEEELDRLEKELDKLLKEHHEENKRLLEEIDRVLKEHEETLRRLIKELREVLKEVKEKL

SEQ ID NO: 21812 - protein, 56 aa, Artificial Sequence
  Synthetic
VEKLREDVERVKRELEDLTRKSEELVKRLKDTLRRVSEELKRRVDEAKKEAREVER

SEQ ID NO: 21813 - protein, 60 aa, Artificial Sequence
  Synthetic
SAEEELKRLLEENERVTEEHHKRNRDLLRRIDEALRRHEKTLEDLIRELDRVLRELERRL

SEQ ID NO: 21814 - protein, 56 aa, Artificial Sequence
  Synthetic
VDDLRRIIEESRRRHEELTKESEKLVREVEDILRRLSEELAELVKRVKDKLDEDAK

SEQ ID NO: 21815 - protein, 60 aa, Artificial Sequence
  Synthetic
SAEETLKRLAERIRKLLEEHRETVKRVIDRLDKVLRDHHRENKRLLEDIDRVLRRLEESL

SEQ ID NO: 21816 - protein, 56 aa, Artificial Sequence
  Synthetic
VEDLDRRVKEVERRLREMSKTIEKLVKDIERELKEASEESRELVERMKRELTEAEK

SEQ ID NO: 21817 - protein, 60 aa, Artificial Sequence
  Synthetic
REIEEILKEIEKSLRDLEEEVRRILEEIKKSLEDLRESMERIVEEVDRRLRTLKEVFDRG

SEQ ID NO: 21818 - protein, 59 aa, Artificial Sequence
  Synthetic
DRVRRIIEKLEEDLRRVNKKIKETLEEAAKRLEDADREIEKILRDLARKIRKVLEEIKK

SEQ ID NO: 21819 - protein, 60 aa, Artificial Sequence
  Synthetic
SEVEEIERRIEKSLKELRERLEEAEKRHEELLERLEREIDRIEKELRKDLKRLRDMTRRG

SEQ ID NO: 21820 - protein, 59 aa, Artificial Sequence
  Synthetic
ERVKKEIDRLEKRLEEVNEEIKKRLKELAERSRRVLERIKDRIRRAAEELKRVLDEVRT

SEQ ID NO: 21821 - protein, 60 aa, Artificial Sequence
  Synthetic
SEIEEILKRLKELLKELKERNEDILRRVEKSLKDLRKKLEEIVRDLRRLLEELREMVKRG

SEQ ID NO: 21822 - protein, 59 aa, Artificial Sequence
  Synthetic
DRVREIIKTAEKELEKALRTSEDIDRRLEERLEKVNKEIREELRRAEEEIKRVLEEVKR

SEQ ID NO: 21823 - protein, 60 aa, Artificial Sequence
  Synthetic
DELDRIRKEVKRISDKNRRHVERLDEEVRKLLEELRKHLEDLTREVERLLRELKEVKKEG

SEQ ID NO: 21824 - protein, 59 aa, Artificial Sequence
  Synthetic
EEMRTKVEELRKRLEESLEEHKRAADELRKRLKKVLEEHEKRVRELEEELRRVLKEAED

SEQ ID NO: 21825 - protein, 60 aa, Artificial Sequence
  Synthetic
DELEELRKLVEEISRENREHLKKLKKLVEDLSRENEKHLRDVDKRVKELLEDLERLTRRG

SEQ ID NO: 21826 - protein, 59 aa, Artificial Sequence
  Synthetic
EDVERELRRLKKELDKSLKEHRTTLERLEEELRKSNKEHRDRVKELREELEKVLRDAKR

SEQ ID NO: 21827 - protein, 59 aa, Artificial Sequence
  Synthetic
SMLDEARKEVKELKDRVERASEKLEDNARRNVEKLERVSEELEREVKRLLDEIEEVKRR

SEQ ID NO: 21828 - protein, 56 aa, Artificial Sequence
  Synthetic
EETLKELERRIREVLKKHDKTLRDLERRIREVNKRHKDVSDRLAERIKKVIRELER

SEQ ID NO: 21829 - protein, 59 aa, Artificial Sequence
  Synthetic
DKEKELEREVDELLKRLEEHSKRVDKTVEDVHRRNEEALRDMERKVREVVEKLKEVKER

SEQ ID NO: 21830 - protein, 55 aa, Artificial Sequence
  Synthetic
EEVDRLRRELREVLKRNRESVERAEEKLKKSVKELDERVKELEEELDRALDELRK

SEQ ID NO: 21831 - protein, 60 aa, Artificial Sequence
  Synthetic
SEVEKLERDVRELHKDNKRHSDELDREVKKLLEELRRALEELKEKVERLTRRLEEVKRRT

SEQ ID NO: 21832 - protein, 55 aa, Artificial Sequence
  Synthetic
KEVEELKRRIDRSVEENEDSIRRLKEEIKRIVDEVRRVVEKLIKEIKDAVKKLRD

SEQ ID NO: 21833 - protein, 59 aa, Artificial Sequence
  Synthetic
DELEELKRRVEELEERNKDHSRKMRETVERVKERLDRHSKEMEKEVRKVVEDIKDVKRK

SEQ ID NO: 21834 - protein, 55 aa, Artificial Sequence
  Synthetic
REVDELKKEIERADKENKDSIEELERELDRVLKENEKSIRELEKELDDVLDEADK

SEQ ID NO: 21835 - protein, 57 aa, Artificial Sequence
  Synthetic
SEAEKLLEENRRELEKVKRDAERLNDEIRERLKEIEDKLKTLNDEIRKLVKEMEDRN

SEQ ID NO: 21836 - protein, 56 aa, Artificial Sequence
  Synthetic
EEILRTIADDNRRVLEEIKKIIKHSRDELERVKRDIDRIVKHSVKLLEDVLRRLRK

SEQ ID NO: 21837 - protein, 60 aa, Artificial Sequence
  Synthetic
DEEEIVKRIEDDARRIIEEVKEVLRRIRDLNERILREAEEVLKEIREINRKVLEDLRRDG

SEQ ID NO: 21838 - protein, 55 aa, Artificial Sequence
  Synthetic
ERVLKRLRDELDKLREDLERILRRNKKLLDELRELLERSRRENEKLVEELKRKAK

SEQ ID NO: 21839 - protein, 59 aa, Artificial Sequence
  Synthetic
SEAERIEEEVKKLLKDVKKKLEELKESSKRVVEELDKVLKELKESSDRLAKEIKKALDD

SEQ ID NO: 21840 - protein, 56 aa, Artificial Sequence
  Synthetic
KDVLEKLRELVKRLIDDLRRVVEELEETNERLDRKLEDVLKKLRETNEKTLRELRK

SEQ ID NO: 21841 - protein, 59 aa, Artificial Sequence
  Synthetic
SVREDLKRVVEDIRRIVKEVHERNREASKRSEDLVREVHERNERIARELKKIVDDLRRV

SEQ ID NO: 21842 - protein, 56 aa, Artificial Sequence
  Synthetic
RRVLEEVRKEVEKVLREIEKSLRDHERENKRLLEDIERSLRELEKTVEKLKRDIRR

SEQ ID NO: 21843 - protein, 59 aa, Artificial Sequence
  Synthetic
SAREALKEAVKEIERIVREVHDRNRRASERSEKIVRDVHRRNKKLTDESKDLVDKARRI

SEQ ID NO: 21844 - protein, 56 aa, Artificial Sequence
  Synthetic
KRVLEEVAKRVEEVLKRIKDSLEEHRRVNDKLLKDIEKSLRDHERANEKLLEDLRK

SEQ ID NO: 21845 - protein, 57 aa, Artificial Sequence
  Synthetic
DELEELLKRIEDVIRRVEELLDELLERHRKVSKESNERLEELLRRHEKVSEEVKREN

SEQ ID NO: 21846 - protein, 59 aa, Artificial Sequence
  Synthetic
EEVEKRVREVLKEIEDRAREVEKRARDSVRRNREELERLERDVRRSLKKLRDDLERMRR

SEQ ID NO: 21847 - protein, 61 aa, Artificial Sequence
  Synthetic
SKVEKLLEDIKKLVKEVSDKIEELLKRLHEVVREIAKAVRDLIRENKRVVDDIVKKVRERG

SEQ ID NO: 21848 - protein, 59 aa, Artificial Sequence
  Synthetic
KEAEDDARRIIEEIERLLREVKKYIEEHIKRLRTVLKKLAEDSKKHLDELRELLRRLEK

SEQ ID NO: 21849 - protein, 61 aa, Artificial Sequence
  Synthetic
SELETLLTDVERLLDESRRVAERVLKEVKELLDEWEKRHKELADRIRELLRRVEEEMKRAN

SEQ ID NO: 21850 - protein, 60 aa, Artificial Sequence
  Synthetic
DEEVRREATDLRREIKEHTDEVEKKLEELAREIEELLERSERSAEELRKEIEKLLEEIRR

SEQ ID NO: 21851 - protein, 60 aa, Artificial Sequence
  Synthetic
SEIEKLLEDFKKRIEDIKRRLERYLEEVRKRVEKVKRELERALEESKRTVDEVKKEIDRA

SEQ ID NO: 21852 - protein, 55 aa, Artificial Sequence
  Synthetic
DEVRKEIRKLLDDIRRVVEKVKRDNERLNRDLNRRVREVIRESEKLNKRLEEAVR

SEQ ID NO: 21853 - protein, 58 aa, Artificial Sequence
  Synthetic
SESETLEKELKELKEEADKLIEDIRRRLEEVARRVERNVTESERTLEELLRRAREKKK

SEQ ID NO: 21854 - protein, 55 aa, Artificial Sequence
  Synthetic
RRVKEEVKRVLEEIERALRTVLKEVRDLLKRLEELHREVLDKNRRVLKAISDEAK

SEQ ID NO: 21855 - protein, 60 aa, Artificial Sequence
  Synthetic
SEDEKVKKDLDELRDRVRKNIERIRRKLKKLLDEARDNVRRSEETLRRLARRVEKIKKDK

SEQ ID NO: 21856 - protein, 55 aa, Artificial Sequence
  Synthetic
RSVKEELRRVLEDLKRLHEEVSKRVEDALREMKELHDRVLKRNKDVLRELKERAQ

SEQ ID NO: 21857 - protein, 60 aa, Artificial Sequence
  Synthetic
SLEEIVKDILRRIKTKADEIKEKVDRSLREIEELVKEIKKEVDDSLRDIERVAEELRREG

SEQ ID NO: 21858 - protein, 55 aa, Artificial Sequence
  Synthetic
ERLLRDVRRILEELRDLVRRLHEDNKRLDEDLNRKVEKLKRDNEDLNKKMRDRAE

SEQ ID NO: 21859 - protein, 60 aa, Artificial Sequence
  Synthetic
SEKEEADKKLKKVMDDLREILRRLLETLKRVIERSEEVLKRLDDRNREVLEEIKRAIERL

SEQ ID NO: 21860 - protein, 56 aa, Artificial Sequence
  Synthetic
EKEAEETVRRMKELVDRIRKKAEEDVKKLREDSKRTADRSKKNVEDLKRRLDELAK

SEQ ID NO: 21861 - protein, 59 aa, Artificial Sequence
  Synthetic
SEIEELVRRLERKLEEHKKMVDKYREDLKRTLDRVNELSKDYIKKLRDILEKAERLVRR

SEQ ID NO: 21862 - protein, 55 aa, Artificial Sequence
  Synthetic
EDLRRIAERVLREAHRTAKDLHRDSERVREEIKKSVDRVHEESERVLREIRKLKK

SEQ ID NO: 21863 - protein, 60 aa, Artificial Sequence
  Synthetic
SIEEEVRKIVDDIRRSSEELEKSVKRVVEEIAESSKEEKDRVKRNIEEIRKEIDKLRRDG

SEQ ID NO: 21864 - protein, 59 aa, Artificial Sequence
  Synthetic
KDVLEKLKRLLDKVVRDSEDVIRKLEERLKKVVDESKEVLKELEELHERVMREVEETIR

SEQ ID NO: 21865 - protein, 60 aa, Artificial Sequence
  Synthetic
KIEEDIRRELTKILDKLRKLLEKAKKNVEDIERSSRDLKRRVDETIEKIKDELRKLERDG

SEQ ID NO: 21866 - protein, 59 aa, Artificial Sequence
  Synthetic
EEVLERAERELRRVMKEVEKVLREIEELHRRVAETSKRVIDELRRLLEKVFKEFEDAVR

SEQ ID NO: 21867 - protein, 61 aa, Artificial Sequence
  Synthetic
SEVDEDLKRLEDRVREYEDRVREDIRRLEEDLKRLRKRIEDSIEEMRRTLEEVKEDVRREG

SEQ ID NO: 21868 - protein, 59 aa, Artificial Sequence
  Synthetic
RDRLTKLREVLERLEKRIREIDEEIKRVLERVEKEIRDALRKIEKVNEDVEKALRDILR

SEQ ID NO: 21869 - protein, 59 aa, Artificial Sequence
  Synthetic
SLEEEIEKVIRKLKEVVERINERNKRALDKLRKVVEEVKDALRRTNEELKKVVKEVERR

SEQ ID NO: 21870 - protein, 59 aa, Artificial Sequence
  Synthetic
KDDVRRLKREIEELIKRIDDKIRKLIRRHEELVREIREELKKHEERVKDVLRKLEKLAE

SEQ ID NO: 21871 - protein, 57 aa, Artificial Sequence
  Synthetic
SEVEKLKKEADEESERNKDEVRKLEKESKENADRIRRHLEEHLKRSDENVKRVKDAK

SEQ ID NO: 21872 - protein, 55 aa, Artificial Sequence
  Synthetic
EEMLRRLEELLRENKKRNKEVLDRDRELLRELDEEVDDVLRRDKELLEELERRLK

SEQ ID NO: 21873 - protein, 61 aa, Artificial Sequence
  Synthetic
SEVDEVLERIERLADDNRRKAETVLRKIARLLEELKKHSEDVNRKIKELVKELEDEVRRAG

SEQ ID NO: 21874 - protein, 59 aa, Artificial Sequence
  Synthetic
RELLERVLRRVEKKSEDHKRKLEEAERRVDKNREDHERRNEELLRRVEERVEDVKRRIK

SEQ ID NO: 21875 - protein, 60 aa, Artificial Sequence
  Synthetic
DEVKEVLKRIKDLLDELRRHSEKVNRDVERLLEELARNSEKVNREIRRLLDDLRRLVEEK

SEQ ID NO: 21876 - protein, 59 aa, Artificial Sequence
  Synthetic
RDDLERILREVDKKIKDLKRENERMLEEVERNAKEHKDRDREELKRVKEDLDRLRERLR

SEQ ID NO: 21877 - protein, 58 aa, Artificial Sequence
  Synthetic
KDAEELEKEVERESRKNEESIRRIREEVDKLSKDNDRKLKEIEKEVEDLRRRVDERRK

SEQ ID NO: 21878 - protein, 55 aa, Artificial Sequence
  Synthetic
EKLLDKIRKVVKENEERMDKLLEDIERVVRENIKKNKEVLERARRVIERLEEKIK

SEQ ID NO: 21879 - protein, 58 aa, Artificial Sequence
  Synthetic
DEDKKLEKDVRDKSEDNKRRLEEIKKKVEDASRENERKIEEIKRRVEEKAEEVDRARK

SEQ ID NO: 21880 - protein, 55 aa, Artificial Sequence
  Synthetic
EELLKTATELVTRNRTENERVLREAERVVKENLRRMDELLKDIRRVIEELERRIK

SEQ ID NO: 21881 - protein, 56 aa, Artificial Sequence
  Synthetic
EEVERSLKKLEDDIRRIERELEEMVRKSKREIDKLVRDLEEMLKDSRRKLEKLRKD

SEQ ID NO: 21882 - protein, 56 aa, Artificial Sequence
  Synthetic
EEAIRELERLLEELLRKIEEVIKDLRRLNKELDEEIKRVIDEARRLNKELEDDLRR

SEQ ID NO: 21883 - protein, 60 aa, Artificial Sequence
  Synthetic
SKVEKILKDIKRLLDELRKKLKEVKDRLDEINEELRETLKRSLDRNRKINEELKDKLRRR

SEQ ID NO: 21884 - protein, 55 aa, Artificial Sequence
  Synthetic
DEVLKRVEEEIRRLEEELDRTLERSKREVEKIKREIERTNRESERAVKEIDDRER

SEQ ID NO: 21885 - protein, 61 aa, Artificial Sequence
  Synthetic
SKDEEVLKTLRRILEELRDVHRRNLEDNKRITDRLREIHERNLRDNRRITKELEEVARRDG

SEQ ID NO: 21886 - protein, 55 aa, Artificial Sequence
  Synthetic
DEKREEVKKEVDETRERNERKNRRSREDVKRVEDRNRDANRKSRKEAEDVKRRLT

SEQ ID NO: 21887 - protein, 61 aa, Artificial Sequence
  Synthetic
SKVEEVLKRLREILKELEEVHKENKDDVKRILRDLEKTHKDNLDDNRRITEKLKRVVERDG

SEQ ID NO: 21888 - protein, 55 aa, Artificial Sequence
  Synthetic
DEEREKVERRAKEARDRNKRKNERVKEEVKRVKDRNKKKNDESKETVRKIEEDAT

SEQ ID NO: 21889 - protein, 57 aa, Artificial Sequence
  Synthetic
SDSERILKDIEDKLREIKKRSDDNRRRLEKENREVEKRVREILRRIEEENKDVERED

SEQ ID NO: 21890 - protein, 55 aa, Artificial Sequence
  Synthetic
EKVKRDLEEALKTLRKVAEDNKKSLRESLETVKKLLEDLERELRKSAESVRRKMK

SEQ ID NO: 21891 - protein, 57 aa, Artificial Sequence
  Synthetic
SESEELLKRAEDEVRKVEKKSRDNERRLREKLKKAKEDLDRIDEDIKRLNKELEDRN

SEQ ID NO: 21892 - protein, 55 aa, Artificial Sequence
  Synthetic
ERLRRELERILEELRELVRRNEEELKKIMKRVREEVEKLLRKLEKSLESVDRKVT

SEQ ID NO: 21893 - protein, 60 aa, Artificial Sequence
  Synthetic
SRDEKAERMVREVEKKIKELIDRNRRVTEKVKEDIKRLIEDLERVTRDVSRAIKELARRL

SEQ ID NO: 21894 - protein, 55 aa, Artificial Sequence
  Synthetic
EEDDKRIEEDLRKLEEDSRRYDEDLKRELERLRKEVEEYKKRMREELRRLKEEAD

SEQ ID NO: 21895 - protein, 60 aa, Artificial Sequence
  Synthetic
SELERATKVVKRVADRIAELIRENARVTKRVADESRKLLEETETVTREVMRAIEELLKRL

SEQ ID NO: 21896 - protein, 55 aa, Artificial Sequence
  Synthetic
EEDLKKLEDDLKRAADESKKYDDDLRRKLDELRRRHEEYKERLKEMLKRLEDETR

SEQ ID NO: 21897 - protein, 60 aa, Artificial Sequence
  Synthetic
SELEDARRVVKRVADRIKRLIEENERVTKEVKEASEKLLKDTKDATRRLAKEVKELVKRL

SEQ ID NO: 21898 - protein, 55 aa, Artificial Sequence
  Synthetic
EKDKKRLEEELERLRESSERYDERLKRELERLEEEHRRYIRRLKEELDKLREDTD

SEQ ID NO: 21899 - protein, 60 aa, Artificial Sequence
  Synthetic
SEVEELIKDIRRHNTRLEKRMREILEDLKRHLKRSEDKMRKLVKELKELLDRLRDIARDG

SEQ ID NO: 21900 - protein, 59 aa, Artificial Sequence
  Synthetic
EKLLKELEDVIRENEKRSRDIARTLEKALEELRKASKELIDTARDILRKVLEDVDRLRQ

SEQ ID NO: 21901 - protein, 57 aa, Artificial Sequence
  Synthetic
SEVETSAERLKREVEKHHKEVEEYIRRLEEELKKMTRDVERALEKIKEDVDRLRKEQ

SEQ ID NO: 21902 - protein, 59 aa, Artificial Sequence
  Synthetic
EELLKRLRDVLEEVSRRIKDNLEELKKVSERLKRRIEELIRRLEKVMRDVRRSAEEIKR

SEQ ID NO: 21903 - protein, 57 aa, Artificial Sequence
  Synthetic
KEVEEDIERLKRILEKHHKDIERAIRRLEEKLKRLEDKLRKYKRDLEEEVARLKDEQ

SEQ ID NO: 21904 - protein, 59 aa, Artificial Sequence
  Synthetic
EKVLRRLKEVLREIEERIRRNKEELDKALERVKRTIERLIRELEKLSERLKRIADEIAR

SEQ ID NO: 21905 - protein, 57 aa, Artificial Sequence
  Synthetic
DEVDEIVRRLRETVDRHHKRIKEAIEKLKEEVKKHHREIEEYIRRLEEEVKRLADEQ

SEQ ID NO: 21906 - protein, 59 aa, Artificial Sequence
  Synthetic
RKLLEKLDRVLKKLEEDIRRNKEALDRALREAEKSLTDNIKELRDVSREIAERIKEITR

SEQ ID NO: 21907 - protein, 60 aa, Artificial Sequence
  Synthetic
DEKEKVIEDIKELLKELEKKLEDIIREIEKELKRNDEENEESRRRIEDMLRRLEELKRRS

SEQ ID NO: 21908 - protein, 55 aa, Artificial Sequence
  Synthetic
EDVDRVLREAERRVREILKELEEVLRRAEERSEENLRSAEKVLREVEKRLKELTD

SEQ ID NO: 21909 - protein, 60 aa, Artificial Sequence
  Synthetic
SEEERIIKRIKETLEDLKRKLDRIREEIERDIRRNNKKNEDSIRDIERMLRELRRLFEES

SEQ ID NO: 21910 - protein, 55 aa, Artificial Sequence
  Synthetic
KELKEVLEEAKKTVDKILRDLEELLRRAEEESRRNLREAEEVLKKVREDLERLAT

SEQ ID NO: 21911 - protein, 60 aa, Artificial Sequence
  Synthetic
SEEEEVIKEIKDALRDLRRRAEELMKELRELIRENNERNKESEREIRRLLDRLRDLKRRS

SEQ ID NO: 21912 - protein, 55 aa, Artificial Sequence
  Synthetic
EEVKRVLDDAKRAVEEILARIKELLDEVRKASKENLERAEELLRDVERELDRLTK

SEQ ID NO: 21913 - protein, 56 aa, Artificial Sequence
  Synthetic
SEVERLIEDIRRANEELNRKSERKSRESKKENDRLNRESDKKSRDSERVLEELRRR

SEQ ID NO: 21914 - protein, 59 aa, Artificial Sequence
  Synthetic
EELVRRLDELLKESETNVRDNKRRVRDNLRRTEENARRNLEKVKKNVRKIDKVIKEIET

SEQ ID NO: 21915 - protein, 56 aa, Artificial Sequence
  Synthetic
SEVDETARKLDEDLKRLEEEVRRTSKESEDENRKLNETSKRESDESKRRLDELRRK

SEQ ID NO: 21916 - protein, 59 aa, Artificial Sequence
  Synthetic
ERVLRKLKDLVEKVKRVIEKLVKELEDNVKKTKDNARRNKREIEENARRIREEIKKLED

SEQ ID NO: 21917 - protein, 56 aa, Artificial Sequence
  Synthetic
SEVEKEADEVRRTNEELNRRSEETSRRSEEDLRRLEEKVRRASKKSEDDLRRLKRE

SEQ ID NO: 21918 - protein, 59 aa, Artificial Sequence
  Synthetic
EEMVKRLRDVVKRSRENIEENKRRIEDNLRRIDEVIRRLIEELRRNMRRIEEEIERIRR

SEQ ID NO: 21919 - protein, 59 aa, Artificial Sequence
  Synthetic
SEVEREIERLEEDLDRLRREVDEAHKRSKKKLEELRKEVEDYEERVKEELRRLEKLVRE

SEQ ID NO: 21920 - protein, 59 aa, Artificial Sequence
  Synthetic
EEVRERLERALRKAEKDVKRLEDELKRSLKEVRETVRELEERLREVNERVEELLDRLRK

SEQ ID NO: 21921 - protein, 62 aa, Artificial Sequence
  Synthetic
RVEDRVRDLIRKHDETSREIEKRIRDSIKRLADVLDKIRKAIDDLIRKLREAVEDLLRKIGK

SEQ ID NO: 21922 - protein, 59 aa, Artificial Sequence
  Synthetic
EKEVEDLARKIEKLNEDLRRRLEKLDKENKDVIRRLEDALRRLAEEIKRLIDELRERAR

SEQ ID NO: 21923 - protein, 56 aa, Artificial Sequence
  Synthetic
KDEDRLRDDIRRAIEEIEEKLKRLKDRNKEHIERLKKRNEDLNRRNRDVVRRLRER

SEQ ID NO: 21924 - protein, 55 aa, Artificial Sequence
  Synthetic
EELEKLREDLRRVIERVEREIRRSSEENRRVVKKSVDNIRDSLRKNEDVIRKLRK

SEQ ID NO: 21925 - protein, 59 aa, Artificial Sequence
  Synthetic
DVEKKIKDLARELREVIDDARRKNRKLHEDAREVSERHEKAVRDLTEELKRVIDELRKR

SEQ ID NO: 21926 - protein, 59 aa, Artificial Sequence
  Synthetic
EDMLREVEKRVKEEIKRIKDDLDEVRKRHEKKVRDIRKHLKELEDRIKKTEKDLREEAR

SEQ ID NO: 21927 - protein, 59 aa, Artificial Sequence
  Synthetic
RVEEEIERLSRDLKRVIEKAKRDNDRLHKEVRKASEDHKRENKRLHEDVKRVIEELRKR

SEQ ID NO: 21928 - protein, 59 aa, Artificial Sequence
  Synthetic
ERMLKKLEDEIEETKKDIEREIREIDKRHKDAVKELRDHIRELAREHEEEKKRLEETAR

SEQ ID NO: 21929 - protein, 59 aa, Artificial Sequence
  Synthetic
RVEEEIRRLLEESERVHKELEDINRRLHEKVDRVSKKHREENKRLHEKLKRAIDRLREK

SEQ ID NO: 21930 - protein, 59 aa, Artificial Sequence
  Synthetic
EEALKKLEKEVKDNERKLREEARRVEEEHEKTVRDLKKHLDELREEHDRILEELERTRK

SEQ ID NO: 21931 - protein, 60 aa, Artificial Sequence
  Synthetic
SDMEKRKRDIKRKLDESNKKSEEAVREVERKLDESNKEVKKKEERVEDELRKLEEKRRRG

SEQ ID NO: 21932 - protein, 55 aa, Artificial Sequence
  Synthetic
EKLKDIERELRENLKRNEDIVREILKKLEDNLRRVEKLAEDIRRKLEKVADDLRK

SEQ ID NO: 21933 - protein, 56 aa, Artificial Sequence
  Synthetic
SELEEDKKRIEETLRRLEETAKEYHRRSREELRRLEEEAKRYHEESKETLDRLRRE

SEQ ID NO: 21934 - protein, 55 aa, Artificial Sequence
  Synthetic
KKLKDIKEEVERVMKKLEDLVRRDNEESEKVLEKLKRLVERNNEDIKRALEELRK

SEQ ID NO: 21935 - protein, 56 aa, Artificial Sequence
  Synthetic
SEDEERLRRIEEELRRLEEEAREYHERSREELKKLREKAKEYHERSRRELEELRRR

SEQ ID NO: 21936 - protein, 55 aa, Artificial Sequence
  Synthetic
KRLKEITRKVEEVMKKLEKLVRDNNEEIRKVMEELKKLVEDDNEESDRALKELET

SEQ ID NO: 21937 - protein, 56 aa, Artificial Sequence
  Synthetic
DEMETRLEDVRKKLDDSRRETRKVEEDIRRTLEELRREAKKYHEDSKEELDDLRRR

SEQ ID NO: 21938 - protein, 55 aa, Artificial Sequence
  Synthetic
EKLKEIKERIEKVLRENRDVVKKIKEDVRRALKELEELVRKNNEDIKRLLDELRR

SEQ ID NO: 21939 - protein, 56 aa, Artificial Sequence
  Synthetic
SRVEEVERRVRDKSRKSKEKLRKLEEDVRRESETSRDRLRKLAEEVKTKVKELKDK

SEQ ID NO: 21940 - protein, 56 aa, Artificial Sequence
  Synthetic
SEDLKRLAKEIEDNLEELERKIREIRKELRRSLEEVEKTVEDLKRELKKVLDELRK

SEQ ID NO: 21941 - protein, 60 aa, Artificial Sequence
  Synthetic
SDIEEAKERLERKLEKLLRKVEEYLKEIADEIRRLEEELEEYNRRSKERIDRVLEVKERG

SEQ ID NO: 21942 - protein, 56 aa, Artificial Sequence
  Synthetic
ESVLKELEELLKELEDRIRKILTESTELLRRLEKRVRDSLRRNTEELDELLDRLEK

SEQ ID NO: 21943 - protein, 59 aa, Artificial Sequence
  Synthetic
SEVEKSEKKLRDEIERLVRENEKYLERIKELVEELLRELEKAVRELEKEVTEIEEVKRQ

SEQ ID NO: 21944 - protein, 56 aa, Artificial Sequence
  Synthetic
ERVLKKLRDLVKEVVDRSKRSLDESTKVLDTLEKEVRKVLEALKDILREALERLDK

SEQ ID NO: 21945 - protein, 60 aa, Artificial Sequence
  Synthetic
SREEIIKKLKEEVERLLRESAKVLEELKRRLEALLRESEEILRELRELVRTLLEKLERDG

SEQ ID NO: 21946 - protein, 59 aa, Artificial Sequence
  Synthetic
EKDLKKTEDDLKREADEHRKAVEDELRKVKKRLEEHRERVRKRLEDIEKTLRDIDREVR

SEQ ID NO: 21947 - protein, 60 aa, Artificial Sequence
  Synthetic
SSVEDLLRKAEEVVRRAEEKSRDSHEKTKDVLRKVKRKSEELNKHNRESIKKVEEVRRRT

SEQ ID NO: 21948 - protein, 55 aa, Artificial Sequence
  Synthetic
EEVLKTIEDLLRKLERKVRETIETDRRLLRKVEEELKRSIEDSRRLVDELKKRVT

SEQ ID NO: 21949 - protein, 60 aa, Artificial Sequence
  Synthetic
SSKDRLRDEIRRVVERVREISERVNKHNRDSVKRVEEESRRINKEIRKVVEDVDRMRRRV

SEQ ID NO: 21950 - protein, 55 aa, Artificial Sequence
  Synthetic
EEVLREIEKLVRDVEREVRESIERSKRLVKELEERVKKSIDEIKKEVDDVERKLK

SEQ ID NO: 21951 - protein, 60 aa, Artificial Sequence
  Synthetic
KEVEDLKEKVKRVVEEVEKISRELNKHNRDSVRRAEKTSKELNDHNKDSIRKVREVLKRT

SEQ ID NO: 21952 - protein, 55 aa, Artificial Sequence
  Synthetic
DKVLKDIKKLLKDVEKKVRESIKESKELVKRLKDKLEESIRRSKKDVEDLKREVD

SEQ ID NO: 21953 - protein, 60 aa, Artificial Sequence
  Synthetic
SSVDKLRKEIREVLRRVERISEESHKHNEESVRKVKERSERLNKHNRDSARDVERVLREV

SEQ ID NO: 21954 - protein, 55 aa, Artificial Sequence
  Synthetic
EEVLEEIRRRLEEVEERVRRDLEESKKLVDELRKRVEKSIRESRKLVDDLRKRVT

SEQ ID NO: 21955 - protein, 60 aa, Artificial Sequence
  Synthetic
SSVDKLKDEVRKVVETVKDLSRRLNETAKRVADRVRKISRETHEEVRKVVEDVKDVRRRT

SEQ ID NO: 21956 - protein, 55 aa, Artificial Sequence
  Synthetic
ETVLEELKRLLDKVREDVRRSIEEIRELLKTVEKEVRDDSRDLERLLKRVEEETK

SEQ ID NO: 21957 - protein, 60 aa, Artificial Sequence
  Synthetic
SSVDRVREEIERVARRVRKLSEDSHREVEKVLKEVEEISKRTHEEIDKVVKEVEKVIRDT

SEQ ID NO: 21958 - protein, 55 aa, Artificial Sequence
  Synthetic
EEVLEEIRRLLETVEREVKTDIDRLREELRRVEEAVKKDSEDIRRKLKRVEDDVK

SEQ ID NO: 21959 - protein, 58 aa, Artificial Sequence
  Synthetic
REAEDIVRRSHELVERAREKLRRLNKDSERLVDEVEKELREVVERVAELIKRAKDEIG

SEQ ID NO: 21960 - protein, 59 aa, Artificial Sequence
  Synthetic
EEVLEKVLRDSERVLKELEEKLRKSLEDVKRVIDEVKKVLEDVKRKVEEVLKRVRDKRR

SEQ ID NO: 21961 - protein, 58 aa, Artificial Sequence
  Synthetic
SRAEKVERESHELVRTLKEELDRVVEKVERLVRRVEEELKRVNKESAELVKELKDRIG

SEQ ID NO: 21962 - protein, 59 aa, Artificial Sequence
  Synthetic
DEVLTKLVKSSRDVIEEIREDLKRVLKEAEEVIRRVKKRLEDSLEKVKEVLRELLRAAK

SEQ ID NO: 21963 - protein, 58 aa, Artificial Sequence
  Synthetic
SSAEDVVRRSHELVRRLEEELDKVNEDSERLVREVEERLKRANEESKRRVEDAKRRIG

SEQ ID NO: 21964 - protein, 59 aa, Artificial Sequence
  Synthetic
EEVLEEVLRRSREVLKKLKEDLKRSLDDAERVIRRVREDLKRSLKRVREVLEEVRRRTK

SEQ ID NO: 21965 - protein, 58 aa, Artificial Sequence
  Synthetic
SSVDRIVEESHTRVRKLMKDLEDVNDESRRRVERLRERLEEVVKEVEKLVEELRRRIG

SEQ ID NO: 21966 - protein, 59 aa, Artificial Sequence
  Synthetic
EEVLKTILERSREVLDRIRKELERSLKEVEDVLRRIEKDLKKVLDEAREIIKRLLDEAK

SEQ ID NO: 21967 - protein, 60 aa, Artificial Sequence
  Synthetic
SRLETVLERAKELIDRIRKLLEDVRRKVKELIDRIRRLNEEANRESEELIRRIEEELRKG

SEQ ID NO: 21968 - protein, 57 aa, Artificial Sequence
  Synthetic
DARRILEEVRKLVKELEEELRRALKEVRDLAKEVDEDSKRALDRNEKLIRDLDRKVE

SEQ ID NO: 21969 - protein, 60 aa, Artificial Sequence
  Synthetic
RELEEAKKKVEDLLRRILEENERAHEESKKLIEEIRRLLKKMNEESEELRERIRKKLEEN

SEQ ID NO: 21970 - protein, 57 aa, Artificial Sequence
  Synthetic
DVERALDDVRRLLREVERRSEELLRTDEEAIRTLKKEIDKVLKENKDKADRLKEEVN

SEQ ID NO: 21971 - protein, 60 aa, Artificial Sequence
  Synthetic
DELETVERRVEKLIEDIKRELRKVHEESKKLIREIKKELEDANRESERVIEEIKRELDRD

SEQ ID NO: 21972 - protein, 57 aa, Artificial Sequence
  Synthetic
DARKMLEDVKKRAKDVEDEIEEVLRRDRELIKELKRELDEALRENRRLIEDLKRKIK

SEQ ID NO: 21973 - protein, 60 aa, Artificial Sequence
  Synthetic
SEAEEALKRVKKAIDDARKLLEEANRKDKKSIEEAEKLLREAHERSKKAIKEAEDALDKA

SEQ ID NO: 21974 - protein, 57 aa, Artificial Sequence
  Synthetic
DAEKALRDAKRLADDLKRTADEVLKENKRTAEDLKRKADEVLERDKKLAKELKEKAT

SEQ ID NO: 21975 - protein, 60 aa, Artificial Sequence
  Synthetic
SELEDVKRKVKRLIEDIERALTEANKEDEKSIEETERLNRTVHEESKELVERLKDELRKR

SEQ ID NO: 21976 - protein, 57 aa, Artificial Sequence
  Synthetic
DVDEALKEVRDRAKKLKDKIKKVLDDNRRTVEDNERKSDELLKTDKELVREVKERTE

SEQ ID NO: 21977 - protein, 61 aa, Artificial Sequence
  Synthetic
RELEKVRKEVERLIKEIKDLNKRAHDETKTRIDRIREKNEKVHEESKRLIREIEELLRRKG

SEQ ID NO: 21978 - protein, 55 aa, Artificial Sequence
  Synthetic
EEVIKEVEKRLDELRKESKKLLDDDRRLIEKLKEESRRLLEEDRRLIKELKEKVK

SEQ ID NO: 21979 - protein, 61 aa, Artificial Sequence
  Synthetic
SAAERAAEEVKKLIDEARKLLERAHRETKKLIDEARKLNKRALDEVRRLIEEADRLLRRDG

SEQ ID NO: 21980 - protein, 55 aa, Artificial Sequence
  Synthetic
EEVAERARRLAEELKKEADDVLRKDRDLARRAREESEEALKEAEKLARDLRRRAK

SEQ ID NO: 21981 - protein, 60 aa, Artificial Sequence
  Synthetic
KEAEDIKRKVEKVAREITEKSRKSHEELRKVVKEARDKSEKSLRDVERVLREIEELLRRR

SEQ ID NO: 21982 - protein, 55 aa, Artificial Sequence
  Synthetic
KDLIEEIKRRLDEVRRRSEDNLKKMEEELKKVEEDSRRVVERIRTELKRVEDEAR

SEQ ID NO: 21983 - protein, 60 aa, Artificial Sequence
  Synthetic
SEAEKIRKDVEKVIREVREDSKRTLERSRKVDEEIRRKSETSHRLVEEVIRRAEELLRRE

SEQ ID NO: 21984 - protein, 55 aa, Artificial Sequence
  Synthetic
EELIEEIKKALEDVKRESEKVKEESRKSLEDVERDSDRNLKDMERLLREVTERAK

SEQ ID NO: 21985 - protein, 60 aa, Artificial Sequence
  Synthetic
DEVEEIRKEVERVIREVEEKSKETLRRSEKVDREAKKKSDDSRRKVEKVADEIRRLLETR

SEQ ID NO: 21986 - protein, 55 aa, Artificial Sequence
  Synthetic
KDVIEEIRRLLDEVRRRSEKVIRDSERSAEEVKERSERVIEELKRLLEKVAREVK

SEQ ID NO: 21987 - protein, 60 aa, Artificial Sequence
  Synthetic
SSVERVERDVARVAREIRKISRDTKEESKEVDRRIDEISKRTNEDVRRVAEEIKRLKEKR

SEQ ID NO: 21988 - protein, 55 aa, Artificial Sequence
  Synthetic
KDVIKEIEDRLREVEEESKKAIEESKTSLKRVKEKSEKNVEDMKKLLEKVREDVR

SEQ ID NO: 21989 - protein, 60 aa, Artificial Sequence
  Synthetic
SEVEKVLDEIRRLLKEVEERSKENNDRNEELARRNTRRSEENIRRIEELLRRVREEARKD

SEQ ID NO: 21990 - protein, 59 aa, Artificial Sequence
  Synthetic
EKFLREVRREIEEIIRRIKEASEKTHKEAKEVVDRINELSRKSHETIKEIIKRVRDRAK

SEQ ID NO: 21991 - protein, 60 aa, Artificial Sequence
  Synthetic
REVDEVLDEIRRLLERVREESEKNNRDNEKLMRDNEDRSRKVIETIKRLLEDVKDRATKK

SEQ ID NO: 21992 - protein, 59 aa, Artificial Sequence
  Synthetic
EKFLREVRREIEEIIRRIRELSERTHREAKEIVDRINELSKRTLDKAKEMLDRAEEKAK

SEQ ID NO: 21993 - protein, 60 aa, Artificial Sequence
  Synthetic
DEVEKVLRDIEKKLEDVERRSKEVIDEIRKLLKEVEEESRRNVKKIREELKKVVDDVRRK

SEQ ID NO: 21994 - protein, 59 aa, Artificial Sequence
  Synthetic
EKFLRDVKRMVDEILDTARELSRRTLEEIKRIIARIRERSEKSHEEARKALRDVEEKAR

SEQ ID NO: 21995 - protein, 60 aa, Artificial Sequence
  Synthetic
DSVREVLKKIEDELERVKRDNKDVNRKNEELMRRNEERSRRVVEDIKRKLKELVDDVRRN

SEQ ID NO: 21996 - protein, 59 aa, Artificial Sequence
  Synthetic
EEVLKRVDEEAEKVLRENEKLSKKSLDEAREIVREINRLSEDTRREADEILERVKEKVR

SEQ ID NO: 21997 - protein, 60 aa, Artificial Sequence
  Synthetic
DEVETVLEKIERLLRKLEKDSREVIKKIKRLLDEAKKESRKNIEEIKKLLEEVKREVDRR

SEQ ID NO: 21998 - protein, 59 aa, Artificial Sequence
  Synthetic
ERFLREVEKELEDMLRRVRKLSEDTERKIREILERIKRLSDDSNRKAKEILREIRKRAE

SEQ ID NO: 21999 - protein, 55 aa, Artificial Sequence
  Synthetic
DELEKVKEEIRRLLRRIEEDVKRSEERNKELLRRITEEVKRSERRNEELLKEIKD

SEQ ID NO: 22000 - protein, 56 aa, Artificial Sequence
  Synthetic
LKKVREDLERMLRRVEEELKRSNEESERAIEEVRRELEDIDRESRKAIEDVLREEK

SEQ ID NO: 22001 - protein, 59 aa, Artificial Sequence
  Synthetic
SEIDEVLTRLRKISKDLNETSDRVNERARKIIDDIKKESKRVNDEAREIVERLKREIDK

SEQ ID NO: 22002 - protein, 59 aa, Artificial Sequence
  Synthetic
KDKVERVVREVEKLHEEDRKRLEESTRSVRKLLEELKRELEKSTRSVKKLVDELRERVR

SEQ ID NO: 22003 - protein, 59 aa, Artificial Sequence
  Synthetic
DEVDEMLKRAEDRIREISDTSRKVNEDARKIVEDLKRDSERVLRELRKRIEELRREIER

SEQ ID NO: 22004 - protein, 59 aa, Artificial Sequence
  Synthetic
EKRVREVAEEVKRLVKELEERLRRSTESVKRLLEDVERAVKESSDEVEKLLRRLREELE

SEQ ID NO: 22005 - protein, 59 aa, Artificial Sequence
  Synthetic
DEIEEVLRDAKRISDELNRRSEEVNRELREIIKELTKRSRKVLEELKKIVRDLEKKIKD

SEQ ID NO: 22006 - protein, 59 aa, Artificial Sequence
  Synthetic
REKAERVLRTVEELHKEDRDRMKESTDSVKRLLEELKRRAEKSSRTVEELLRRLEEKIR

SEQ ID NO: 22007 - protein, 59 aa, Artificial Sequence
  Synthetic
SEIDELLERAKKRSKELNDTSKEVLDRARRIIEEISKTSEEVNKDLERIIRELAEEIKR

SEQ ID NO: 22008 - protein, 59 aa, Artificial Sequence
  Synthetic
EKRVREVLKEVRRLHEEDRKRMKESSEDVERLLTELRKRMKESTDSVEKLLKELEDRVR

SEQ ID NO: 22009 - protein, 59 aa, Artificial Sequence
  Synthetic
SSLEKLLEDVRRRSEELNRRSRKVLEDLKDIIRRLKEESKRVLDEAKKKVDDVERKIDK

SEQ ID NO: 22010 - protein, 57 aa, Artificial Sequence
  Synthetic
KVRKALEDVRRLHEEDKRRVDESSKEVERLLRELREDMKRSSEEVERLVKRVRDRLK

SEQ ID NO: 22011 - protein, 59 aa, Artificial Sequence
  Synthetic
SEADELLKEVKRISDELNDTSRRVLEELREISRRLNEDSKRVLKELEDILEEIRERIDR

SEQ ID NO: 22012 - protein, 59 aa, Artificial Sequence
  Synthetic
EERVRELVERVKELHEEDKRRMDDSSRDVERLHKEDADSARDSSRKVRELLEELRRRVE

SEQ ID NO: 22013 - protein, 60 aa, Artificial Sequence
  Synthetic
KELEDVLRELKRILEELEKLSREADERSKEIVKRLVEETTRSLKEVKEIVERLKELDDAG

SEQ ID NO: 22014 - protein, 59 aa, Artificial Sequence
  Synthetic
EKRAREVRETVRKLVEDVKKKNEESERRNRELVKEVRKRNKEVRDRSRKLVKELEDKLR

SEQ ID NO: 22015 - protein, 60 aa, Artificial Sequence
  Synthetic
SSLEKVLKDLRKILEDLRREIKTVLDDLRRILEELKRETERVDKKSKEIIETLSELRKAG

SEQ ID NO: 22016 - protein, 59 aa, Artificial Sequence
  Synthetic
KKKVDEAIREVEKLIEELRRDLDRVRKTVEKLVRDLERRNEESKRRNEKLVRKLEEELR

SEQ ID NO: 22017 - protein, 59 aa, Artificial Sequence
  Synthetic
DELETVLRKLEKLVRDLKKRSTDVLRRLEEIVKELTDETKRVDDESRDILRRLKELRDR

SEQ ID NO: 22018 - protein, 59 aa, Artificial Sequence
  Synthetic
KEEADRVITTVEELVKELRRRNEEVKERVEKLARELRRRNEESIKTNEKEVRELEKRLK

SEQ ID NO: 22019 - protein, 60 aa, Artificial Sequence
  Synthetic
STLKKVLDENRKSIKELLDMSRRVLEKLREILRRLEEETREVDEKSERIVTTLEELIKAG

SEQ ID NO: 22020 - protein, 59 aa, Artificial Sequence
  Synthetic
EDKAKKVIDEVRKSVKRLEEENERVLRDVERLVREVEKKNRESEKRNRKLVEELRRKLK

SEQ ID NO: 22021 - protein, 60 aa, Artificial Sequence
  Synthetic
SVLEEVLKKLEKILRELKREIEEVLKKLRRILEELVRETEKSLEKVDRIIKELEKLIEAG

SEQ ID NO: 22022 - protein, 59 aa, Artificial Sequence
  Synthetic
EKKAREVTKTVEKLIRELRKTLEDVKREVRKLVEEVKRRNKDVERKSRELVKKLEERLR

SEQ ID NO: 22023 - protein, 60 aa, Artificial Sequence
  Synthetic
STLEEVLERNKESIERLRKESEDSHRKLKEIMERLKRETERSLEEVEEIVKRLKELTDEG

SEQ ID NO: 22024 - protein, 57 aa, Artificial Sequence
  Synthetic
KVKRVIEKAKKSVEDLERRLREDEEAAREWVKKLRTENEKVRKRSEELVRELEERLR

SEQ ID NO: 22025 - protein, 59 aa, Artificial Sequence
  Synthetic
STLEKVLRDLRKILEELLRMSKKVLEELKRLADRLKEEIKKSLDKVKKIIDELRDLTRK

SEQ ID NO: 22026 - protein, 59 aa, Artificial Sequence
  Synthetic
EDKARKVIEEVTREVRRVEEENKKVERTVEKLVEELEETVREARERSERLVRTLEEELR

SEQ ID NO: 22027 - protein, 60 aa, Artificial Sequence
  Synthetic
SDAERVEKEIREVLKRVEDLLRRVNEETKKVAKEVRELLKEVDDRSREIMKRVAEKLRRI

SEQ ID NO: 22028 - protein, 55 aa, Artificial Sequence
  Synthetic
KDVAREVEKLLRELEKKLEEVNRHDKKLLEELEERLKESEERNRRLLEELKRRLD

SEQ ID NO: 22029 - protein, 60 aa, Artificial Sequence
  Synthetic
REVEEVLKRIEELIRRSEEETREVNERTKKLAEDVRRLLEEVDRRSKKIADEVRELLERI

SEQ ID NO: 22030 - protein, 55 aa, Artificial Sequence
  Synthetic
KDLVRTVEELLKRNEEDLRRVNEHDKKLLEDLTRSLERSEERNKTILEKLKEDLR

SEQ ID NO: 22031 - protein, 60 aa, Artificial Sequence
  Synthetic
SDAEKVLDEIRKRIEESEKRTKEVNDRTREVLDRVRKLLEKVNKESRKVAEDVREAAERI

SEQ ID NO: 22032 - protein, 55 aa, Artificial Sequence
  Synthetic
EEVRKDVERLLRENERSLREVNRHDEALLRELEKRLEEVNRHDDKLVKDLRERER

SEQ ID NO: 22033 - protein, 60 aa, Artificial Sequence
  Synthetic
DEVREILEDVKRINKEVEDELRKIEEEIREIVKTVRDESRKTLEELERILRKVEDDLRKD

SEQ ID NO: 22034 - protein, 55 aa, Artificial Sequence
  Synthetic
EEAVKDNERLAKETEDKVREVVKRIRKIIEEVERTARESERRLRKLLKEVEDRAR

SEQ ID NO: 22035 - protein, 60 aa, Artificial Sequence
  Synthetic
EEIERILEELRRIAKKVEEDSRRTLETVRRLNEEVKRRLREILEEIRRVAEDVRRKLDEK

SEQ ID NO: 22036 - protein, 55 aa, Artificial Sequence
  Synthetic
EDVKRELERILEEVRKKSREALEKNKRLLEDTRRVVEEVKRELEKILRDVKRKVD

SEQ ID NO: 22037 - protein, 59 aa, Artificial Sequence
  Synthetic
SVVEELRDELRRAEEENRKIVEDTTRRLEDMIRRDEKINEEVERRLEEVTRRVEELRKQ

SEQ ID NO: 22038 - protein, 59 aa, Artificial Sequence
  Synthetic
ERKAREMEKEVTEILRRLEEENKRDLDRIKKLLDELRKKNEDTLRRIRRLLEEVRERLR

SEQ ID NO: 22039 - protein, 57 aa, Artificial Sequence
  Synthetic
SSLDEVLERLRKLLKEIEDKVRRINEEVKKSSEDVERELKRVVDELKRRVERLKEEV

SEQ ID NO: 22040 - protein, 59 aa, Artificial Sequence
  Synthetic
ERELEKILRDAERVVREIEKRHRDLLEELKKANEDTRRALDEIRKEAERVLERVREEAK

SEQ ID NO: 22041 - protein, 57 aa, Artificial Sequence
  Synthetic
DEVEEVLKRLRESSEESKRRADDVTRRAEESSRRVHKRSREVVERLKKLVEEVERRV

SEQ ID NO: 22042 - protein, 59 aa, Artificial Sequence
  Synthetic
RRELEKLEREMRDVDRRTDEALERLLRTLEEVNKRTDEENKKILEDLKRVVEEVEERDR

SEQ ID NO: 22043 - protein, 57 aa, Artificial Sequence
  Synthetic
SEIEKVIEELRRSSEESHKRSRKVEEDARRSSDEVHRRSREMLRKLREEVKDVERKV

SEQ ID NO: 22044 - protein, 59 aa, Artificial Sequence
  Synthetic
RRDLRRLREEMRRVDERTTRENEKILRELEEVNKETIKENERLLRDLKRVVDRVREEDR

SEQ ID NO: 22045 - protein, 57 aa, Artificial Sequence
  Synthetic
RRIEEVIKEARKSSRESHEESKEVMERLKRSSDDSHRKSEEVLRRLRKLVEDVERRV

SEQ ID NO: 22046 - protein, 59 aa, Artificial Sequence
  Synthetic
DRELKKLRDELKRVDDETRKANEEILREMEEVDKRSKEANDRLLEELAKVVKRVDDEDR

SEQ ID NO: 22047 - protein, 57 aa, Artificial Sequence
  Synthetic
KDIEEVIRRLRESSKESTKRLRDVVEDLKRSSKEVHDESEDVLRRLEELVRRLKKKV

SEQ ID NO: 22048 - protein, 59 aa, Artificial Sequence
  Synthetic
KRLLKELEDRMRRVDERTDEELEKIRKRMKEVDDRSRDVNRKLAEDLKRAIKRVDDEEK

SEQ ID NO: 22049 - protein, 61 aa, Artificial Sequence
  Synthetic
DEVREVLRRDEELHRELKERIDRILEELERLHRDLKRKIDRVLEELKRLHEDVKRELDKRG

SEQ ID NO: 22050 - protein, 59 aa, Artificial Sequence
  Synthetic
EEALRKLHEESKKSVRDVEKELEELRRENKKVIEDLEDELRRLLEENKRAADELRKRAE

SEQ ID NO: 22051 - protein, 61 aa, Artificial Sequence
  Synthetic
DEVEKVKDDVRKLVEKVKRDAKRAHEDNERKHRKLKKELDDALRELKKRHEELKRRIDDRG

SEQ ID NO: 22052 - protein, 59 aa, Artificial Sequence
  Synthetic
DEALRRLKEELDKMIEDVRKELRKLNEDSDDSIRRVKKRLKELRDENEKVIRDIRRETE

SEQ ID NO: 22053 - protein, 60 aa, Artificial Sequence
  Synthetic
SELEKVRKKVEDISRESEKHLREVKKENDRIIKEIEDELRKLLTDVEREIREVEKRIREE

SEQ ID NO: 22054 - protein, 58 aa, Artificial Sequence
  Synthetic
EKAKRVFEEIERIVRRNKEELRRILKELRELHEEVKEKIKKVLEDVKRLVDELLERAK

SEQ ID NO: 22055 - protein, 60 aa, Artificial Sequence
  Synthetic
SELEKVLRDVREAIKRNEDLLRRVHEESRRISEESEKNLRRVHERSRRIAEDVRRVLRER

SEQ ID NO: 22056 - protein, 58 aa, Artificial Sequence
  Synthetic
EEAEKVAREAKKLVDDLKRKNDEVLDEDRKEVERNERELERVLREDKKLLEDLEREIK

SEQ ID NO: 22057 - protein, 60 aa, Artificial Sequence
  Synthetic
DFAKKLEDEARRVSEESRRHLEDLLRRSKESIDALKRKLEDMLRRVREVIKRIEDELRRE

SEQ ID NO: 22058 - protein, 55 aa, Artificial Sequence
  Synthetic
ERVIERIKELLDRNRKELEDVARDAERLNRELNERVDRVLKEVEERLKELEDRVK

SEQ ID NO: 22059 - protein, 60 aa, Artificial Sequence
  Synthetic
DKAKELEEEIRKIIREIEELLRRMEETSRKSSKESEKHLRDAHEDSRRIAERIKDLLRKE

SEQ ID NO: 22060 - protein, 55 aa, Artificial Sequence
  Synthetic
EDVIRELERLLRELKKRIEDVVRRIKELNEDNNRKVEKIREDDERLLEKVRRDVK

SEQ ID NO: 22061 - protein, 60 aa, Artificial Sequence
  Synthetic
SAAEDVLRKVEKIIKEIEELLKRALEESRKSVKELEKILRDAHEKSRKIAREIEDALRKR

SEQ ID NO: 22062 - protein, 55 aa, Artificial Sequence
  Synthetic
DEVVEEIKRLLEELRKKIEDVADEIRRLNEEVNKKLDDLVKTDTKLLEDVDRKVK

SEQ ID NO: 22063 - protein, 60 aa, Artificial Sequence
  Synthetic
SAAEEVRKKNEKISRELEKLNRKALEDSRDSIRKLKKILDDAHKDSREIIKEIEDLLRKR

SEQ ID NO: 22064 - protein, 55 aa, Artificial Sequence
  Synthetic
DEVVEEIKRSNDENNERSKKVLDEIKKLNKEVNDRVEELLERDKRELERVKRDVD

SEQ ID NO: 22065 - protein, 60 aa, Artificial Sequence
  Synthetic
DEFRDIEERAKELAEENETINRRVLTEHKKLIDELREILERVLREHEKRLKDLKDLVRKI

SEQ ID NO: 22066 - protein, 55 aa, Artificial Sequence
  Synthetic
EEILERIRKLLEDVEEKVKKSVEDSRRLLKTIREEVERVLDTSRKLLKRLEDDVR

SEQ ID NO: 22067 - protein, 61 aa, Artificial Sequence
  Synthetic
SDLEEVEKRAEEIIRRNKEELEKVLRESKDIIDKNRKLNKESLDEVKRIIERLEDLLRKDG

SEQ ID NO: 22068 - protein, 58 aa, Artificial Sequence
  Synthetic
EEVRKVAKKIRDEAKKSHDESKKLNDTSRDLVRKSKEEAERIDEEMKKLLKEIKDKVR

SEQ ID NO: 22069 - protein, 60 aa, Artificial Sequence
  Synthetic
SEVEEILKRIEDLARTLLKLNEDSLRRNEEIIRTIKELNEKTLKENKEIIDRLRELLRRT

SEQ ID NO: 22070 - protein, 55 aa, Artificial Sequence
  Synthetic
ERVLKEIEDLLREVADRSRKFNERSERLLREVEERSREVNDRSKKLMDTIAKEVK

SEQ ID NO: 22071 - protein, 58 aa, Artificial Sequence
  Synthetic
SEVEKALERVKKLAEDLERLDKESLERVEKVIRDAERLDKTSREEVKKIADEADDLRR

SEQ ID NO: 22072 - protein, 55 aa, Artificial Sequence
  Synthetic
EEVLRRIRRLLEEVRKKVEDSNRELKRRLDELEKRVRDSNKEIRELVKEVERKVN

SEQ ID NO: 22073 - protein, 60 aa, Artificial Sequence
  Synthetic
SRLEEVLRRIRKLLRDNKETAKRVLEEIERLLREADKRNREALKEIEKRMREVEDKLRKA

SEQ ID NO: 22074 - protein, 59 aa, Artificial Sequence
  Synthetic
EKDLEELRRRVKEVSDESRKLLEDLLDEARKVLEENRKLVEEILREAKKVIDEIEEKLR

SEQ ID NO: 22075 - protein, 60 aa, Artificial Sequence
  Synthetic
SELEKVLREIRRLLDEARKRNEEFLRRIEELLRRNEEEVRRVLEKIERKVERVKRDLERR

SEQ ID NO: 22076 - protein, 59 aa, Artificial Sequence
  Synthetic
EEKLERILRTARKVVEDNERLVREVLKKVKRVSDESRRLLEEIDREVDEVIKRLEERAK

SEQ ID NO: 22077 - protein, 59 aa, Artificial Sequence
  Synthetic
SEAEEIRRRLEEISRRSVEHLRKVLEEIKRISERSKRHLDRVLEENKRRLEELRELLER

SEQ ID NO: 22078 - protein, 56 aa, Artificial Sequence
  Synthetic
EEVLRELEELLKESEERIKRIEEEIKKIIDKSREDIKRVLEEIERLNKKAADDLRK

SEQ ID NO: 22079 - protein, 59 aa, Artificial Sequence
  Synthetic
DEVREVLEELKRISDDSIRHLEEVLRRLREIIERLKATNDDVLRELEEIIRTLLDLDRQ

SEQ ID NO: 22080 - protein, 56 aa, Artificial Sequence
  Synthetic
KEALDTLERTVEESKKRIKEILDRVKELIDKAREDSKRSVEEVRRRIEKARRDLDR

SEQ ID NO: 22081 - protein, 59 aa, Artificial Sequence
  Synthetic
SKVDELLKRLEDIIRKLDKENEKVLRELEEISKRSVDHLKRVLEENRRILEELERLLEG

SEQ ID NO: 22082 - protein, 56 aa, Artificial Sequence
  Synthetic
ERVLRDLKRLVDEARRRSERSLEEVKRIADESRKEIERILREIEEENRRAKDKLRR

SEQ ID NO: 22083 - protein, 59 aa, Artificial Sequence
  Synthetic
SRAEDLLRRLEKIIRDSLRHLREVLKRLERIIDELRKTNERVKEELERIIDTLRKLKDN

SEQ ID NO: 22084 - protein, 56 aa, Artificial Sequence
  Synthetic
EEILRRARELVDESRRRLEKVVKEVRDVIRTLKKDSDKSLRDLEEEVRKAEEDLRK

SEQ ID NO: 22085 - protein, 59 aa, Artificial Sequence
  Synthetic
DEVRELLDTLRRIIERSVKHLEDVLRDLKRIIDKLREDNRRVLEENRRRLEELDKLRKE

SEQ ID NO: 22086 - protein, 56 aa, Artificial Sequence
  Synthetic
EEFLRDVERLAEESRRRLEAVEREVERLITEAEKESKKSLDEVERLNRELKERLKK

SEQ ID NO: 22087 - protein, 60 aa, Artificial Sequence
  Synthetic
DVEDILRTIRDLIRRVDEKSRKTLEENRRAIEEVLRRSDETLRRNKKLIEDVEEEVRRTV

SEQ ID NO: 22088 - protein, 59 aa, Artificial Sequence
  Synthetic
REFMETVLRKIKEDIERLEERNREVHEKSREEIRKLEEENEEVHRKSRKEIDEIRKELK

SEQ ID NO: 22089 - protein, 60 aa, Artificial Sequence
  Synthetic
DVEEILKEIRKRIEDVKRESEKTLKEIRDLIKKVAEDIERSVKENRELIDKVRRELERDV

SEQ ID NO: 22090 - protein, 59 aa, Artificial Sequence
  Synthetic
RKVLTDVLKEIERRIDELRRRNEEVVEKIKREIKKLEDESKRVNDESREIIKRIKEEVD

SEQ ID NO: 22091 - protein, 60 aa, Artificial Sequence
  Synthetic
DVEEIIREIRKLIEKVLRDVRRSAEENKKLIDEVKRRVEEMLKRNRDMIKKVLDDVRREV

SEQ ID NO: 22092 - protein, 59 aa, Artificial Sequence
  Synthetic
REFLKKVLDEIREIIERLRRESEKVNEDSKREIKDIERELREVHKKSRRIIRRIEEKLR

SEQ ID NO: 22093 - protein, 60 aa, Artificial Sequence
  Synthetic
DEAREVLERLKKISEEDKRRSDKVNEETRRIIKEAEERSRKVNEETKRIIEKLEEDLRDR

SEQ ID NO: 22094 - protein, 56 aa, Artificial Sequence
  Synthetic
EEILRELREILRENTERVERSLRDNRRLLDELRKKVERSAEENERLLREAEEKLRK

SEQ ID NO: 22095 - protein, 60 aa, Artificial Sequence
  Synthetic
SEVDKVLDDSRKSAEDLRREIETVLKRNKELIDENRKRLKEVLDRNAKLADDLRRERKKG

SEQ ID NO: 22096 - protein, 56 aa, Artificial Sequence
  Synthetic
ERVVRTLEKLIEEWRKAVEDVLRTLEKLTEEAKRESERILEELKRITKELRDEERR

SEQ ID NO: 22097 - protein, 59 aa, Artificial Sequence
  Synthetic
SEVEDVLRRLEELLRRLEKKSRESLEELRRRLDEVRKDSERSNEDSERLIRELEEIRRK

SEQ ID NO: 22098 - protein, 56 aa, Artificial Sequence
  Synthetic
KEFLDTMRRIVEELKKRLKEVNDRIKDIVRRAEEELKRSNDENKERIERAEKKVRD

SEQ ID NO: 22099 - protein, 59 aa, Artificial Sequence
  Synthetic
SELEKVLEELKKLLEELERESDTSVKELRTLLERLEEESKESNERSKRLAEELERRLKD

SEQ ID NO: 22100 - protein, 56 aa, Artificial Sequence
  Synthetic
REFLETMERIIEELEKRLREVNEDLKRIVRTVAERLKKSNRDNRELIRTLKDRVRT

SEQ ID NO: 22101 - protein, 59 aa, Artificial Sequence
  Synthetic
SEVEDVLRRLEELLRRLKEKSKKSNEESKKLIKELKEESDKSRRDLERLLEKLDRDLKR

SEQ ID NO: 22102 - protein, 56 aa, Artificial Sequence
  Synthetic
REVLERMRELVEKLKEDLERSNKENKDLIDKVKRDLEEVNRRLEKIVREVKERVRT

SEQ ID NO: 22103 - protein, 59 aa, Artificial Sequence
  Synthetic
SEVEDVLRRLRELIEELRERSERSNEESKRLADELEKRSEESLRRLAELLRKLEEDLRR

SEQ ID NO: 22104 - protein, 56 aa, Artificial Sequence
  Synthetic
REVLTTIAKIVTDLERELRKSNEENKKLIDELRKRLEDSNKRVKEIVKRLEEEVRR

SEQ ID NO: 22105 - protein, 60 aa, Artificial Sequence
  Synthetic
KDVEEALKELERVLEELKRLSKELLDRLRELADRIRRISKELLEELKRLLKDIKETVDRI

SEQ ID NO: 22106 - protein, 56 aa, Artificial Sequence
  Synthetic
EDVLRRLRELIEKVKRDLDRTDETLKELIKTLEDELRKSNETIEDLIRRLEEALRK

SEQ ID NO: 22107 - protein, 60 aa, Artificial Sequence
  Synthetic
SDLERLLDELRKLLDDLRRKSEELLRRLDTLAKKIEREAEKITKDNKELIDRLRDRLRRI

SEQ ID NO: 22108 - protein, 56 aa, Artificial Sequence
  Synthetic
ERMLRTLERLIEKLKEELKRTDKELERLIRELKKRLDDNNRRNEELIKRVEDELRK

SEQ ID NO: 22109 - protein, 60 aa, Artificial Sequence
  Synthetic
SEAETVLEEMKEVSKRTEEKNKKVEDDDKRSIDELRKKLEKVLREDRRSIEDLERRLKEN

SEQ ID NO: 22110 - protein, 56 aa, Artificial Sequence
  Synthetic
EEVLRTIERLSRENKKKDEDTLRKSKEEHERVREELERVLETSRREHEKVKKRLED

SEQ ID NO: 22111 - protein, 60 aa, Artificial Sequence
  Synthetic
RVEEMLERLRRLHEEVKRRIDEVLRELEEESKRNEERIRRVLERLRDEHRKLKETLDRRN

SEQ ID NO: 22112 - protein, 59 aa, Artificial Sequence
  Synthetic
EEELERLERKSRESIERLKDTLRELKERLKRISDRSDEKLREAEKRSRESIEEVKKRAK

SEQ ID NO: 22113 - protein, 60 aa, Artificial Sequence
  Synthetic
EVEDVMREARKLHKELEDKIRDAARRIRETIDRVKKEDDDSLRKLRKLHEDLKRELEKRN

SEQ ID NO: 22114 - protein, 59 aa, Artificial Sequence
  Synthetic
RDELRKLLEDSKRSIEKVEDDLRKLEEKIKRVIDDNRRKNKELEEKSRKSIRDLEEEVR

SEQ ID NO: 22115 - protein, 60 aa, Artificial Sequence
  Synthetic
EVEDVLRELRKEHDDLRKEITDVLRRLEKLHRELDEEDERSVKRIRELIEEVMRELRKRN

SEQ ID NO: 22116 - protein, 59 aa, Artificial Sequence
  Synthetic
RKDLKALKEDSKRSIDDIRRKLEEARRRSERSIDENRKLNKRVIEKIREIIRRLEEKTK

SEQ ID NO: 22117 - protein, 59 aa, Artificial Sequence
  Synthetic
EVEDVLREAERLHRTLLKEIRDALRRLRKLIEDVKRKDDESLKRLREKLERLKESLERN

SEQ ID NO: 22118 - protein, 59 aa, Artificial Sequence
  Synthetic
REELKKLLEDSKRSLDELRRRLKEVEDRVREAIKKNEDENRKLERRLDKIIEDLERRVK

SEQ ID NO: 22119 - protein, 60 aa, Artificial Sequence
  Synthetic
SEAEKILKEIRDISDRTREELKKVKDEHKTLIDRLREILERALREHDRLAKELEDIKRKI

SEQ ID NO: 22120 - protein, 56 aa, Artificial Sequence
  Synthetic
EEVLREISKIIKDNHDEVTEVLKESEELIRRLRKEVEDVRRTSEKLIRELEERVRE

SEQ ID NO: 22121 - protein, 58 aa, Artificial Sequence
  Synthetic
SEVDDVLRRLEELIKTLEDINRKSLEDIKKLIDDLRKILEDALRKHEKLIRELREMKK

SEQ ID NO: 22122 - protein, 56 aa, Artificial Sequence
  Synthetic
KEFLDRMREEIRRLEEESRKSDETIERLIRELRRRVEEVLKTSTDLIRELEEEVKK

SEQ ID NO: 22123 - protein, 61 aa, Artificial Sequence
  Synthetic
SSVERVLEAVKELAKKLAEDIRRSLEHIRRLLEEVEKKHRDSKEHVRKLLKDLRDIAREKG

SEQ ID NO: 22124 - protein, 59 aa, Artificial Sequence
  Synthetic
DKELKKILDELRKLIRKVLEALRELNKRAKEILDRVAENVKEVNERLERLVRRIAEEIR

SEQ ID NO: 22125 - protein, 61 aa, Artificial Sequence
  Synthetic
SSVERVKEEVEKLLEKLEREIRKSLKTIRELLRELKRKHEESKEHVRRLLEKAEREARRRG

SEQ ID NO: 22126 - protein, 59 aa, Artificial Sequence
  Synthetic
DKKLEEILRRAKELIDRVLEELKKLNEELRRIIEEIVRNVKRVNEKLEKLLRDIKRRID

SEQ ID NO: 22127 - protein, 61 aa, Artificial Sequence
  Synthetic
SSVEEVLRRVKELLKTLKKKHEDSKRTVKELLDDLRKKHEDSKRHVRKLLEELEKRARERG

SEQ ID NO: 22128 - protein, 59 aa, Artificial Sequence
  Synthetic
DKELKRILEEVKELVKRVLENVERVNREVRERLKEVSRNVERVNKEAKELVDEVEERAR

SEQ ID NO: 22129 - protein, 61 aa, Artificial Sequence
  Synthetic
SSVEEVRKRVRDLIKRYREEVEKIKKDVRRLLDELREEVKRSLDHVRKLMEELRRKIKRDG

SEQ ID NO: 22130 - protein, 59 aa, Artificial Sequence
  Synthetic
DKELKRILDELKERLERAKRENEDSVRKLRKLIEEILREIRRLNKEAEDLIREIEERAR

SEQ ID NO: 22131 - protein, 61 aa, Artificial Sequence
  Synthetic
KDVEEVLTRVRELLRRVEEEIRRSEEHIRRLLEELRRKHEESKDSIRKLLEDLEEKVRRRG

SEQ ID NO: 22132 - protein, 59 aa, Artificial Sequence
  Synthetic
RKDLEEILREVEKLVEEVERRLRKLNEELKEILRTIVENVERVNRRLEELIRDIKRRVK

SEQ ID NO: 22133 - protein, 57 aa, Artificial Sequence
  Synthetic
SEVEKIVEEVKKIVEEVERLHRKLLEDLRRVVEEVEDRSRRINEEAKKIVEDLKRRG

SEQ ID NO: 22134 - protein, 55 aa, Artificial Sequence
  Synthetic
EEVLKEIEDRLERLRRRAEEVNDTARKIVREVEESLKRSVESLKKLVDELRETLR

SEQ ID NO: 22135 - protein, 57 aa, Artificial Sequence
  Synthetic
DEVERLLEEAKKIVEEMKRLHEEILREVEEIVRELDEKHDKLLRDAEEIVKELKKEG

SEQ ID NO: 22136 - protein, 55 aa, Artificial Sequence
  Synthetic
EEMRRRLEKLVRDLREKSREVNERIDKLLEELHEKSERVKKTIDDLVEEVKDTLT

SEQ ID NO: 22137 - protein, 57 aa, Artificial Sequence
  Synthetic
KEVEDILREVKKIVDELLRRHRELLERARRIIKRLKEEHDRLLKELEEIVRDLTRKG

SEQ ID NO: 22138 - protein, 55 aa, Artificial Sequence
  Synthetic
EEILRRIEELLKRLRDDAKRVNDELKRLVEELRKRSKEVNDELRRLLKELEDRLR

SEQ ID NO: 22139 - protein, 57 aa, Artificial Sequence
  Synthetic
SEVEEILKEVERRVDELTRRHEELLRKADEIVKDIRRKLEEINKRLKDIADDVRRKG

SEQ ID NO: 22140 - protein, 55 aa, Artificial Sequence
  Synthetic
EEILRRIETLLEELERRSKRVNDELEKLVRELKEELERSKRSIDEILKKVSKDLK

SEQ ID NO: 22141 - protein, 57 aa, Artificial Sequence
  Synthetic
DEVERLLEDLREKVKRLVKKHEDILREVEKEVRRILRTSEEINREAEEIIRELDKRG

SEQ ID NO: 22142 - protein, 55 aa, Artificial Sequence
  Synthetic
EDVLRDVDRLLRELREKSKEVNKRIKELLDKLKTDLERSKEHLERLVKTLKDKLR

SEQ ID NO: 22143 - protein, 57 aa, Artificial Sequence
  Synthetic
DEVEDLVRKLKKRVDDLLAEHKRLLDEAEKIVREVLKKSRESNERNKKVSKEVRERG

SEQ ID NO: 22144 - protein, 55 aa, Artificial Sequence
  Synthetic
EEVLKTLDRLVEELRKASEDVNRELDKLLKDLEKKLRDSIRHLEENHKDVRRALE

SEQ ID NO: 22145 - protein, 60 aa, Artificial Sequence
  Synthetic
DEVEKVLKEIRKRVEDSLRHLEKVNKEAREIVEKVREELRESNERLREIVKTIRDRLEKL

SEQ ID NO: 22146 - protein, 55 aa, Artificial Sequence
  Synthetic
EDVRRTVEELVRRSEKAIEDSRRSIEDLVRRLKEDIERSLRSVEKLVEELTEAIR

SEQ ID NO: 22147 - protein, 61 aa, Artificial Sequence
  Synthetic
SEVEKVLEELRRIVTKSARHLDESNERLKEIIRRLDEKNKEALKRAEDIIRDIDDKLKKLK

SEQ ID NO: 22148 - protein, 55 aa, Artificial Sequence
  Synthetic
KKVKDEVKKLIDDSREKIKRSRESVKRLVEEHRRRSEEVRKTLEKLAREITERIR

SEQ ID NO: 22149 - protein, 57 aa, Artificial Sequence
  Synthetic
DELEEVADEVRKIIEDLERRLREVVKTSEKLNKENRRRTEDVEKEVEKILRELEEKL

SEQ ID NO: 22150 - protein, 59 aa, Artificial Sequence
  Synthetic
DEDIRKVLKELREIIKEVEDMLKEVLDRNRKLIEDNLRRLKEVLDRLRKKVREIEEEAR

SEQ ID NO: 22151 - protein, 58 aa, Artificial Sequence
  Synthetic
SEIEEAEERVRRLIERNKRETDRVAEEVKRINDENRRATEKVKRDVKRILDDLRRKLE

SEQ ID NO: 22152 - protein, 59 aa, Artificial Sequence
  Synthetic
DKLLRDVLRDLERLVRKNLEELKRVLDELKRLMEDNLRRLEKVLEELERLVREIVERAR

SEQ ID NO: 22153 - protein, 58 aa, Artificial Sequence
  Synthetic
EELERVAKKVRDINRRNKEETKRVEDEVRRLIKENEDTSREVVRRNEEILKDLERKLG

SEQ ID NO: 22154 - protein, 59 aa, Artificial Sequence
  Synthetic
RDVVREVLERLKELVKRNLDKLKRVLDEIRRLIEENLDELRRAHEEHRRIAEDIRRKAK

SEQ ID NO: 22155 - protein, 57 aa, Artificial Sequence
  Synthetic
ESLERVKEEVKKILEKNRRTSEEVARRVKELIDRNREKSKDVARKNEKILEDLERKL

SEQ ID NO: 22156 - protein, 59 aa, Artificial Sequence
  Synthetic
EEEVERVLRRLRELVRENEKRLKEVLDEIRRLIRENEEKLEKAHREHKKLAEEVERRKR

SEQ ID NO: 22157 - protein, 59 aa, Artificial Sequence
  Synthetic
DDVERVLKEVRELVERANEEIRKVLERDRKSNEDANRKIREVLRRVEELVDRIDKIRRE

SEQ ID NO: 22158 - protein, 55 aa, Artificial Sequence
  Synthetic
DEVVKKIKELLDRHRKTTEEVLERIRRSLEKHRRDSEEVMKELRRLVKELEDRTR

SEQ ID NO: 22159 - protein, 59 aa, Artificial Sequence
  Synthetic
DEVRELLRTIEELVRDANRKIKEVLDRDRESNDRANKTLEEILKRDKRSNEDVEEKLKK

SEQ ID NO: 22160 - protein, 55 aa, Artificial Sequence
  Synthetic
KKVEKKIRDLLKKHEEDSRKALEDIKRSLERHRERSEEVLKRIRDSLRELDKKTK

SEQ ID NO: 22161 - protein, 59 aa, Artificial Sequence
  Synthetic
DSVEEILKRVKELVDKANEKIKEVEERVRRSDEELKKILEEILREIEKLVREVEEIARR

SEQ ID NO: 22162 - protein, 55 aa, Artificial Sequence
  Synthetic
DEVKKKIKDLLEKHERDSRKVLRKLEESSKETEDRAKEVLERIEKLLEDLRRETK

SEQ ID NO: 22163 - protein, 59 aa, Artificial Sequence
  Synthetic
KDAEELLKRVRDLLKRSLESLEKILRDSKELADRWRKKLEDLLRESEELVDRAEKILRR

SEQ ID NO: 22164 - protein, 55 aa, Artificial Sequence
  Synthetic
ERVREELKKLLTRVEEEHRKVLETDKKLLKELHKESKEVNDRDRELLERLEESVR

SEQ ID NO: 22165 - protein, 59 aa, Artificial Sequence
  Synthetic
KDAERLLRELKKLLEESLKSLKELTDRIRDEVRRVKKRLRDLLRESEELVKRAEDILRR

SEQ ID NO: 22166 - protein, 55 aa, Artificial Sequence
  Synthetic
EEVEETAKKLLDEVRRAHEEVLKEIRELLRDLERTVREVNEEDKKLLRKLEEDVR

SEQ ID NO: 22167 - protein, 56 aa, Artificial Sequence
  Synthetic
SEAEKVRKDLKDIADDLHRVSERVLREDERLLKRLHDVSRDVRERDREIVEDLRRG

SEQ ID NO: 22168 - protein, 55 aa, Artificial Sequence
  Synthetic
EEVLDRARKEVDEIKKKHKKVLDESRKLVAEAERKHEEILKESEDLAREIKERER

SEQ ID NO: 22169 - protein, 56 aa, Artificial Sequence
  Synthetic
SRAEKVREDLDRIEEDLRRVHREVLKEVERILKELHDTSKRVRDEVEKIVRDLRRA

SEQ ID NO: 22170 - protein, 55 aa, Artificial Sequence
  Synthetic
EKVLEDARKLVRESKENIRRVLEDLKRIVKKLKEDHKRILDELKKLVDKIKEDAR

SEQ ID NO: 22171 - protein, 56 aa, Artificial Sequence
  Synthetic
SRAERVREEIDKILEDLHRVSERIKRELTKLMEDLERTHERIKKAIREILADLRRR

SEQ ID NO: 22172 - protein, 55 aa, Artificial Sequence
  Synthetic
EEVLKEAKKLVDDLKEKHKEVLTRVERLVEESKKNLKRVLDELRDLVRRVKEEAK

SEQ ID NO: 22173 - protein, 56 aa, Artificial Sequence
  Synthetic
SEAERVREELDKIVEDLHRTSEDVKRRDEELLKDLERRHKEVKEEDEKILKDLRDS

SEQ ID NO: 22174 - protein, 55 aa, Artificial Sequence
  Synthetic
ERVLEELRKTVTEMKKRHRDILRESEELARESKENVDRVLEESRRRAEEIKRRAK

SEQ ID NO: 22175 - protein, 56 aa, Artificial Sequence
  Synthetic
DERERVKEELDKLLRDLERVHDKVREDDKRLLDDLRRVHEKARRDDKRILDELKRA

SEQ ID NO: 22176 - protein, 55 aa, Artificial Sequence
  Synthetic
EEVLERAKELVKRSKENVERVLRDSERLAKESKENVRRVLEESKRRVEEIEERAR

SEQ ID NO: 22177 - protein, 56 aa, Artificial Sequence
  Synthetic
SEAERVREELKRILEDLERVHREVEEAIERIVEELEDVHRRARERVERILRELERR

SEQ ID NO: 22178 - protein, 55 aa, Artificial Sequence
  Synthetic
EEVLKEIEKMVKESRDTVRRILEELRELVERSKRNVEKVLRDLERAVEKIERDAK

SEQ ID NO: 22179 - protein, 56 aa, Artificial Sequence
  Synthetic
KEAEDARRRVDEILEELRKLHDEVRKTDKELLDDLEREHERVKREDDKILDTLRRQ

SEQ ID NO: 22180 - protein, 55 aa, Artificial Sequence
  Synthetic
EKVLEDLERLVETSRKTVRDILEESKELVKRSKENVRRVLERSKELVKRVSERAK

SEQ ID NO: 22181 - protein, 60 aa, Artificial Sequence
  Synthetic
SDVDEARKTVKKILDESEETLERVRRELERILRDSERTLKRVEERVRRILRDLERELRKL

SEQ ID NO: 22182 - protein, 59 aa, Artificial Sequence
  Synthetic
REEIDKVLKEIRERVERSKKHLEDVLDRLRKIIEESKRHVEKVLEKLEKIVKELKDELK

SEQ ID NO: 22183 - protein, 60 aa, Artificial Sequence
  Synthetic
KDIEEVEKRVREILEDSRRMSKKDEESTRRILEESRRVSEEDKKSTEEILKELKDELRKL

SEQ ID NO: 22184 - protein, 59 aa, Artificial Sequence
  Synthetic
RDTIKKMLEEIKRRVDESKRHLRESNKRIRDIAEESKKHLEDSNKKVRDRADELKKRLK

SEQ ID NO: 22185 - protein, 60 aa, Artificial Sequence
  Synthetic
SDLERVKKAVEDILRDSERTLRRARERLKRLLEELRRTSEEDKKSTDEILERLKRELEKL

SEQ ID NO: 22186 - protein, 59 aa, Artificial Sequence
  Synthetic
RDELRKLLEEIRRRAEESKRHIEEVLKRLEEIVKRLKEELKRSNDEIREIVRRLEEELK

SEQ ID NO: 22187 - protein, 57 aa, Artificial Sequence
  Synthetic
STLEEMEKEVEKLNRDSRRTLREVAERVEELNRDNERTSKRVEDAVRELNKRLRDEV

SEQ ID NO: 22188 - protein, 59 aa, Artificial Sequence
  Synthetic
EEELRKVLKENEELARELKKELERALEENRRLHEENKEDLRRVLEENERLHRKLRKDAK

SEQ ID NO: 22189 - protein, 57 aa, Artificial Sequence
  Synthetic
DTLERVAEAIRRLNEDLKRTLEKVERAVREILKRLAETLKRAEEEVRRLNRDLERKV

SEQ ID NO: 22190 - protein, 59 aa, Artificial Sequence
  Synthetic
EEEIKKVLDDNKKLAEDLKRELKRVLEEIRKLVKELEDIVREVLKTNKELHERLKRRAD

SEQ ID NO: 22191 - protein, 57 aa, Artificial Sequence
  Synthetic
DTLERAAEEVKKLNEDNKRTSKRVEDEVRRLNRENEEMSKRVKDTVKKILDDLRRKV

SEQ ID NO: 22192 - protein, 59 aa, Artificial Sequence
  Synthetic
EKEIERVLRELERIARENKKELEKVLRENRELHERNKKLLEKVLRDIKRLAKTLRDRTR

SEQ ID NO: 22193 - protein, 57 aa, Artificial Sequence
  Synthetic
RELEEARERVKRLNEENKEFSRRVAEEVKKLNEENERTSKKVEDEVRKLNEDLRKKV

SEQ ID NO: 22194 - protein, 59 aa, Artificial Sequence
  Synthetic
EETIKRVLEELTRIMDRNRKDLRRVLEENKKLHDENRKELKRVLDENRRLHEEVKKRAK

SEQ ID NO: 22195 - protein, 57 aa, Artificial Sequence
  Synthetic
SELERVKTEVEKLNRRNREATERVKEEVKKLDEENKKSSKRVEDEVRKILDELRKKV

SEQ ID NO: 22196 - protein, 59 aa, Artificial Sequence
  Synthetic
REELERMLKRLKEIIERNEERLKEVLDRIRELIERNKELLRRVLKRIRDLVKELKERAD

SEQ ID NO: 22197 - protein, 57 aa, Artificial Sequence
  Synthetic
RELEEVERRVRELNEDNRRKTEEVKREVKRIDDDNRRASERAAREVKKLNKDLKDKV

SEQ ID NO: 22198 - protein, 59 aa, Artificial Sequence
  Synthetic
EKTLEDMLRRLKEIIKRNKDELEKVLRDIKKLVDDNKRDLERVLRRNEELHRELLERAR

SEQ ID NO: 22199 - protein, 57 aa, Artificial Sequence
  Synthetic
DELERAKEEIERLNDELKKSLEEVEKEVEKLDDDNRRTSRRVSEEVKRLNKELEDEV

SEQ ID NO: 22200 - protein, 59 aa, Artificial Sequence
  Synthetic
RDTIRKVLKENEDLIRKLEEILKKVLDEIRRLIEDNKRELEDMLRKNKELHDRLRERAR

SEQ ID NO: 22201 - protein, 57 aa, Artificial Sequence
  Synthetic
SELEEVKKEVEKLDERNKRLSKRVEEEVRKLNEENKRATERIKREVEKILEDLRRKV

SEQ ID NO: 22202 - protein, 59 aa, Artificial Sequence
  Synthetic
REELKRMLDRLRRIIEENERKLKEVLDRLRDIIRKNKEDLKRALERIKKLVEDLKRRAT

SEQ ID NO: 22203 - protein, 59 aa, Artificial Sequence
  Synthetic
SDLERVLDEIRRLAKEVKDTLRRMLEKNEELSKRDEDKTREMLKEIERLVKELEEIADK

SEQ ID NO: 22204 - protein, 59 aa, Artificial Sequence
  Synthetic
DDRLRKAEEEIKEIERDLKRTLDEVAKEVKRTIDRNRETSKRAAREVEKLLEKLREKTR

SEQ ID NO: 22205 - protein, 59 aa, Artificial Sequence
  Synthetic
SDLERMLREIRKLVEDDKRRTREMLRDNERLSREDKKKTDDVLRRLEELVRRLEEILKK

SEQ ID NO: 22206 - protein, 59 aa, Artificial Sequence
  Synthetic
DKRLDDIRRAIEEIIRDLRRASKKASEDVERTIERNERTSEEAKRRIEELIERLRRTDK

SEQ ID NO: 22207 - protein, 59 aa, Artificial Sequence
  Synthetic
SDLEEALKRVEKLVRDDKEKTKRMLERNRELVKRNKEKNKRMLDEIRRLVEELEDILRR

SEQ ID NO: 22208 - protein, 59 aa, Artificial Sequence
  Synthetic
DKRLKEVEDAVREILKDLKRTSERAKEEIERTIRDNERVVRRLEEEARKILEDLERRDK

SEQ ID NO: 22209 - protein, 59 aa, Artificial Sequence
  Synthetic
SRIEELLKTVEKLVDEVKKALRKLLEENKDLARKSKESLERLLDEVRDLVRRLEEILDR

SEQ ID NO: 22210 - protein, 59 aa, Artificial Sequence
  Synthetic
KDKLERVMRTLDEILKDLERTVERVKRALDESNRDLRREHERIKKELDKILDRLREKAR

SEQ ID NO: 22211 - protein, 56 aa, Artificial Sequence
  Synthetic
SEVERLKEELDKLHKENREVLEDSKRSLDKILDDVRKLAEDVKKRLDDILKELRDR

SEQ ID NO: 22212 - protein, 59 aa, Artificial Sequence
  Synthetic
RDLLRRLLREAERVSEETKKESKKLNDEIRKVLERLRDELRKIEDEIRKVVRRIRERAN

SEQ ID NO: 22213 - protein, 56 aa, Artificial Sequence
  Synthetic
DEVETLKKRLDKLHEDNKRDLERSKRSLEELLKELEEVVRRSEKTLDELLKKVEDQ

SEQ ID NO: 22214 - protein, 59 aa, Artificial Sequence
  Synthetic
RKLLKELEDTIRKVSDDTRRKSEELNEELKTVAEEIKKRSRELNEEAKDVLEKVERRTT

SEQ ID NO: 22215 - protein, 57 aa, Artificial Sequence
  Synthetic
DEVERAKEKLDKILEDLRDVVRRSKENLDRLHEENRETLERSKKNLDRLLEKVKKDG

SEQ ID NO: 22216 - protein, 59 aa, Artificial Sequence
  Synthetic
RRDIERILRELEKVLKKLTDESERLNREVERVSRDTKKKSKELNEELKRVLDEVKRKAD

SEQ ID NO: 22217 - protein, 60 aa, Artificial Sequence
  Synthetic
DEVREVLRELKKVVDDSKRDLDRVLREAERVVKESKDDIKRLLEETERVARDVERKIREN

SEQ ID NO: 22218 - protein, 55 aa, Artificial Sequence
  Synthetic
ETLDKEVKRLLKESKRAADELRERIKRLIEESKRLLDTVRREDKKILEKIERDLK

SEQ ID NO: 22219 - protein, 57 aa, Artificial Sequence
  Synthetic
DEIEKILEDLRRISEDTKRKHEEILRELEEILRELEERHRRILREVEEVARRLEERL

SEQ ID NO: 22220 - protein, 59 aa, Artificial Sequence
  Synthetic
EEKVKEVEREIRRLLKENEDASREVERLIEELKRRLDKISEDVERVLKKILERIDRATK

SEQ ID NO: 22221 - protein, 56 aa, Artificial Sequence
  Synthetic
RSVEEAEKVLEELKRRNERLNEEHRREVEKVREKNERLNKRHREDVERIKRELDKE

SEQ ID NO: 22222 - protein, 59 aa, Artificial Sequence
  Synthetic
DETIKDVLRKIKKISDETRKTLEDTLRELREISEKTRRRLDESLKELEEILRRLKEETR

SEQ ID NO: 22223 - protein, 60 aa, Artificial Sequence
  Synthetic
REAEEIRKEVEKLLRDLKRALDEHRETSRRLVEELKDILRKNREEVERLVREIREVIKRV

SEQ ID NO: 22224 - protein, 55 aa, Artificial Sequence
  Synthetic
RELIEEITRIVEKAKKELREVSKRLREIVKKIKEDNDRSNKRLREIAKEIKDRLT

SEQ ID NO: 22225 - protein, 60 aa, Artificial Sequence
  Synthetic
SEREEARERVKDLSRKLKEINERSEKHLRDLAKENRDANRRTREEVERLLDKIRKVIKDV

SEQ ID NO: 22226 - protein, 55 aa, Artificial Sequence
  Synthetic
EELIRELEKIVRDAEKKNRDVNREVRKILEDSKRELEKVLRDLERKVREIEKELK

SEQ ID NO: 22227 - protein, 61 aa, Artificial Sequence
  Synthetic
RELEEVLKKLKEDAERLKRILEEATRELEKILERLHRLNEKSTEELRRIVKDLKEELKRRG

SEQ ID NO: 22228 - protein, 55 aa, Artificial Sequence
  Synthetic
EEVEKTVRKLEEDLKRAIEKHEEDSRRLVKRLKESNDEHEKESRRLVRELEKEIE

SEQ ID NO: 22229 - protein, 59 aa, Artificial Sequence
  Synthetic
DEVREVIKTVRKLLEDLHRTNREVIERVKRTSEETHRKNEDMLRRLRKLVEDLKETLDR

SEQ ID NO: 22230 - protein, 59 aa, Artificial Sequence
  Synthetic
EKSLRDAEREVKKLLEELKRSLDKLREDVERLLRENKESLDRLREEVKKIERELREKTR

SEQ ID NO: 22231 - protein, 59 aa, Artificial Sequence
  Synthetic
SDVDRVLEELRKLVEELHRRNRKIIEDLRRASEKTHRKNRDLLEKAKKLADELREIAER

SEQ ID NO: 22232 - protein, 59 aa, Artificial Sequence
  Synthetic
KDELRRLEEAAKKILDDLEDSLRKLEEAVKDLKRKNKKSLDDLAEAAKDILRRLAETAR

SEQ ID NO: 22233 - protein, 59 aa, Artificial Sequence
  Synthetic
DEAEEVIKTVKRLLDELHRRNEEAIKEDRRLVEELHRTNEKVLREVEELVKRLAEILRR

SEQ ID NO: 22234 - protein, 59 aa, Artificial Sequence
  Synthetic
KETLDRLRERAEELKRRLEKSLRDLNRDNERTKRELRESLRKLEETARRLKEEIDRRTK

SEQ ID NO: 22235 - protein, 60 aa, Artificial Sequence
  Synthetic
DEADDLIRRVRELVKRVKEALEDLLRRNKDVLRKVKEELEKITRRNRDKVRRVEEELKRI

SEQ ID NO: 22236 - protein, 59 aa, Artificial Sequence
  Synthetic
SRKLEELRKEVEKLKEELDRVLEEARKEVEKSNRELKEVLERHAEDNERIKRRLDEARR

SEQ ID NO: 22237 - protein, 60 aa, Artificial Sequence
  Synthetic
SELERLLDEVDRIVREIEERLRDILRKNRELSEDSERKLRELLREVRDLVRRIMDELRRT

SEQ ID NO: 22238 - protein, 59 aa, Artificial Sequence
  Synthetic
REKLEEARRRIDEIRRRLEELLKRAREDSDRSNKRNKDLLREIEEELKKLKRELDEETR

SEQ ID NO: 22239 - protein, 60 aa, Artificial Sequence
  Synthetic
SLKEKVKKVIEDLKRAIDDLLRKVREESKKSNDHIRKLLEDSERTLRDLARRIKKLKDDG

SEQ ID NO: 22240 - protein, 59 aa, Artificial Sequence
  Synthetic
ARLIKEVIEEAERLLREIAKRIRKVIEEDRDLNRRIAKKLDELNRRAEELLKRIADRAK

SEQ ID NO: 22241 - protein, 59 aa, Artificial Sequence
  Synthetic
SSKETVKDVLRKITKRIRDLVRESKKTSDESNKHIKELLERSKKTIDELERRIEDLRRR

SEQ ID NO: 22242 - protein, 59 aa, Artificial Sequence
  Synthetic
EELLRRLIKELEDLMREIERKLRELNERDKRLNEEIAKKLEKLNRDARKLVEEIERRAR

SEQ ID NO: 22243 - protein, 59 aa, Artificial Sequence
  Synthetic
KLREDLEEMLRRSEKHIRDLVKRSEETSRDSNRHIEKLLKDSRKTIEDLKRKIEDLARK

SEQ ID NO: 22244 - protein, 59 aa, Artificial Sequence
  Synthetic
RELLERLIRELKRLNEEIAKKLEDLNREDRRLNEEIAKRLRDLNEELKKLVEDIERRAR

SEQ ID NO: 22245 - protein, 60 aa, Artificial Sequence
  Synthetic
RSKEEVDKMLERLRERIEKLVEESRKTSKESNEHLEKLFRESEETIKELKKRIEDLRRKG

SEQ ID NO: 22246 - protein, 59 aa, Artificial Sequence
  Synthetic
EDLLEKLIRELEELIRRIEKKLRDLNREDRELNKRIADEIERLNREARRLIEEIRKRAE

SEQ ID NO: 22247 - protein, 59 aa, Artificial Sequence
  Synthetic
SLEEEVRREIERSRRHIEKLVRDSERTSKESNKHIKKLLDESKRTLDEIRKRIEDLARK

SEQ ID NO: 22248 - protein, 59 aa, Artificial Sequence
  Synthetic
REVLKELIRELRRLNEEIRKKLEKLNDEDRRLNEEIRRKLEEINEELRRLVREIEERAR

SEQ ID NO: 22249 - protein, 60 aa, Artificial Sequence
  Synthetic
SLEETVEEVLRRLRRKIEKLVTESEETIRRSKKHIEEVLEKSKRTLDKIKEDIDRLRKEG

SEQ ID NO: 22250 - protein, 59 aa, Artificial Sequence
  Synthetic
REVLKELIDRARELIERIARKLTELNKENRKLNEEIARRVEELNKELKRLLKEIEDRAR

SEQ ID NO: 22251 - protein, 60 aa, Artificial Sequence
  Synthetic
STKETVARELERSRKHLEDSFREAERAIKESEEHIRELLERSRRTLKEIEDRIRDLRRRG

SEQ ID NO: 22252 - protein, 59 aa, Artificial Sequence
  Synthetic
ERLLRELIEELRRLNRKIHEDNRRLIEDNKRLNEEIKRELDKLNRELERETEEIKKRAD

SEQ ID NO: 22253 - protein, 57 aa, Artificial Sequence
  Synthetic
SVRETLREVLKESKKHLDDLVRRVKEEIERSKKHIDDLIRRNKESLDDIRRTVEEKI

SEQ ID NO: 22254 - protein, 59 aa, Artificial Sequence
  Synthetic
SDLVRELIKRLKEINDRVAERIKDIIRKVREANKDLERKLRELNKRSRDVLEEVVRAEE

SEQ ID NO: 22255 - protein, 57 aa, Artificial Sequence
  Synthetic
SAAEEAEKASKDSEKHIKDLIRRLREVSEESRRHLRRLIEENKRSLEEIEKEVRKKV

SEQ ID NO: 22256 - protein, 59 aa, Artificial Sequence
  Synthetic
TELIKRIIDRNREINRRVAEAIKKIIKDNRDINEDLERKLRKLNEESKRVLDDVVRREK

SEQ ID NO: 22257 - protein, 57 aa, Artificial Sequence
  Synthetic
SVEERLKDELRKSEEHLRRLIRELEKALEDSKRHADRLIKENRDSLRRIEDKARKKI

SEQ ID NO: 22258 - protein, 59 aa, Artificial Sequence
  Synthetic
DETVKRIIEENRRINEDLARKIKEIIRDNKRFNEEVEEKLKRLNDTSEEILRRLVRRDE

SEQ ID NO: 22259 - protein, 57 aa, Artificial Sequence
  Synthetic
SVDKELEEVIRRSKDHLEKLIKEAEDALKRSEEHLRKLIEEVKRRLEEVEKRVREKV

SEQ ID NO: 22260 - protein, 59 aa, Artificial Sequence
  Synthetic
SELIKRLIKENKEINEKLAREIEEIIKENKRINDELKKRLEELIERLERILEEVERRER

SEQ ID NO: 22261 - protein, 57 aa, Artificial Sequence
  Synthetic
SVDRTLEEVIKDSRRHVKELIDRLEKVIKESEENVKRTVDDNERSLKEIADTVRREI

SEQ ID NO: 22262 - protein, 59 aa, Artificial Sequence
  Synthetic
SEDIKRLIDTNRKINRDVAETIKEIIKEVRKINKEIDDKARELNKESRRVLEEVVRAER

SEQ ID NO: 22263 - protein, 57 aa, Artificial Sequence
  Synthetic
SVAETLRKVLKESEENVKRTVDRAEEELKKSEEHLRRLVERLKEVLEDVRRRVEEEV

SEQ ID NO: 22264 - protein, 59 aa, Artificial Sequence
  Synthetic
DERVERIIRELREVNERLDREVERLIRENREINRRLAEEIKDLIRRLREILREVVERAK

SEQ ID NO: 22265 - protein, 57 aa, Artificial Sequence
  Synthetic
SIAEKVEKVLKESKENLDETIRRAEEDLKRSRDHLRKLIEENKRSLDRIKEEVDRRI

SEQ ID NO: 22266 - protein, 59 aa, Artificial Sequence
  Synthetic
SDAIEKLITDLRKINEEADRKVKEIIKRNRDINKKVEDDLRELNKESTTVLREVVERER

SEQ ID NO: 22267 - protein, 60 aa, Artificial Sequence
  Synthetic
SELEKIIEDARRVLEEDERRNREVNRKLRKILEDNERLNREVNKRLREILKRLKEELKRL

SEQ ID NO: 22268 - protein, 55 aa, Artificial Sequence
  Synthetic
EEAKRALDKIREDVRKILEDTKRELEDVRRRVEEILRETREELKRVEDDVKRAED

SEQ ID NO: 22269 - protein, 60 aa, Artificial Sequence
  Synthetic
SELEDIIRKLDEILKRNEEENRRVIRRLRELLEEDERRNRKAIEDLERIITKLKDDVRKL

SEQ ID NO: 22270 - protein, 55 aa, Artificial Sequence
  Synthetic
RDAERRIREVEEEVKRILEETEEVLRDVKRRVDEILKTTEDRIREIEEEIKRTVK

SEQ ID NO: 22271 - protein, 60 aa, Artificial Sequence
  Synthetic
DELRDIIRELRDILRENKKRNEDAIRKLRKILKENEKKNRDAIRELEDILEKLRKEIEDL

SEQ ID NO: 22272 - protein, 55 aa, Artificial Sequence
  Synthetic
RKVEEDIKRVEEEVKKILDKTDEELKEVERRVRKILRETEEELKRVEDEVRRAKT

SEQ ID NO: 22273 - protein, 60 aa, Artificial Sequence
  Synthetic
REEEKARRVMEKLKRDVDRINTRHRDILKKIEDEVRRIDEEHKTEVKKIKDRAEEIIRRI

SEQ ID NO: 22274 - protein, 55 aa, Artificial Sequence
  Synthetic
KDLIREVEKILKDIEDLVRESERELREILKDIKRMVDESLKRLEDILRELEERTR

SEQ ID NO: 22275 - protein, 60 aa, Artificial Sequence
  Synthetic
REEEEMRKVVKDLEDAARELDRDHETKLRRIEEEVKKLNEEHKRELERIARRIKEIIDRI

SEQ ID NO: 22276 - protein, 55 aa, Artificial Sequence
  Synthetic
KDLIRRLEEILRRIARELEDSLRKLEKILEEIKEIVKKSLDELRRIVDELEKRVR

SEQ ID NO: 22277 - protein, 60 aa, Artificial Sequence
  Synthetic
SEEEEVRRVLKRIAEEVKRLDEDHRRILEEIRKKVEKSSRDHKRELDKIKRDADEIIRRI

SEQ ID NO: 22278 - protein, 55 aa, Artificial Sequence
  Synthetic
KDLIKKLEEILEEIRRLLEESLRELEDILKKVHDRNARTLERLREILKEIEDRAR

SEQ ID NO: 22279 - protein, 60 aa, Artificial Sequence
  Synthetic
DEKRKVDKRLKEIEETIRRLLEEHRRELDEIRKRIEEISRRHRKELEDIEREVRKIISRI

SEQ ID NO: 22280 - protein, 55 aa, Artificial Sequence
  Synthetic
EDLIRDVERVMREVKRDLERSLEELRDVVRRAEEEVRATLRKLREILKKVEDETR

SEQ ID NO: 22281 - protein, 60 aa, Artificial Sequence
  Synthetic
SEEETMRKVVKEIREKVRRISERHKEELERITDALRRSSKRHEDELREIEKAVREIIRRI

SEQ ID NO: 22282 - protein, 55 aa, Artificial Sequence
  Synthetic
DKLIRELEEILERLEREVRKSLDRLRKILEDIHRTNKDTLDRLREILKKVEDRTR

SEQ ID NO: 22283 - protein, 59 aa, Artificial Sequence
  Synthetic
SEVEEVIRRLEELVDRLHKINKRAIEENERLNRELHEKNRDIIRKLKELVERLRDIKEK

SEQ ID NO: 22284 - protein, 59 aa, Artificial Sequence
  Synthetic
KETADRARDEVRRIEKELDDSLRELEKRVRDSKRHLDRSLEELEKVVDEIRKELEDLAK

SEQ ID NO: 22285 - protein, 59 aa, Artificial Sequence
  Synthetic
KEVEEVIKRLRELVDRLEKENRDVNEDNKRLNEELHDRNRKMIEELRRLVTELEDIRRK

SEQ ID NO: 22286 - protein, 59 aa, Artificial Sequence
  Synthetic
KDLLKRVEDEARKIEEKLKRIHEETKKVADDSERHLRKSLRELEKVAREIKKRLEEERK

SEQ ID NO: 22287 - protein, 59 aa, Artificial Sequence
  Synthetic
DEVREIIKDLRRLLKELEERNREINDRNKKLNDTLRKELEDIKRRLEKLLRELEKIVRE

SEQ ID NO: 22288 - protein, 59 aa, Artificial Sequence
  Synthetic
EEVLRRVEEEVRDIERRLDKIHEDTRDTAEKSERHLDALLRDLERVAREIEEALDRLKD

SEQ ID NO: 22289 - protein, 59 aa, Artificial Sequence
  Synthetic
SEVEEVIRRLRELLRTLEEENRKMIRENERLLEELKKRNEDIERELRKLVTELAKIADK

SEQ ID NO: 22290 - protein, 59 aa, Artificial Sequence
  Synthetic
EKLARELREVAERIKKRLDEIDETTRRMVTESIKRLEEIDKRTTERAREIKKELRDRAT

SEQ ID NO: 22291 - protein, 59 aa, Artificial Sequence
  Synthetic
SEVEDLIRRLEELLDRIRRDNERIIKELEELLRELEETNKRLIERIRKLLEDLRDTVRK

SEQ ID NO: 22292 - protein, 59 aa, Artificial Sequence
  Synthetic
EKLMREAKEAVDRIKKRLDEINKRTEDVARRIRKRLDEIDERTKEEAKRIKEELDKEEK

SEQ ID NO: 22293 - protein, 59 aa, Artificial Sequence
  Synthetic
SEVEELIERLKELLERLEELNRRVNEENRRLNEELERRIRKAIEDLKDLLRRLDDIRRR

SEQ ID NO: 22294 - protein, 59 aa, Artificial Sequence
  Synthetic
EKKLRELKEVVDRLKKEIKRIDEETRKEAERSKRNLEKILRDLEREAKRLKEEIDKKAR

SEQ ID NO: 22295 - protein, 59 aa, Artificial Sequence
  Synthetic
DEIRDLLRRLRELNKRIADRIRKLNEENKKLNKEVADKIRKLNREAREIIKTIAEIIKS

SEQ ID NO: 22296 - protein, 59 aa, Artificial Sequence
  Synthetic
KEVLDRAKEEVDRSRKHLKELLDRSRETSDRSRRHLKDLMRRSRETIRKLDEELKRLEK

SEQ ID NO: 22297 - protein, 59 aa, Artificial Sequence
  Synthetic
SEIEKLIREAERIIEEIAKEIKDLNEENERLNREVDKRLTDLNRRAKELLEEVKRIIDR

SEQ ID NO: 22298 - protein, 59 aa, Artificial Sequence
  Synthetic
EEKLRDARREIERLRRELEKLLEDSRRTSEESRRNLERSLDESRKTIEELIKRLDDAER

SEQ ID NO: 22299 - protein, 59 aa, Artificial Sequence
  Synthetic
SEIEKLIEDAKRILEEVARRLKKINEDNDRLVRKIADELRRLIEEAKKILDEIKKIIED

SEQ ID NO: 22300 - protein, 59 aa, Artificial Sequence
  Synthetic
EDVLREVRKVIKKLRDELEELARRSRKTSEDSRKRLDDLLKRAREVIEELKKRLEDLRR

SEQ ID NO: 22301 - protein, 59 aa, Artificial Sequence
  Synthetic
KDIEKLIKDLEKLNRDIAKRIRDLNETNKKLVRDVAEEIKRLNEELKKLLEDIRRIIER

SEQ ID NO: 22302 - protein, 59 aa, Artificial Sequence
  Synthetic
EEVLKRAREMVKRSKEHLDELLKRSEDTSRESKRRLEKLLKESEDTIRRLEEELKKAEK

SEQ ID NO: 22303 - protein, 59 aa, Artificial Sequence
  Synthetic
KEIEELLEEIERILREIKKDLERINKENEKLNREVKKKIEDLIREVRKIIEEIRRIIER

SEQ ID NO: 22304 - protein, 59 aa, Artificial Sequence
  Synthetic
ERKLKEVRDTIEELKKRLEKLAKESRDTSRRSRENLERLAREFREEIKRLKKELEEART

SEQ ID NO: 22305 - protein, 59 aa, Artificial Sequence
  Synthetic
SEIEKLIRDAEKILEEIAELIKRLNEENKELNERVAKRIKDLNEELRRLLKEIADIIRR

SEQ ID NO: 22306 - protein, 59 aa, Artificial Sequence
  Synthetic
REELEKVRKVIDKLREELKRLERESERTSEESRRNLERLLRESRKTVEEIKKRLDELRK

SEQ ID NO: 22307 - protein, 59 aa, Artificial Sequence
  Synthetic
SDIERLIAELEKLNKEIEDKIRELNRENRRLNKEIDEEIERLIEEARKIIEDIREIIRR

SEQ ID NO: 22308 - protein, 59 aa, Artificial Sequence
  Synthetic
RKKVEEARKKIEDSKRHLEELLRDSRRTVKESNDNLRRSAEKARREIKRLEEALKELRR

SEQ ID NO: 22309 - protein, 60 aa, Artificial Sequence
  Synthetic
DEVEKVVRELEEVLRRNKELLEKTKKETKEALDRNRELLEDTKRKTREILERLKKVIKEG

SEQ ID NO: 22310 - protein, 59 aa, Artificial Sequence
  Synthetic
EEVVKRLRDILRRVKEAAEELHRDDERELRRVEKELEELHKDDRRVVEEVKDDVRKAEK

SEQ ID NO: 22311 - protein, 60 aa, Artificial Sequence
  Synthetic
SDAERVVRELRKILKEIEDTIRKSKKETKEMLDRNRELARKVKEELKEILRRLEKMKRDG

SEQ ID NO: 22312 - protein, 59 aa, Artificial Sequence
  Synthetic
ERLLRELRRIVEEVKRAVEELNRDDRRTLERVKREAKKIHEDLRRVVEKLERDVEEARR

SEQ ID NO: 22313 - protein, 60 aa, Artificial Sequence
  Synthetic
DEVEKLKRELDKILEDLERLHRRLEEELRRIHEENRDLSRRTKEELDRILKRIEELLRER

SEQ ID NO: 22314 - protein, 59 aa, Artificial Sequence
  Synthetic
EKVLEELRRILRRVEEAVRRLNERSEEVLRDVERRDEELNEDNKRRLEEVKKRVEDLLR

SEQ ID NO: 22315 - protein, 60 aa, Artificial Sequence
  Synthetic
SELDELKKSLEEIHRRDREKNRKLKEDLKRILDEIRKRLEESKKRLEEILREIERLLRER

SEQ ID NO: 22316 - protein, 59 aa, Artificial Sequence
  Synthetic
EKALKELRKILEDVARANEELNRDTRRTLERVEEEVEKLNRDHKRVLEKVERDVRRLTK

SEQ ID NO: 22317 - protein, 60 aa, Artificial Sequence
  Synthetic
SEVERLKEELKRILEEIKKLVDDSKKDLERIHREDKKKNEDLKKRAEEILREIRDLLTKR

SEQ ID NO: 22318 - protein, 59 aa, Artificial Sequence
  Synthetic
EKLLRDLRRVLEEVKRAVDEISKDHKRMLDAVKKANEELNDDSRRVLERVDREVKKAEK

SEQ ID NO: 22319 - protein, 61 aa, Artificial Sequence
  Synthetic
SELDRVREEAKRIDDENRKRSEDSVRDSERLLREIEELHRETKERSEELLKRVEEIVRDRG

SEQ ID NO: 22320 - protein, 59 aa, Artificial Sequence
  Synthetic
DRLLEELEKVLRESARRNERIITENRRTMKRVSEEVEKLNRDDKRRMEELEKRAREIIT

SEQ ID NO: 22321 - protein, 61 aa, Artificial Sequence
  Synthetic
SELERAVEELEKLLKELEDLHRKSKEDSKDMLRRVEELHRRTKEKSKRILEEIERRITEEG

SEQ ID NO: 22322 - protein, 59 aa, Artificial Sequence
  Synthetic
DELMRKLEEILKRVAEAIKRLIDDDRRVLKRVAEEVKKLNEDDKRVADEVSERIKERLT

SEQ ID NO: 22323 - protein, 61 aa, Artificial Sequence
  Synthetic
DELEEAEERLREIDKRNEDLHEESRKESKRLLDELRKLVEDVKRELEKILEEAKDIVRKRG

SEQ ID NO: 22324 - protein, 59 aa, Artificial Sequence
  Synthetic
KEKLEKLRDVLRESERRNRELIEEDKEVMRRVSEEVKKLIDDLRRALEKAARDVEKIRR

SEQ ID NO: 22325 - protein, 61 aa, Artificial Sequence
  Synthetic
SELEDAERRAEEIDRRNKRTVERVEEELEKILREVEELHRRTEEKSKRILDEIRRKIRDRG

SEQ ID NO: 22326 - protein, 59 aa, Artificial Sequence
  Synthetic
KELADKLRDVLRRSAEENKKIIDRLRKILEDVARAVEELIKRDKRVMEEVKKEIDKLLT

SEQ ID NO: 22327 - protein, 58 aa, Artificial Sequence
  Synthetic
SEVEEIKKRARKLLEEVREIVDRVKKLHERLLREIEKTNREAKREHKRVLDTIRDIFR

SEQ ID NO: 22328 - protein, 58 aa, Artificial Sequence
  Synthetic
ETVADLDREIRRLKDELRRILEDLRRVSEEVKKELEKLTRDTRRVSKEVKDELKKVEK

SEQ ID NO: 22329 - protein, 60 aa, Artificial Sequence
  Synthetic
REVDEIKKRLTEMLETVRKIVEEIRRELEKLLEDVREINERVKEEHERILKDIRDVARKI

SEQ ID NO: 22330 - protein, 58 aa, Artificial Sequence
  Synthetic
ETMEDLKRRVREVEKRLEEILRRLDDVVRKIKEELKKLTDDTRRVSKRVKDDLERTRT

SEQ ID NO: 22331 - protein, 58 aa, Artificial Sequence
  Synthetic
SRVEEIKKELRRLLEEVRKKNEESKERDRRLNDTIRRELEEIIRRLRKLLEEIRRLRE

SEQ ID NO: 22332 - protein, 58 aa, Artificial Sequence
  Synthetic
RTVEDLRRVVEKVLRDIKRSIDDVRRENKKSNEDARRWLEELKREVKRLKDELREIEK

SEQ ID NO: 22333 - protein, 59 aa, Artificial Sequence
  Synthetic
SEVERIKRELERLLKEVKDANKRVKDTLRKLLRDVEEMNRRVKRENHELLRRLDELVKA

SEQ ID NO: 22334 - protein, 59 aa, Artificial Sequence
  Synthetic
EELLKDVRKVAKEVEEELKKLHDDTKRVADKVKEDLDRLHRDSERNARRSEEEMDKRRK

SEQ ID NO: 22335 - protein, 59 aa, Artificial Sequence
  Synthetic
DRVREVKERLKKLLEEVERTNREVMERNHRLLEDVERKNRRVKEENHRLLEELKRLRED

SEQ ID NO: 22336 - protein, 59 aa, Artificial Sequence
  Synthetic
ERLLEDVERTAERVERELDRLHEETKRNADRSREELEKLHRDSEKNARDSAKELEKIRR

SEQ ID NO: 22337 - protein, 59 aa, Artificial Sequence
  Synthetic
DEVERAEEELERLLRELKKLHEDAKERARELLKRIEDVNRKVKEELKRLLDTIRKLREA

SEQ ID NO: 22338 - protein, 59 aa, Artificial Sequence
  Synthetic
KDLLEKVKRVVEEVHKRSRELNEDTRRVIDKVEKDLDELHRDSRRVVETVKEELEKLRK

SEQ ID NO: 22339 - protein, 59 aa, Artificial Sequence
  Synthetic
KEVEEVKRRLREVLKRLKEMHERVKRELEKLLKKVEDFNRDVKRKNHDLLRRLEELKKA

SEQ ID NO: 22340 - protein, 59 aa, Artificial Sequence
  Synthetic
KDLLEDVEREARRLHDESRKLNEDTKRVVDTVTEELKKLHRDSERNAKRSEEEMDKRRK

SEQ ID NO: 22341 - protein, 59 aa, Artificial Sequence
  Synthetic
DEVERVKETLDKLLDDVRKLNEEVKKRLEELLEKVERDNRKVKEDNHRLLEEVKDLKRR

SEQ ID NO: 22342 - protein, 59 aa, Artificial Sequence
  Synthetic
KDLLEDVERRAKRVEEELDKLHEDTRREADRVRRDLRRLDEDTKRNVDESRKELEKTRK

SEQ ID NO: 22343 - protein, 60 aa, Artificial Sequence
  Synthetic
SEVEEVIRRIRALVEEIARKNEDILRKNRKLLEDLRELVERVIKEIKELIDRLADEVRRV

SEQ ID NO: 22344 - protein, 59 aa, Artificial Sequence
  Synthetic
DRVRKEVEEVLRDVEERIRRLDEEVRRRAEESERELERLREKVEDMIEKVKRALEELRR

SEQ ID NO: 22345 - protein, 60 aa, Artificial Sequence
  Synthetic
SELEEIIKKLRKLVEDVARRNEELIKKLEETNKRLEDEVRELIEEIKKLIDELAETVKRI

SEQ ID NO: 22346 - protein, 59 aa, Artificial Sequence
  Synthetic
EEMKKRLRDVAEKLKEDVRDLDRKVKKVAKESHERNRRILKELEEVAARVTERLEELRR

SEQ ID NO: 22347 - protein, 55 aa, Artificial Sequence
  Synthetic
DEDERVDEVIKKVREDLRKLLEDSERVVKRSKEELDRWRKKVEDVMRDSDRRLEE

SEQ ID NO: 22348 - protein, 55 aa, Artificial Sequence
  Synthetic
EEVIKELKKLIDKLREDSKKTIEENKKMNKDAADEIEKIIEDNRRLIKRIEEEDR

SEQ ID NO: 22349 - protein, 55 aa, Artificial Sequence
  Synthetic
SEDERVEEVVKRIEDKLRRLLEESKRVVDDSKRRLDEWRKEVEKVVKKSTDDLEK

SEQ ID NO: 22350 - protein, 55 aa, Artificial Sequence
  Synthetic
EEVIKELEELIERLARISKKTIEEDRRVNKELAERIKEIIERNRRVIEEARERLR

SEQ ID NO: 22351 - protein, 59 aa, Artificial Sequence
  Synthetic
KELEELIEELERLNREINERAKELIKKLRKLNEEVARRHERLIEELRRILEELKELLER

SEQ ID NO: 22352 - protein, 59 aa, Artificial Sequence
  Synthetic
EELRRRAKRVLEESKRNIEKVAEDVTRVLRESEESLERLRERSERVLREVEKTIRDMAR

SEQ ID NO: 22353 - protein, 59 aa, Artificial Sequence
  Synthetic
SEVERLIEELDELNRRINEKHKKLRRELEELNKRVAERHEELIRRLRKLLEDLERLARR

SEQ ID NO: 22354 - protein, 59 aa, Artificial Sequence
  Synthetic
EELRKRVEDALRRSKENIKRLEEESREVLRRSEKSIDELRRESERVLKEVKEEIERVRK

SEQ ID NO: 22355 - protein, 59 aa, Artificial Sequence
  Synthetic
SELEELIKELRDLNRRINKRVDDLADELRRLNERINRRHEELIKELRRLLEDLKRKFDR

SEQ ID NO: 22356 - protein, 59 aa, Artificial Sequence
  Synthetic
EELKKRADDVLRESKENIERVERKIRRVLEESEENIEDLRRRSKEVLDEVRKRIEDIRR

SEQ ID NO: 22357 - protein, 59 aa, Artificial Sequence
  Synthetic
SELEELIRRLKELNKDVNEKHKRLIEELEKLNRDINERHKELIEELERLLRRLEKLLRD

SEQ ID NO: 22358 - protein, 59 aa, Artificial Sequence
  Synthetic
EDLRREAERVLRESEENIKELEDRSRDALRRSEENIRRLKKESEDVLREARREVERLER

SEQ ID NO: 22359 - protein, 59 aa, Artificial Sequence
  Synthetic
SLEEELDKVLKESRDNVRRVEEELEEVMEKSERAAEKLRRDLDRVLEELEKMIRDLKRR

SEQ ID NO: 22360 - protein, 59 aa, Artificial Sequence
  Synthetic
REDIKRVIDTLRKLNERLNREVKEVIKRNEELVRRLAERVKKVVEDLRRLVKRLDDEVR

SEQ ID NO: 22361 - protein, 60 aa, Artificial Sequence
  Synthetic
SLEETLKEVLRKSEENAERLKRELEKVLRKLEEDLRRLDERLDEVLKRSRDEARKLREAD

SEQ ID NO: 22362 - protein, 59 aa, Artificial Sequence
  Synthetic
REVIKRVIEDLDRLNDELNKEVEEVIRRLEDIVRELEKKIREVIKRNKELVDRLEEKVR

SEQ ID NO: 22363 - protein, 59 aa, Artificial Sequence
  Synthetic
DLEKRLRDVLKESDENIEELRRELREVLKESEDNVKKLAEENKEVTDRLREEIKRLKEE

SEQ ID NO: 22364 - protein, 59 aa, Artificial Sequence
  Synthetic
KEEIERVIRELKDLNRRLNEELKRAIKRIKELNKRLNELSKRSIDELRRLVEELERRVK

SEQ ID NO: 22365 - protein, 61 aa, Artificial Sequence
  Synthetic
SLKEKLEEVLRRSEENVERLRKENEDVAKKNREAIEEIKKRLDDVLRELRERIERLKKEGV

SEQ ID NO: 22366 - protein, 59 aa, Artificial Sequence
  Synthetic
EEVIDRAVEELKKLNDDLNRTVKKVIRESEELTETLRKDVKRVVDDLRRLVEELARRVK

SEQ ID NO: 22367 - protein, 59 aa, Artificial Sequence
  Synthetic
DLEEELKEVLKESEENIERLKRENDRVVEKNKKAVDDLRERNKRVTERLREEIERLKRR

SEQ ID NO: 22368 - protein, 59 aa, Artificial Sequence
  Synthetic
KKDIKRVIDELRKLNEDLNRRVKEAIKTSEKITDDLRRMSEESEKELRELVRRLEERVR

SEQ ID NO: 22369 - protein, 60 aa, Artificial Sequence
  Synthetic
SEVEEIIRRIDELIKRLAETVKEIVDRLRKLNKKLNDENREIIKEIRDLIRELAKEVKRI

SEQ ID NO: 22370 - protein, 59 aa, Artificial Sequence
  Synthetic
EEVRERLERVLRRVEEVIKRLKEELKKVLDESRKNVEDVTRENEKVLDEVRKTIDELRR

SEQ ID NO: 22371 - protein, 60 aa, Artificial Sequence
  Synthetic
SEVEELIKTIERLIKELEKLNEEIIKRLRDLNKRLNERNEEIERTLRKLITDLARMVREV

SEQ ID NO: 22372 - protein, 59 aa, Artificial Sequence
  Synthetic
EEVLRRLEEVLDRVKKKIKTLTDKNREVLERSRENVKKVTEDNERVLRKLKEDIERLRK

SEQ ID NO: 22373 - protein, 60 aa, Artificial Sequence
  Synthetic
SELEEALKDIKRLIDKLRKDNEDIIRRLRETNDELRKLNKKIIDEIRDLIRRLEEVAKRI

SEQ ID NO: 22374 - protein, 59 aa, Artificial Sequence
  Synthetic
KDLKKRLEDVVKRVREEIEKLTRDNERVLEESRRTLEKLTRENEKVLREVKKKIDDLRK

SEQ ID NO: 22375 - protein, 60 aa, Artificial Sequence
  Synthetic
SELEDVEEKIKRLIDRLRELNKKIEDDLRKLAKELADLNKKIIREIEELIRRLAEVVKRI

SEQ ID NO: 22376 - protein, 59 aa, Artificial Sequence
  Synthetic
EELKRRLRKVLERVKREVEKSSERNREVVERLRKELERLTRENEEVLKRVKKEIERLEK

SEQ ID NO: 22377 - protein, 60 aa, Artificial Sequence
  Synthetic
SEVDEVIKRLDELIEELRKRNDDIIREIEKLIKRLEEENKEIVDRIRELIKRLEDMVRRL

SEQ ID NO: 22378 - protein, 59 aa, Artificial Sequence
  Synthetic
KDVLDRLREVLDRLRKEIERLTRKNEEVLKDVRRRVKRSSEENEKVLKEVRERIERLKK

SEQ ID NO: 22379 - protein, 60 aa, Artificial Sequence
  Synthetic
SDVDEVIKRLRELIRENHKRNKKIVDEIRELIRELKERNKKIVDEIRELIKRLKDIVRRL

SEQ ID NO: 22380 - protein, 59 aa, Artificial Sequence
  Synthetic
EEVLRRVEEVLRELREAIKRDDEENKKVLEEARKTVEDSSRENKRVLEEVRRRLDEERR

SEQ ID NO: 22381 - protein, 59 aa, Artificial Sequence
  Synthetic
SEKERAEEVFRESKKNIDDVKRKLERVLEDSKRTLDELRKEVEKVLKESEDELRKLARS

SEQ ID NO: 22382 - protein, 55 aa, Artificial Sequence
  Synthetic
EELIREIRELNKRLNDTIEDVIRRMKDLNRRLAEVIKEIIERNKKLIEDAARRIK

SEQ ID NO: 22383 - protein, 59 aa, Artificial Sequence
  Synthetic
REKERLKEVVEKSRRNLEKLREDSERVLEKSRRTLERLKKEVEEVLKESEERLRELARS

SEQ ID NO: 22384 - protein, 55 aa, Artificial Sequence
  Synthetic
EELIKTIEDINRRANEESKRTEKELEDINRKLEEDIKRIIDRNRKMIEDAARKIK

SEQ ID NO: 22385 - protein, 59 aa, Artificial Sequence
  Synthetic
REEERLEEVLRRAEEILKRLEDEVRKVVEDSKKNIEDVRREVEEVLKKSEDRLRKLARD

SEQ ID NO: 22386 - protein, 55 aa, Artificial Sequence
  Synthetic
EELEKRLKEILDRAAEEIRRIIRELEELNKEANDRIRKIIKENEDLIREAEERTR

SEQ ID NO: 22387 - protein, 59 aa, Artificial Sequence
  Synthetic
ELEERIKKANEDSKRTLRELMERVRKANEDSKRKLEEIREKVERANRESKKILDELRKA

SEQ ID NO: 22388 - protein, 59 aa, Artificial Sequence
  Synthetic
EKVIRELIKELKDVNRALEKKAKELIDELEEVDKDLEDKVRELIRKLKEVNEDLKRKAD

SEQ ID NO: 22389 - protein, 59 aa, Artificial Sequence
  Synthetic
SLKERVKKVLEESERNLEENKKDAKRVNDETRKKLKELEDRADRVNRETERALRELEDN

SEQ ID NO: 22390 - protein, 59 aa, Artificial Sequence
  Synthetic
EKVVREVIEELKRVNDKLNDASRRLNERLKRVVEDVERRVRDLNKELEDVVEELKERTR

SEQ ID NO: 22391 - protein, 59 aa, Artificial Sequence
  Synthetic
ELEERIKRVIDELRRRLEELRRELKRVNDKTEEDLRRLEDNARRVNDTSRKMLERLEDG

SEQ ID NO: 22392 - protein, 59 aa, Artificial Sequence
  Synthetic
ETVVREIIRELEKVIEELEREVRELNRELREVVERVAKKVRDLNRELEEVIRDVKRKVD

SEQ ID NO: 22393 - protein, 59 aa, Artificial Sequence
  Synthetic
SLEDEARELRRKSEKTNDELRRAIEELEKKVRDMIRRSEEHVRDLVRKVKRVIEKLEED

SEQ ID NO: 22394 - protein, 59 aa, Artificial Sequence
  Synthetic
RKDLEELIKELKKLNDESREEIERLIRELEELLKEIEDRNRKLAETLKRLLEEVEKRAR

SEQ ID NO: 22395 - protein, 60 aa, Artificial Sequence
  Synthetic
SIEEEIKELKDRSKKTNEELKKEIDELKEDSERTNRESRKHVKEVLDRLREILERLRREG

SEQ ID NO: 22396 - protein, 59 aa, Artificial Sequence
  Synthetic
RKEIKRLIDELTELNKRSKELIKRLIEELKKLNDDSRKENKRLVREVERLAEEVDRRVK

SEQ ID NO: 22397 - protein, 59 aa, Artificial Sequence
  Synthetic
SLEEKAKRLKEESDKTNKKLRELIERLERESRRTNEELRKKIRELLEDARRELDRLRKE

SEQ ID NO: 22398 - protein, 59 aa, Artificial Sequence
  Synthetic
EKKVEELRRDLERLDRESEKKIRDLIKTLDELNKESDRKIRKLEEELKRLLEEVEKRVR

SEQ ID NO: 22399 - protein, 59 aa, Artificial Sequence
  Synthetic
DIEKKIEDLRRKAKKVIDDLRKRSDELKKRSKDTNDRLREELKKLEEDVRRVIEDLRRR

SEQ ID NO: 22400 - protein, 59 aa, Artificial Sequence
  Synthetic
DKDIEKLIRDLEKLLRDVEERHEDLRRKAEELDRDTKEKVDRLIKELKDLLKEVRDRVR

SEQ ID NO: 22401 - protein, 60 aa, Artificial Sequence
  Synthetic
SLKEKLDDLVRKSDDTNKDLEEKARRLVEDAKRVLKELEDKSRRLVEEARKVLKRLEEEG

SEQ ID NO: 22402 - protein, 59 aa, Artificial Sequence
  Synthetic
DKKIKELIEELEDLDRRSKKAVEDLIKELKKLIDEVREIHDRLEEELRRLIKTVRDKAR

SEQ ID NO: 22403 - protein, 59 aa, Artificial Sequence
  Synthetic
SLEDKVRKLEEEIKKVLKEIREEVERLLEEDRRTLEDLKRRHRESDRESKEVLDEIAKK

SEQ ID NO: 22404 - protein, 59 aa, Artificial Sequence
  Synthetic
DKVIKEVIDTLRKRLEELKRRLEDVIREVRKANEDSERESRDVIRKLKELLERLKEKVK

SEQ ID NO: 22405 - protein, 60 aa, Artificial Sequence
  Synthetic
SEEEKLKEVKDRIREVLRKLEEHTDKVKKEVEKVLRDIRRTTDELKKEVRAMLERLRRKK

SEQ ID NO: 22406 - protein, 55 aa, Artificial Sequence
  Synthetic
DELVTEVEKLLRDDEETNRDVVKKVREAVKKDADTNRKVIEEVKKVLEDAARRLD

SEQ ID NO: 22407 - protein, 60 aa, Artificial Sequence
  Synthetic
SEEEKLERVERRLEKVLDEIRRHTEDVKRKDEENLDRLRKKIEKLKRELEKVLRDLEEKR

SEQ ID NO: 22408 - protein, 55 aa, Artificial Sequence
  Synthetic
DELVKKLEELLEEDKDTNRKVVKEIEDANRRVNEELDRVIEELKRILEELERRLR

SEQ ID NO: 22409 - protein, 59 aa, Artificial Sequence
  Synthetic
SEVDEVRKTLEDLLRRLDEENKDIIRRNKELLDDLDRKVREAIERLKRLLDELRKILEK

SEQ ID NO: 22410 - protein, 59 aa, Artificial Sequence
  Synthetic
EELARRITELEKRVREVIERLKEKNKRLEDDSRRVITELRKKLKDLEDRVREEIEELRK

SEQ ID NO: 22411 - protein, 58 aa, Artificial Sequence
  Synthetic
SEVERVKEELKRLLEDLDRKNKRMIDEDERLNKELNEENERLIRELEELLKRLKEIRD

SEQ ID NO: 22412 - protein, 59 aa, Artificial Sequence
  Synthetic
EEVKREIDKLREEIREVIERLDKKNEDVLRKSEKNVRDLNRENEEVLRRATEAVRELER

SEQ ID NO: 22413 - protein, 59 aa, Artificial Sequence
  Synthetic
DEVDKVTRTLEELLKRLEEENRKMIEDDKRLNEELNKENRRVEETLRKLLKELEDIRKD

SEQ ID NO: 22414 - protein, 59 aa, Artificial Sequence
  Synthetic
KEVKEKIDRLEKRIRDAIRELNERNKKALDDSERNVRELNKRNERLREEVERKIRELER

SEQ ID NO: 22415 - protein, 59 aa, Artificial Sequence
  Synthetic
SEVDEVAKRLRDLLRELEEKLKRAEDRDRKLNDDLNKTNKKLIKELEDLLRKLEEIARR

SEQ ID NO: 22416 - protein, 59 aa, Artificial Sequence
  Synthetic
DEVRRKIDELEREIKEVVDRLRRRLEELLRRSKENVDRLNRENDRVLEEAKRKIRELEK

SEQ ID NO: 22417 - protein, 59 aa, Artificial Sequence
  Synthetic
SEVDEVADRLEKRLKENRDKNKRVEDEDKRLNKELNDTNRRMEEELKRLLTEIDDIRRK

SEQ ID NO: 22418 - protein, 59 aa, Artificial Sequence
  Synthetic
EEVRKKIDELERRLKEVIDDSKRRNDELERESRENVRELNRRNKELEDEARKEVERAKK

SEQ ID NO: 22419 - protein, 59 aa, Artificial Sequence
  Synthetic
SRVDEVIERLERLLRELDKINRDMIEDDKRLNTELNKENKEVEDRLRRLLEELEEIRKK

SEQ ID NO: 22420 - protein, 59 aa, Artificial Sequence
  Synthetic
KEALDKIRRLEERARRVIEELDEKNRRALERSKENVKRLDERNERLRKELEEKVRRLRK

SEQ ID NO: 22421 - protein, 58 aa, Artificial Sequence
  Synthetic
DVEEKVKKVIRELREVLKEIEERVRRVLERNKRSLEDLKRKHKESIDRAKEVLDEIRK

SEQ ID NO: 22422 - protein, 59 aa, Artificial Sequence
  Synthetic
EEALKRLEDKLREKLRDLRRKLDELRKENEKVNRDLEDKTRRVIEKLKRVITKLKEEVK

SEQ ID NO: 22423 - protein, 60 aa, Artificial Sequence
  Synthetic
SEIEEVEKRLEDVLRKVNKKTEDLMRSVKEIIKRSREHLEKVIRDLEEILKELRELRKRG

SEQ ID NO: 22424 - protein, 59 aa, Artificial Sequence
  Synthetic
EDVKRRIEEVEERLKRDNERNNKKIEDVNRDNRRVAEELRRRVEDVKRKIEKVLRELKK

SEQ ID NO: 22425 - protein, 59 aa, Artificial Sequence
  Synthetic
DVEELLDRVTKRVEKALRELRKKVRELKEENRKSVEELEETSKRLKKEVDDVERRLEAG

SEQ ID NO: 22426 - protein, 59 aa, Artificial Sequence
  Synthetic
REKLKKVLEEIEKILKEIEDKVRRVIEKSRRINEENKETNRRVIEDVRRLLKKAEEDLR

SEQ ID NO: 22427 - protein, 60 aa, Artificial Sequence
  Synthetic
RVEERLDEVRKKIDEVLKRLRDTTKELEDENEESLRKLKKEVDEVRKKIEEVLKRLEDAN

SEQ ID NO: 22428 - protein, 59 aa, Artificial Sequence
  Synthetic
EEKLEKVDREIEEILRRNKRTNEKVAEESRKINREAEERLRRVIEELEKILKEIEDRLK

SEQ ID NO: 22429 - protein, 60 aa, Artificial Sequence
  Synthetic
SVEKKLKDVEDEIRKVLRELEETSKKLDKEVDDMLKKLKDSTEEVKKEIDEMLKRLEERR

SEQ ID NO: 22430 - protein, 59 aa, Artificial Sequence
  Synthetic
DEKLDKVVKDLRKLLEDDKRTNKEVIDRVRRKLEENKETNEKVIKELRDILREIEERAR

SEQ ID NO: 22431 - protein, 60 aa, Artificial Sequence
  Synthetic
SEIEDVARRIRKLLEELRRRIRKIAEDSRRLNRRLEERNTEMEKEIKDRLRKLEEELKRK

SEQ ID NO: 22432 - protein, 59 aa, Artificial Sequence
  Synthetic
EEVKEKIDRLEKEIRDMLKELRERIKRLKDENEKSLEDLRRRNTELEEEVRRVIRELEK

SEQ ID NO: 22433 - protein, 60 aa, Artificial Sequence
  Synthetic
SELEKVAEDIRRLLKRNEEINREMIKRSRELNEELRERNREVTERIRRLLERLKEERKRT

SEQ ID NO: 22434 - protein, 59 aa, Artificial Sequence
  Synthetic
DELEKKLRDLEREIRKVLREAKRLNDELRKENKESLERLKRENDKLRKEVETVIREAEK

SEQ ID NO: 22435 - protein, 60 aa, Artificial Sequence
  Synthetic
DEIEEVIRRIKRLLDENRKKNEEMSDRSRKLNERLRKIIKKIIDEITELLKRLEDRARTV

SEQ ID NO: 22436 - protein, 59 aa, Artificial Sequence
  Synthetic
RKVDKKIEDLRKEIEDVLKELAERNKENKDRNKKSADELRKEIEDLERKVREVIRELTR

SEQ ID NO: 22437 - protein, 60 aa, Artificial Sequence
  Synthetic
RVEDEIRRLEEEARRVLRELEDLLRRLKKKNDESNKEIRERIERVRRKAEKVLRELERRG

SEQ ID NO: 22438 - protein, 59 aa, Artificial Sequence
  Synthetic
ERVIERLIRELRRLLEDVKRKAEDLIRKSEDLNEKWRKELKKLEREIERLLKEVADRVK

SEQ ID NO: 22439 - protein, 60 aa, Artificial Sequence
  Synthetic
EAEKELKRVEDRDKESNDRTKDILRRIEKEVRESNKRSKEILDEIRKRVRDVIEELRRKR

SEQ ID NO: 22440 - protein, 59 aa, Artificial Sequence
  Synthetic
EETVRRLKDELEEVNERTERAVRDLLRKARKVDDESRRRVEALLRKVEEVLREIKRRVD

SEQ ID NO: 22441 - protein, 60 aa, Artificial Sequence
  Synthetic
SFKETLDEIRKRVKEVLDKLEKILRDIARRVEKVNKENEDRLREINRRNEEVLRRLKKKG

SEQ ID NO: 22442 - protein, 59 aa, Artificial Sequence
  Synthetic
EDKLRELLERLERLLRELERRVEKIEEDLKRILDEVRKRTKELLERNERILEKLERDAD

SEQ ID NO: 22443 - protein, 60 aa, Artificial Sequence
  Synthetic
SIEDIVREIRERNKDAKRKVEDIVRRNREEIDKVLKRVEKILRDNEKRIREVKEELKERV

SEQ ID NO: 22444 - protein, 59 aa, Artificial Sequence
  Synthetic
EKDLDKVRKESEDNLREILRTLKEVHERSKETLKRIEDTLRRVHKKSEDELRRLREEVR

SEQ ID NO: 22445 - protein, 60 aa, Artificial Sequence
  Synthetic
SIEEIAKTIKEEIKEVMDRVREIVERDEREIKKVKEEVDRIAKRNEDEIRKVKDELDKKV

SEQ ID NO: 22446 - protein, 59 aa, Artificial Sequence
  Synthetic
EEAMKEVADRVRKKLEEIERTLEEVHRKSRKVLTEIIKKLKENHDRSKELLDRIREEVK

SEQ ID NO: 22447 - protein, 59 aa, Artificial Sequence
  Synthetic
SEVEEVLKEIKDLLRRLEEIVRRVLKENRRLLEEDVRRTEEILEELERLLDELRKDIKR

SEQ ID NO: 22448 - protein, 56 aa, Artificial Sequence
  Synthetic
EELLKRIEDEVRRVEDKLRKLIKRSKEESDKVAEELERLNREARKRIRDVMEELKR

SEQ ID NO: 22449 - protein, 60 aa, Artificial Sequence
  Synthetic
DEAEEILRRLKKLLEDAKRISDRTVEKNREMLKKIEEDSKRSLERNRELLKRIKELAKDI

SEQ ID NO: 22450 - protein, 56 aa, Artificial Sequence
  Synthetic
REIIERLKEEVDRLLKELRDSNRELKRESDEVVEKLRELNKRSKEEADKVEKDLRR

SEQ ID NO: 22451 - protein, 60 aa, Artificial Sequence
  Synthetic
SEVDEVLKRLRKDLDKVRKDSKKSLEELRRVLEEVERLSDESVKRLEEVLKRLEDLIKDI

SEQ ID NO: 22452 - protein, 56 aa, Artificial Sequence
  Synthetic
REIIKKLADEVREVLERLKELNRRLEKEARDAKRRLEESNDRLRRKVEEVIKELRR

SEQ ID NO: 22453 - protein, 60 aa, Artificial Sequence
  Synthetic
SEVEKLLDESRRVVEENRRANKKLAEESRKAVRRNREESKRLNEELREVVERARRKVTER

SEQ ID NO: 22454 - protein, 56 aa, Artificial Sequence
  Synthetic
EESLRRIKRTHEETEKESEKTLRDLEDEHRKTIEELERSLKELRDRIKKVLDELRK

SEQ ID NO: 22455 - protein, 56 aa, Artificial Sequence
  Synthetic
DEVEEVLKKARKDIERWREETRKVKEENKRNIDRIRKKLEEVLRDLKRAIDEIRKS

SEQ ID NO: 22456 - protein, 55 aa, Artificial Sequence
  Synthetic
REVLEEIRKLLRDIKETDRKVHEELERSNEKLRREIEKILRDLEDELRKLRRERE

SEQ ID NO: 22457 - protein, 57 aa, Artificial Sequence
  Synthetic
SEVEEVLRRAEKAIREWEEETRRAKEENEKNIKKVADDLRRLLEDARRTIEEIEKRR

SEQ ID NO: 22458 - protein, 55 aa, Artificial Sequence
  Synthetic
EEVLKEIKKLIDTARRKDEKVHKELEDTNRDLDRAIEEVIREIKKLLDDLREKAR

SEQ ID NO: 22459 - protein, 60 aa, Artificial Sequence
  Synthetic
SEKEDVLRRIKELLERLHEENREVLTRIEKLLKDNKERNDDVLRRITELLKEVTKRAKDR

SEQ ID NO: 22460 - protein, 56 aa, Artificial Sequence
  Synthetic
TEEVRKRVEDVVRKNKEVARELLDRVRKLSERNKRAIDKLLEEVKRVLEEVERALK

SEQ ID NO: 22461 - protein, 57 aa, Artificial Sequence
  Synthetic
DEERDVRREIRKLLRDAEEHSKKLNEESKKTNKRNEEENRKALEDNKRLLKEVEDRI

SEQ ID NO: 22462 - protein, 56 aa, Artificial Sequence
  Synthetic
VTELRERIKRLIEEIERLNREFKKKNEELSKKNKELVERSRTESKKLVDEARERAR

SEQ ID NO: 22463 - protein, 60 aa, Artificial Sequence
  Synthetic
DSEEEVRKRVKDLSEENKRLVKTAEKRVRELSKENKELVERLKREVDRIKKEIEELKRRG

SEQ ID NO: 22464 - protein, 55 aa, Artificial Sequence
  Synthetic
EKVLREIREIVKKNKRENEEVLRRIRELVKENNDENKRVLDEIEKLLKEIEDESR

SEQ ID NO: 22465 - protein, 61 aa, Artificial Sequence
  Synthetic
SEMDEVRKKLRELVERLKKEAERSRKSHREILKKVRDDLKRSEESHKELLDRLEEVLKRTV

SEQ ID NO: 22466 - protein, 59 aa, Artificial Sequence
  Synthetic
EDKLRRLLEEAAEVIKRLLDEVKRLNEHAKRMAEKILEDVKRLNKHAEDKVRDVEEKVK

SEQ ID NO: 22467 - protein, 61 aa, Artificial Sequence
  Synthetic
RELEEVARRLERLLDELRKKLRESERSVRRLLEELKKELEKLRKRHEDLLRTVKKKLDDTV

SEQ ID NO: 22468 - protein, 59 aa, Artificial Sequence
  Synthetic
EEELKRLLEEVEKAIRELLERVERLNRRLEEEIRRVLEDLERIIRHAEEDLRRIEEEVK

SEQ ID NO: 22469 - protein, 61 aa, Artificial Sequence
  Synthetic
RELEEVKKKLEKLAKDLRDTLERSARSVEELIKRLEDELRRSEESHKELLERLEDTLRKRA

SEQ ID NO: 22470 - protein, 59 aa, Artificial Sequence
  Synthetic
EEELRKLLKDATEEVRRIAEEVKKLNDELRRAVEEVLKEVRETNKHVREMIETVREEVE

SEQ ID NO: 22471 - protein, 61 aa, Artificial Sequence
  Synthetic
SELEEVAKRLKELVDDVRRALKESDDSHKELLKRLKEKLDEVRKRLKKLVDDLEETLKRTL

SEQ ID NO: 22472 - protein, 59 aa, Artificial Sequence
  Synthetic
EEELERLVREVERVIRKLKEDVKRLNDHAREKVKRVEEELRREEKRVRDEVERVKEEVR

SEQ ID NO: 22473 - protein, 61 aa, Artificial Sequence
  Synthetic
SELERVEDEARKLADDLRRMLEESRRSHEKILREVEEELKKSEESVRRILERVKEVLDRKL

SEQ ID NO: 22474 - protein, 59 aa, Artificial Sequence
  Synthetic
EDELRELLDRLRKAIKKLLDDVKRLNDHVKELIERIRDEVRRLNRRLEEEARDVERRVE

SEQ ID NO: 22475 - protein, 61 aa, Artificial Sequence
  Synthetic
DELETVREEIERLARELEKELKKSEDSVEKLLRELKERLKEVRKRHKELLDRLRDRLRKTV

SEQ ID NO: 22476 - protein, 59 aa, Artificial Sequence
  Synthetic
EEELRRLVEDVKRVVDEVLERVKELNKRLEEAIRRILEELKKIEKNVKDFIEDIDRRVK

SEQ ID NO: 22477 - protein, 61 aa, Artificial Sequence
  Synthetic
RELEEVKRRLEELLERLRKELERSDKSHKELAKKLRDELERVEREHERLLRELEDTLRKTL

SEQ ID NO: 22478 - protein, 59 aa, Artificial Sequence
  Synthetic
EKELTDLLREAKRRVEEVLKEVRDLNRNVKETVDRVLKELEDILRNVEEMIKEIKDKVR

SEQ ID NO: 22479 - protein, 56 aa, Artificial Sequence
  Synthetic
SDAEDILRKVEDLIRRLAEKHRDLLRRSKENAERIKREHDDHHRDIRRVIKEIEDN

SEQ ID NO: 22480 - protein, 55 aa, Artificial Sequence
  Synthetic
RELLKTVRDLLETLREINDRVREELRKIHEDVERRNKEVLDRNKKLLEELERKRR

SEQ ID NO: 22481 - protein, 58 aa, Artificial Sequence
  Synthetic
SELEDIERKLKELEDEDRELNRKLNDDTRRLDERNRRLNEELTKKLREVEEEAKELRK

SEQ ID NO: 22482 - protein, 55 aa, Artificial Sequence
  Synthetic
ERVREKIERIAKKLEDDNKESEDRHRRINEENRRRNDKNREDIERILRRLDEELR

SEQ ID NO: 22483 - protein, 58 aa, Artificial Sequence
  Synthetic
KELEEVDDEVRKEAEEVKRYIKESKEKLDRLRREDERLNDRVREKVEDVRRRVEERRS

SEQ ID NO: 22484 - protein, 55 aa, Artificial Sequence
  Synthetic
ERVKRKVDKIERELEDAIRRANEEHTKIEEDLRRRNKESKDEIRRILEELEERTR

SEQ ID NO: 22485 - protein, 60 aa, Artificial Sequence
  Synthetic
REIETVRREIEKILDDLRRTVKRIEDEVRKIHEDLRRSLEDSKRNIEEILKDLERAARRD

SEQ ID NO: 22486 - protein, 59 aa, Artificial Sequence
  Synthetic
KKDIDKLLKELRDLVEKIKKDLKELLERYEEIVRRIKELLKDLNREAEEVVRRLKEELR

SEQ ID NO: 22487 - protein, 60 aa, Artificial Sequence
  Synthetic
DEEERAEREIKKLLDDLRRTLEEVKEAIRRILEDNRRTTKRINDEDRKINDDLRRTLERR

SEQ ID NO: 22488 - protein, 56 aa, Artificial Sequence
  Synthetic
VDKVLKEVEETIDRVKKDIRRALREVEETSKEDKKRLREVLERSKDLARRLKEKLK

SEQ ID NO: 22489 - protein, 60 aa, Artificial Sequence
  Synthetic
SREEEAERRIEKLLRELEKTNRDIHEEIRKILERLRRTLKKVNDEDEKLNRDLEDTLRRR

SEQ ID NO: 22490 - protein, 56 aa, Artificial Sequence
  Synthetic
VEDVLRRVKEIIDRVKEEHKRMLEEVRKIAKDLEEKIRAVLEESKKLAEDIKRRLT

SEQ ID NO: 22491 - protein, 60 aa, Artificial Sequence
  Synthetic
REEEKAEEDIRRILRDLKETNRRIHEEIKKLLDDNERTLRRINEEDKKLNEDLRRTLEES

SEQ ID NO: 22492 - protein, 56 aa, Artificial Sequence
  Synthetic
VEEVLKTVEDIVRKVKREHEELLKEIEDLSRENKKDNERMLEESRRLARKLKEELR

SEQ ID NO: 22493 - protein, 60 aa, Artificial Sequence
  Synthetic
SEEEKMEEDIERLLDRLRRINKRLHDEHKKLNEDNERTVRRIDEEDKRINEDLERTLRES

SEQ ID NO: 22494 - protein, 56 aa, Artificial Sequence
  Synthetic
VRKVLEDVERIIRRLEEEHRRALEESRKRSEENKRENEEMLERSKELAERIKRRLK

SEQ ID NO: 22495 - protein, 60 aa, Artificial Sequence
  Synthetic
SEEEKAREDIKRLLEDLRRTNKKIHEDIEDILRELKETLKRVNDDDKRINDDLDRTLKER

SEQ ID NO: 22496 - protein, 56 aa, Artificial Sequence
  Synthetic
VEEVLRTVEKIIEDVKKEHEDLLKRVKDIVKKIKEEIEKVLRESEKLAREIKEELR

SEQ ID NO: 22497 - protein, 60 aa, Artificial Sequence
  Synthetic
SEEDELRKRVADILKRLREVNKRLHDEVKRLLKENRDALKEVKDKIRESNRELDEVLKRR

SEQ ID NO: 22498 - protein, 56 aa, Artificial Sequence
  Synthetic
VEEVLERLKEIVRKAEEEHKDVLRRLKEISDRHKRRLEEAERRNEKLLRDLKEELR

SEQ ID NO: 22499 - protein, 59 aa, Artificial Sequence
  Synthetic
SRLEEMLKRAEDLSRESEELLRRVLEEVKDLSRKHEEALREILKRVKDLVDTVRDLLRR

SEQ ID NO: 22500 - protein, 58 aa, Artificial Sequence
  Synthetic
EEVRKLEEELKRLLEENRRLAKELRDELRRLTKRNKDVVREVERRLEEIMKEIDKEVR

SEQ ID NO: 22501 - protein, 60 aa, Artificial Sequence
  Synthetic
SEDERIKKELRKVEREVDKLLKEHEKILEDLKREVDKLIETHRKILEELKRRVDELKRRG

SEQ ID NO: 22502 - protein, 55 aa, Artificial Sequence
  Synthetic
ERIRRELEEVLKDIRRKLKELKERNDKVNRDIEELLRELEERNTEVDKEIKKKAD

SEQ ID NO: 22503 - protein, 56 aa, Artificial Sequence
  Synthetic
DEEKEAEDLIEEHRRRSEEIARRADKLSEDHKRKVDEIAKTVEKLIRTLKEIVDRK

SEQ ID NO: 22504 - protein, 55 aa, Artificial Sequence
  Synthetic
KELKDRVERVLEESRELLERLRKKLEDNSKEVEDILRKLRKEVEDVVRKIRKRAE

SEQ ID NO: 22505 - protein, 56 aa, Artificial Sequence
  Synthetic
RDEDEVRKLITRHEKLSRDIAERLKRESKKHRDDVERIAKENEELNRRLREIVKKK

SEQ ID NO: 22506 - protein, 55 aa, Artificial Sequence
  Synthetic
KELKDDVRRVLKKSRDELKRLREELKRNSEEVERILKKLDEDNRRVLKEIRERLT

SEQ ID NO: 22507 - protein, 63 aa, Artificial Sequence
  Synthetic
DKEREVRRRVEELKKDSEDVLRRNREEVEKLHDENRKVNEESDRTAKELVEEAERMLREARKK

SEQ ID NO: 22508 - protein, 55 aa, Artificial Sequence
  Synthetic
EELLKELKKELDRLREENERSNRRLRKMLEELKRKNEEVNRELRKKLREIKERLR

SEQ ID NO: 22509 - protein, 57 aa, Artificial Sequence
  Synthetic
SEEERLERTVEEVEKALKKLADDLRRDMDRSRKSHEDLLDKLRKELDRVLEEIRKKT

SEQ ID NO: 22510 - protein, 55 aa, Artificial Sequence
  Synthetic
EEVEKRLRELLDEARREVERILKDLRELNEHVRRRVDEVRRRLEELLERLDRETR

SEQ ID NO: 22511 - protein, 56 aa, Artificial Sequence
  Synthetic
DEKREVEKELKRVDDEIKRLLRELEEALRRDKEEVDRLDKEVKDALDEVRERIERA

SEQ ID NO: 22512 - protein, 55 aa, Artificial Sequence
  Synthetic
EKVKEDLKRLLEEVEKAVRKVVEDSKRLHDEAKEAVDRNKEHLRRLLEDAKRRAK

SEQ ID NO: 22513 - protein, 56 aa, Artificial Sequence
  Synthetic
SEKERAEEEIERSKRNLERLLEEAKREIDRSRENLKRTLTKVEEVLRKIKEDLKRL

SEQ ID NO: 22514 - protein, 55 aa, Artificial Sequence
  Synthetic
EKLIRELRELNKRLAEEIKRLIDELRKLNKELDDEVEKIIRRAEDLLRDLERETR

SEQ ID NO: 22515 - protein, 57 aa, Artificial Sequence
  Synthetic
SEVEKVIRDLEEINKRLLEEIKRSIEENKRTNEEAERKVKEVIDRLRKLLEDLKRTN

SEQ ID NO: 22516 - protein, 59 aa, Artificial Sequence
  Synthetic
EDRLKRVEDVLRESVKNLKRLVDEVRKANRESNEHLKDLARKVEKVIREIEEEVDRTRT

SEQ ID NO: 22517 - protein, 59 aa, Artificial Sequence
  Synthetic
SELERLVEELRRALEKHKRRLEELKKELKKALDDHRREVKRLIDELKKTLDDVRKASRI

SEQ ID NO: 22518 - protein, 59 aa, Artificial Sequence
  Synthetic
ERLLEDVKRILDEVRREVEKLDTDADRRLREVKEEVERINREVEKTLRDVEEDLDRLKK

SEQ ID NO: 22519 - protein, 59 aa, Artificial Sequence
  Synthetic
SEVEKLKEDLKRALDEHRKRLEELKKELEDVLRRHEEKVRRLKEKLKRILDEIRRLSRI

SEQ ID NO: 22520 - protein, 59 aa, Artificial Sequence
  Synthetic
ERLLEDLDRALDEVRKEVEKLNRDAKRTLDKVREDVKRLDDDLRRTLKRVKEEIDKLTK

SEQ ID NO: 22521 - protein, 59 aa, Artificial Sequence
  Synthetic
DEIEELKKRLRKILEEHRKRVEDLKKENEDLNRRAEETLERLKRELEEMLREIAERSRI

SEQ ID NO: 22522 - protein, 59 aa, Artificial Sequence
  Synthetic
ERILEDLKRVIERVEREVRRLNKDLKRALDESRKRIEDWLKELDDVIKRVKREVEKIRT

SEQ ID NO: 22523 - protein, 59 aa, Artificial Sequence
  Synthetic
SEAEKLKKELEEVLERARRRLTELKEENKDANRRHRRRLEELKKRLEDVLKKVKDDADI

SEQ ID NO: 22524 - protein, 59 aa, Artificial Sequence
  Synthetic
ERILRRLEEVIRRVDRDIKELIKDAREVLERSKRDVERWNREMKKVLDEVRKRVEEIRT

SEQ ID NO: 22525 - protein, 56 aa, Artificial Sequence
  Synthetic
SEDEDAKRELRRVKEEVDKTLEDSKRVHDESRKRAREWLEDSKRVHREVKERLKEL

SEQ ID NO: 22526 - protein, 55 aa, Artificial Sequence
  Synthetic
EELKRELERVLEEHRRSLEKNKRDVERINEELKRRLDRNKEELRKILEDVERRRR

SEQ ID NO: 22527 - protein, 55 aa, Artificial Sequence
  Synthetic
SEEERLRREVKRVEDENRKLLERLREIAERVHRENKRLLDESRRIADKVRRDLDR

SEQ ID NO: 22528 - protein, 56 aa, Artificial Sequence
  Synthetic
LEEVLEELERVLKRLEEEHRRVVKELRDLLRRIKEDHDRLVEEAEEILREIDERAK

SEQ ID NO: 22529 - protein, 56 aa, Artificial Sequence
  Synthetic
SEEEEADKAIRTIAKAIEDLVRDLERALKESKRNIEELAKDLKRANDRIEEELEKA

SEQ ID NO: 22530 - protein, 55 aa, Artificial Sequence
  Synthetic
KELADRLRDLLRDAKRVVDRIKRALEELNKEAKKLVERAKKKHDDLLEDVKRDTK

SEQ ID NO: 22531 - protein, 56 aa, Artificial Sequence
  Synthetic
SEEEDAKRVLDEIREELKKLNDDVRRALKESKENIDRIIEDLDRTNKRIEEELDRL

SEQ ID NO: 22532 - protein, 55 aa, Artificial Sequence
  Synthetic
EELKERLKRLLERVREEVKRNKEHLERLNKKVKEDVDRLKKRHKDTLDEVDERRK

SEQ ID NO: 22533 - protein, 60 aa, Artificial Sequence
  Synthetic
KLDEDLEKVIKEVKERLKESLDRHKEVAKRLEEEVKRSEEEHRKVLEEAKRKLEEIKTKT

SEQ ID NO: 22534 - protein, 59 aa, Artificial Sequence
  Synthetic
DRTVRKVERELRDLIRRLEKRNEELIRRVKEIVERMEKTNRDLIRRIRELIKKVEDDVR

SEQ ID NO: 22535 - protein, 63 aa, Artificial Sequence
  Synthetic
SEEEKLKRVLDEFRRAVKELLEDLERANERAKDEVRRLLEDLDRAHERIRRAVEKLKERVKDK

SEQ ID NO: 22536 - protein, 55 aa, Artificial Sequence
  Synthetic
KDLEKRIRDTLREIKKRVEDVKRDNKRVLDELRKKIEENKKRNEDVLKEMEDKTE

SEQ ID NO: 22537 - protein, 60 aa, Artificial Sequence
  Synthetic
SDAERVKKESKDLLDTTKRLADRLKELLERLNKETRDRVREVIKEIERLVDEVEKEARKG

SEQ ID NO: 22538 - protein, 59 aa, Artificial Sequence
  Synthetic
EDIRTDLEDVLRRNKEALEEIRKDIERVNRKDREELREIARTLEKVLRDARRRLEELRR

SEQ ID NO: 22539 - protein, 59 aa, Artificial Sequence
  Synthetic
SIEDDLRRVLERSKRSLEELKRKADRVLEESKKNVRDLERELKRVLEKIKETIDKLRKD

SEQ ID NO: 22540 - protein, 59 aa, Artificial Sequence
  Synthetic
KEEVERLIRELDRVNEELAREVERLIRELEEVNRRVNEDLKRLIRELERALKELDERVR

SEQ ID NO: 22541 - protein, 57 aa, Artificial Sequence
  Synthetic
DEVDELIKRLEERNEELNRKAKRIIEKLKKENDDLNRKLDEIVRKAREDIEDAERRV

SEQ ID NO: 22542 - protein, 59 aa, Artificial Sequence
  Synthetic
KDLEDKLEEVLRRSKKNIEDVEKELRDVLRAAKKNLDDLRRKLEDVLRRLRDEIRRKKK

SEQ ID NO: 22543 - protein, 57 aa, Artificial Sequence
  Synthetic
SDVDRIITELRDINREVNRRVKRLIEELEELNRRLNEKAKRDMDEIRRLIEEAAKKL

SEQ ID NO: 22544 - protein, 59 aa, Artificial Sequence
  Synthetic
EDLKRKLEKVLKEARDNLEEVKKRLKEVLERSEENLRRLEEELRRVLEEVREMLKRKKD

SEQ ID NO: 22545 - protein, 57 aa, Artificial Sequence
  Synthetic
KDEEKIKRVLDDVERVLKENEDRNRELLKRVRERLEESRDHLRRVLEDVKRVLEELK

SEQ ID NO: 22546 - protein, 56 aa, Artificial Sequence
  Synthetic
VDELVKRIKDLLKRLNEISRRIAEEIKELLRTHDELNERVVRKLRDLLRKAREKRR

SEQ ID NO: 22547 - protein, 56 aa, Artificial Sequence
  Synthetic
SEEEKLKRVLEDVERDLRRNKRENEKSLEESKKVNDDNRRRNKEALDEVKKVLEDL

SEQ ID NO: 22548 - protein, 56 aa, Artificial Sequence
  Synthetic
DEELVDEIRKLLERLNEISERIHRRNKELDDELNEISKRIRERIEDLKRRAEERAR

SEQ ID NO: 22549 - protein, 60 aa, Artificial Sequence
  Synthetic
SEEDEIRRLLKENEDSTRRVEEDNKRLNDENEKSTKRVEDDIRRILERVRRELDDLRRRG

SEQ ID NO: 22550 - protein, 56 aa, Artificial Sequence
  Synthetic
REEIEREVREDNKRLEELLERSEREVREDNKRLDEALKKIEKEARELVKRMREKAK

SEQ ID NO: 22551 - protein, 59 aa, Artificial Sequence
  Synthetic
REEEEIRRLLKENEESTRKVEEDNKRLNDENRRSTEKVSRDLEDLNRDTRRVMEEAERR

SEQ ID NO: 22552 - protein, 56 aa, Artificial Sequence
  Synthetic
LEEIKREVEEDNERLKELLKRSEKEVREDNKRLRDVLEKSREEHERLKKRLEEAAK

SEQ ID NO: 22553 - protein, 60 aa, Artificial Sequence
  Synthetic
SEEDEIRKLLEKNEKSTEDVERENERLNDENRKSTEDVKREIDRLLKELREVLDEARKKG

SEQ ID NO: 22554 - protein, 56 aa, Artificial Sequence
  Synthetic
LDEIRKTVEEDDKRLKDALERSKREVDDDNRRLKKVLDEIRKTVRTMIEEIKKAEK

SEQ ID NO: 22555 - protein, 61 aa, Artificial Sequence
  Synthetic
SEKEKADDLRRKSKESNDTLRKRLDELKKRSEKNNEELERRLRALLKRLEDVLREITKRTG

SEQ ID NO: 22556 - protein, 55 aa, Artificial Sequence
  Synthetic
DELVKEVEDLNRELEEKVKRLIEEMEELNKRLNDKVKELIEEVERLIKELEDRVR

SEQ ID NO: 22557 - protein, 61 aa, Artificial Sequence
  Synthetic
KDIDELIKRSEDLTRDLERKNKEVVDKIEELLREHEKTNREVVKELRRLLDEVRERVERRG

SEQ ID NO: 22558 - protein, 59 aa, Artificial Sequence
  Synthetic
EDLERKVRKAEEDNKRAVERSKTHVDEVRKEVERVLRESKRHAEKLAEDVERMIRELER

SEQ ID NO: 22559 - protein, 57 aa, Artificial Sequence
  Synthetic
STLEKLKKDLDDIDRDLERILDELRRRVERIDEELRKIVERLHRRNKEIIERLRKAK

SEQ ID NO: 22560 - protein, 55 aa, Artificial Sequence
  Synthetic
REIREAEKKHKKVLDDLRRKLEEVEKRHREVEKELRDRLEESRREHEKVIREETE

SEQ ID NO: 22561 - protein, 56 aa, Artificial Sequence
  Synthetic
RELEELEKEVRKRLKEAEERVRDLAKKSRDLNRELKDRLRRIVEENRDVNRKVKEK

SEQ ID NO: 22562 - protein, 56 aa, Artificial Sequence
  Synthetic
DEDLRRVEEEIRRVIERLKRLLERVEEENRKSRKELRETLERLHRENEKSLREKET

SEQ ID NO: 22563 - protein, 60 aa, Artificial Sequence
  Synthetic
SLKERLDRVEEKIRKVLEELDRSTSRVEKKVEEVLRELKRSNDEVRKEIKKVLDELRKRG

SEQ ID NO: 22564 - protein, 57 aa, Artificial Sequence
  Synthetic
VVDEVAKRMTEELKKLDKENKEIEKEVDDILKRLKDEDKKTVDTLRKILKELDDDAR

SEQ ID NO: 22565 - protein, 60 aa, Artificial Sequence
  Synthetic
SEIEEVEKEMDKLAEESNKLNEEALRRVRKLLRDSNELVRELERRVRELIKRAKDLKREG

SEQ ID NO: 22566 - protein, 59 aa, Artificial Sequence
  Synthetic
EEVRRKIKEIKDRSEENIKRSRDSVREIKKESDENIKRLKRELERIKKRLEEVLRDLKR

SEQ ID NO: 22567 - protein, 59 aa, Artificial Sequence
  Synthetic
KDEEDLAREVKRVIDELEKLNEELNRAAEELIKRAEEINERVNRKVEKVERDLDKLKKR

SEQ ID NO: 22568 - protein, 55 aa, Artificial Sequence
  Synthetic
ETLRKLRDDLRKALKKSEDNIEDVRRRLEEVLERARRNLERVRRRLEEVLRKLKE

SEQ ID NO: 22569 - protein, 60 aa, Artificial Sequence
  Synthetic
SAAERLEKAVRDLIEELKRLNEELNKAVKEIIRRLRELNKKLNEDAERLIRKADELKRRG

SEQ ID NO: 22570 - protein, 56 aa, Artificial Sequence
  Synthetic
KEILDKLREELKRALEESEENLRRLRRELTEVLRESRENLERLKEEVERVLKRLAD

SEQ ID NO: 22571 - protein, 58 aa, Artificial Sequence
  Synthetic
SVVEDLEEKVKRLIERIERENRRLNKDADRLVRELDELNERLNRAIRRLIRKAEEARK

SEQ ID NO: 22572 - protein, 56 aa, Artificial Sequence
  Synthetic
ERELERLKRELEKVLRESEKNLEDLERKLKEVLDRSRENAKRLEDELREVLERLRK

SEQ ID NO: 22573 - protein, 58 aa, Artificial Sequence
  Synthetic
SVVEDLAKKVEELIRRLEELNKELNKRVRDLIEKLRDINRKLKREVERLIEEAEEVRR

SEQ ID NO: 22574 - protein, 56 aa, Artificial Sequence
  Synthetic
KDELKKLEERAREVLRKSEENLKRVEDELREVLRESEETLKRLEEELRRVLDELRK

SEQ ID NO: 22575 - protein, 60 aa, Artificial Sequence
  Synthetic
DEEKKAEDDIRRIHRRNEDLLRRHREITEEIEKRIRELLREHREITKRLERRLRELKKEG

SEQ ID NO: 22576 - protein, 55 aa, Artificial Sequence
  Synthetic
EELKRIKKRLDESLREVEEDLKRSEKRLRELLKRVKEDLDRSRKRLKEILDELRR

SEQ ID NO: 22577 - protein, 60 aa, Artificial Sequence
  Synthetic
DEVRKLEEDVERLRREVEEENRRLEEEVERLRKEVKERNRELNERVKTLIETAKRLKEAG

SEQ ID NO: 22578 - protein, 56 aa, Artificial Sequence
  Synthetic
EEMLRELEKRLKRLADETRRSNKELKERLERLKDESRDNNRELKERADRLLEKLKE

SEQ ID NO: 22579 - protein, 60 aa, Artificial Sequence
  Synthetic
SEEEELRKLERRLEELMKEYKEALDKLREEHEKTLREYEKRVEDLEREHKKVLKKLVDDR

SEQ ID NO: 22580 - protein, 56 aa, Artificial Sequence
  Synthetic
LDDLRRKVDKLRKEVEDHVRELEKKSRKLVEELKDHLRKLEEESRRLNRELEERSR

SEQ ID NO: 22581 - protein, 56 aa, Artificial Sequence
  Synthetic
SKEDLRRELDRVNEESKKHLDKLRKEAEEVLERLDRANKKIIEDAEEILRRIEKKV

SEQ ID NO: 22582 - protein, 56 aa, Artificial Sequence
  Synthetic
RERIKREIEENRKRNEEIARKIKEDIERARRDLERLRKKHEEELEKLKKRVEDADR

SEQ ID NO: 22583 - protein, 60 aa, Artificial Sequence
  Synthetic
DEDRIRKELEKAHKETREESEKLNRDVERVLREVRKASKDLNDKFEEELRKLREKVERDL

SEQ ID NO: 22584 - protein, 56 aa, Artificial Sequence
  Synthetic
RDKVEEDLRRSRKELEDYARDLEDAIRRIEDRLRRYARKLEEDIKRLARKLEERER

SEQ ID NO: 22585 - protein, 61 aa, Artificial Sequence
  Synthetic
SRTERVKEELKRLVEEYKKRSDDSRRRNEKLTRDYREDSRRVEEELKRIKEDVERELRRRD

SEQ ID NO: 22586 - protein, 59 aa, Artificial Sequence
  Synthetic
DEEAKKDLKRVRDALDRLTKRNEEKDKENEDRLRKMLRENRERLKEVRERAKRIKEELK

SEQ ID NO: 22587 - protein, 63 aa, Artificial Sequence
  Synthetic
KEKEEIRKALKELLDDLERTLERLKREYDKLRKDLEDTDERIAREHKKIADDLDRTLKEARKK

SEQ ID NO: 22588 - protein, 55 aa, Artificial Sequence
  Synthetic
ERVLEEVKREVDRIKEELRRTLEENRRRIEEIKKRLEDILRESRERARELKEKLR

SEQ ID NO: 22589 - protein, 56 aa, Artificial Sequence
  Synthetic
SEAETILRRVRRRVEEILDRIRRKLEESKREVEKHRRDVKKVLDDVRRTVKRIKER

SEQ ID NO: 22590 - protein, 55 aa, Artificial Sequence
  Synthetic
EEVDTRLKEISKELEETLRRVTEEHKRLNRELEEVDRRAEKEVRKILKELRDTTK

SEQ ID NO: 22591 - protein, 61 aa, Artificial Sequence
  Synthetic
SKEEELREVLRRIERELERVNEELREENKRIDKELEEVNRELEERNKRINDTVEDLVRERG

SEQ ID NO: 22592 - protein, 59 aa, Artificial Sequence
  Synthetic
REELRKIAEKLKKNLEEHKKRVREYLKRLEENLKRHRERVEKYARDLKRDLDRLRERLR

SEQ ID NO: 22593 - protein, 60 aa, Artificial Sequence
  Synthetic
SEEEKLEKKAREIEEALRRVNEELKRRNKEIDERLEEVNRRLEKDLKKIEEDARKLVKDK

SEQ ID NO: 22594 - protein, 59 aa, Artificial Sequence
  Synthetic
EDELREIIERLERNLERHKRRVDKYLRDLEKNMRDHKRKVDEVVKTLEETLRRLEEEVR

SEQ ID NO: 22595 - protein, 60 aa, Artificial Sequence
  Synthetic
SEEERLREKVKRVEDDLRRLNEEYKEKHKRSEERNKKLLKDLKEVHDRVKKAVEDILRDT

SEQ ID NO: 22596 - protein, 56 aa, Artificial Sequence
  Synthetic
EEEVEERIRRALKESREEIDRLERRNEEEDKKSEETVRRMMERNDRVLKEVEERAR

SEQ ID NO: 22597 - protein, 60 aa, Artificial Sequence
  Synthetic
REEEELRRLVKTVEDEVEKLLRRYRDESEKVKRTLEELNKDLERKHKEVLDRIRDILRKV

SEQ ID NO: 22598 - protein, 56 aa, Artificial Sequence
  Synthetic
REDVERELEETLRDVARKIERLLEKNKRDLDRSKKRVEEMVRRNEKALKDVEDEIR

SEQ ID NO: 22599 - protein, 60 aa, Artificial Sequence
  Synthetic
SEREDLKRTVDEVKKRLEELIDDYRKTSEEVERRLEELLRRLREDHKRVAETIDDILRRV

SEQ ID NO: 22600 - protein, 56 aa, Artificial Sequence
  Synthetic
TEEVKERIRRDLERVKRKIEELKKKNEEDLRRADKKVKDMLEENRRTLEKAKRKAD

SEQ ID NO: 22601 - protein, 60 aa, Artificial Sequence
  Synthetic
SKEDEARKEIKRIEDEIERLRKELEDAHRKLREDLKRLRDENKKVLEDIKRRLKELEKDT

SEQ ID NO: 22602 - protein, 55 aa, Artificial Sequence
  Synthetic
DRVRKKLEDELRRLKRTVDELKKRNEKALRDVKRDSERHKEELRRALRKAEEDAR

SEQ ID NO: 22603 - protein, 61 aa, Artificial Sequence
  Synthetic
SLKEELDKAIRELKERHKRINEDLERVVRESRKNHEDINRRLKKLLEELEKRVEEIVRREQ

SEQ ID NO: 22604 - protein, 59 aa, Artificial Sequence
  Synthetic
DRVIREIKKRLEDLLRRTEERAKEVKDENRKRNEDTREEVRRVEEELKELLRRIEERER

SEQ ID NO: 22605 - protein, 59 aa, Artificial Sequence
  Synthetic
DEVREIIRELKERIDKIAKEIDDENREHRERLKEIAREVKELIKENRKELKRIADERKD

SEQ ID NO: 22606 - protein, 59 aa, Artificial Sequence
  Synthetic
EEIRKRLDEATKRAEDELRKLKEKNKEVLKELDDRLRKLEDEHRRVREEVDKRLDELRK

SEQ ID NO: 22607 - protein, 60 aa, Artificial Sequence
  Synthetic
DEREKIEKRIRELLKEDKEHTRRNEEKIRRLLDTNRRLLEEIAKKIEEIARELKERKKEN

SEQ ID NO: 22608 - protein, 55 aa, Artificial Sequence
  Synthetic
EEIRKLVEDYRREHEKLKRRNDELLERYRRAHEEIKKRIDELVERLEEILRKLAE

SEQ ID NO: 22609 - protein, 60 aa, Artificial Sequence
  Synthetic
SEKETIEKRIRDKLKDDEDHTKRNEERIRRALKEDEDRLRKIEEEIRRTLEELEREKRSN

SEQ ID NO: 22610 - protein, 55 aa, Artificial Sequence
  Synthetic
EDIERLEERYRREHERLKRRNEDLSREYEERHERLKREIDKLEEDLKRETERAAR

SEQ ID NO: 22611 - protein, 60 aa, Artificial Sequence
  Synthetic
SEKEKIKKEIEDARREDEKHTEKNKRDIERDERRDEETLKEIEERIRRTLRELEKDRESN

SEQ ID NO: 22612 - protein, 55 aa, Artificial Sequence
  Synthetic
EDIERLEREYEKDHKRLKDENDDLTEKYRRRHREIDERIKDLERELDRRIKEIDR

SEQ ID NO: 22613 - protein, 61 aa, Artificial Sequence
  Synthetic
DVRDRVRELRRRLEEETKKVDDENRKIHEELKRVADESRKNNERLNRELRKEIRRVEKDLG

SEQ ID NO: 22614 - protein, 59 aa, Artificial Sequence
  Synthetic
EEALRRLEETLKEVKDELKTELDDSRREVEEVKRSNKEKNERSERRLKEVRDRLREERK

SEQ ID NO: 22615 - protein, 59 aa, Artificial Sequence
  Synthetic
SLEDSAREIEKRLRDLHRRYREDHERIREDLERLKTEYEKAHRDIKRELDRLREELERA

SEQ ID NO: 22616 - protein, 60 aa, Artificial Sequence
  Synthetic
EKEMLDRLEEHVDRNEKDIKKALDENRKRLDDIRRKIKKALDENREELKRIERRIRELKK

SEQ ID NO: 22617 - protein, 60 aa, Artificial Sequence
  Synthetic
SAEETTEDLKRRLKELDEKVKEVLKRNEDRVRELEEDVRRNLKKNEDDAREVEERLKTSG

SEQ ID NO: 22618 - protein, 59 aa, Artificial Sequence
  Synthetic
EELLKEVEDRVREIIKRIEEKLKRLNDRTREFIERIRRELRKVNEETKKMIKELKEEED

SEQ ID NO: 22619 - protein, 60 aa, Artificial Sequence
  Synthetic
SKAEKVLEKAREVVETIKRLVEEVLRHSEDVVRRITDLVRRLLEENERVVREIKRLADEG

SEQ ID NO: 22620 - protein, 55 aa, Artificial Sequence
  Synthetic
ERVIKKIEDLLKKVDDEAKKMLEEVERLNKEVNDRLKRVLEEAERLHEEVNRRVK

SEQ ID NO: 22621 - protein, 57 aa, Artificial Sequence
  Synthetic
KELEDVIEEVKKLLKTVNEESRRVAEEVRKLIREVSEELTEVIRRVERLVEEVATRV

SEQ ID NO: 22622 - protein, 56 aa, Artificial Sequence
  Synthetic
LDTVLRRAEDIVRKNRKLAEEVLRRVKKIVEENRKIAKEVLDDVRKLVEDVLRRAT

SEQ ID NO: 22623 - protein, 57 aa, Artificial Sequence
  Synthetic
EELERVIEEVRKLVEEAEKKSREVIKTVKELMDDVNRKSKKVLDDVRRLIEKVRREV

SEQ ID NO: 22624 - protein, 56 aa, Artificial Sequence
  Synthetic
ADDALRRVKEIVERNEEVVKELLKRAEDIVRTNEKLVKDVLDTVRKLVKKVKDDED

SEQ ID NO: 22625 - protein, 59 aa, Artificial Sequence
  Synthetic
SEAEDALRKAKRLADEDRKAAKRALEEAKKSAEEVKKAAKRALEEAKRIAEDVKRAADE

SEQ ID NO: 22626 - protein, 55 aa, Artificial Sequence
  Synthetic
EEAAREAKKLAKDAADVSRKAAKDAKDLSKEAADVARKAAEDARRLAEEAARKAK

SEQ ID NO: 22627 - protein, 60 aa, Artificial Sequence
  Synthetic
SDAEDVVRKVKRLVDELRRHSKELLKEVEDLVRDLVRHSEEVVKRVEDLVRRLEELVRRG

SEQ ID NO: 22628 - protein, 59 aa, Artificial Sequence
  Synthetic
EEVRRVLREIREVLKKVAEDSRKVNEDIRRVLEEAKKTSDKVNTDSEEVLRTVARRFED

SEQ ID NO: 22629 - protein, 60 aa, Artificial Sequence
  Synthetic
SRAERLLEDVRRLLEESLRNSERVLEEVRKLIEENLRHSRKVVDEVRRLLEEVLRVVERG

SEQ ID NO: 22630 - protein, 59 aa, Artificial Sequence
  Synthetic
EDVRRVLEAIKEDLKRVEDANREINRRSEELLREAEKRSRDIDKESRDLVRKVKKDLEK

SEQ ID NO: 22631 - protein, 60 aa, Artificial Sequence
  Synthetic
SRAEEVLKDVKRLVDENRRHSERVVEEVRKLVTENKRHSERVVEEVRRLVEELERARRRG

SEQ ID NO: 22632 - protein, 59 aa, Artificial Sequence
  Synthetic
KDVRKVLKDIREVLERVEEDSERVNRESKKVLDDVKKESDEADDESRRVLEEVDRKARK

SEQ ID NO: 22633 - protein, 60 aa, Artificial Sequence
  Synthetic
DRVEELLKTVEKLVRDNEKHSRDVVKEVRRLAEENERHSERVVREVRRLVKELEDMKRRG

SEQ ID NO: 22634 - protein, 59 aa, Artificial Sequence
  Synthetic
REVREVLKRIEEILKDVKRKSEEVNRESERVLREVEKRSEDADRESKKVLDDVKEKARR

SEQ ID NO: 22635 - protein, 60 aa, Artificial Sequence
  Synthetic
SEEEVLKEIDEVSRDLERKNKTINEEIKKVSDRVAEEVRRVLEDIKRTSKDAVDDVRTRG

SEQ ID NO: 22636 - protein, 56 aa, Artificial Sequence
  Synthetic
LEKVVREVEESVKESEERSRRLLEEVRRSVKKLEEDVTRLLEENKKSVDDIKERAR

SEQ ID NO: 22637 - protein, 60 aa, Artificial Sequence
  Synthetic
REEEVLEEIRRVVEEVRRENERINKEIRERSEDLRRKVKRILEKAKKVLDDVDERAKREG

SEQ ID NO: 22638 - protein, 56 aa, Artificial Sequence
  Synthetic
VDEVLKEVEDLVRESVRLSEDLLREVRESVERLVDEARKLVREIERLVKEAVDTVR

SEQ ID NO: 22639 - protein, 60 aa, Artificial Sequence
  Synthetic
KEEEVLKEAEEVSRRAEEKNRRINDEVRRVVRRVEETVTRVLEDVERTSKEAKERVERAG

SEQ ID NO: 22640 - protein, 56 aa, Artificial Sequence
  Synthetic
LDTVVEEIKDSVRKSVERSRELLERVERIVTELEKRVDELVRENEDSVRRIDERVR

SEQ ID NO: 22641 - protein, 60 aa, Artificial Sequence
  Synthetic
SEAEKIVEEAKRLADKARELAERSVRHSEKLARDSEKAAREAVKEAKDLADKARDLAAKR

SEQ ID NO: 22642 - protein, 56 aa, Artificial Sequence
  Synthetic
KEALDTARKILRDAEEAAKEAHKEANRLNKEAEEAAKRAADEARKILKKAEEDARR

SEQ ID NO: 22643 - protein, 60 aa, Artificial Sequence
  Synthetic
DDLEEIVKRVRRIVEEIRRLVEELVRRDKRIVDEIKRLLEEDKRKVDEIVKEIEEVVRRG

SEQ ID NO: 22644 - protein, 59 aa, Artificial Sequence
  Synthetic
EEVRRVLKEVKDILKTVRDEVEEANEDAKRLNEEVREEAERVLRDTKRILDEVRKEADK

SEQ ID NO: 22645 - protein, 59 aa, Artificial Sequence
  Synthetic
REKEVLEEVRDIVRRASERSKEALDESREILKTVDDEVRRVLEDSRRLLEEVRKRVEDN

SEQ ID NO: 22646 - protein, 56 aa, Artificial Sequence
  Synthetic
AREIVERVRRLVDTSRRLVEEDVRRVREVVKELRKLLREDVKRVRDVVEELAKEAT

SEQ ID NO: 22647 - protein, 57 aa, Artificial Sequence
  Synthetic
SEMEDAKRKIEDLVRRVKDSLRDAERRIREVVERVERSLKEVEDRSRELLEDVKREG

SEQ ID NO: 22648 - protein, 59 aa, Artificial Sequence
  Synthetic
DESVRDAVREVEDLIRRLTEDNKRLVEEVKRLVDRASEENKKLNDTSKKVVDEIREREK

SEQ ID NO: 22649 - protein, 57 aa, Artificial Sequence
  Synthetic
EELERVKEEIDKLVKEVRRSLKDVERRSAELLKEVEKSLEEVERESKKVLDEVRKAG

SEQ ID NO: 22650 - protein, 59 aa, Artificial Sequence
  Synthetic
DKAVKTLLEDVRRLVREATEDNKRVNDESRELVERASRDNRRVNKESRDIVRRLEERTK

SEQ ID NO: 22651 - protein, 57 aa, Artificial Sequence
  Synthetic
SELEEVERRVEKVVKEVRDSLKKVKEDIEKVLRESHKRLRDVEREVRRVLEKVRRRG

SEQ ID NO: 22652 - protein, 59 aa, Artificial Sequence
  Synthetic
DKTVRDVLRRVRKLVEDATRANEKALDDVRKLVEKSRKLVEDVLERVRRLVKELEERTT

SEQ ID NO: 22653 - protein, 59 aa, Artificial Sequence
  Synthetic
DEVEDVVRKVRDLVRRVREAVRRLLEENRDLVRKLIEDSERLVREVEKLIKEVEDTVKD

SEQ ID NO: 22654 - protein, 59 aa, Artificial Sequence
  Synthetic
REELERVIKEIKDVVREVTKVVEKVIREAEKLNEDVNRRSEEVNKRIKKLVEDVARRVE

SEQ ID NO: 22655 - protein, 56 aa, Artificial Sequence
  Synthetic
DEAEEVKKLIDKVLREVEEVVRRVNKRDKDLLREVEKVVRDVNREDKRVLEEVERS

SEQ ID NO: 22656 - protein, 55 aa, Artificial Sequence
  Synthetic
EEIVREIEKVAEDIMRRNEELVKESEDVVRKIVRDNERLAEDSKRVVEEAVRREK

SEQ ID NO: 22657 - protein, 61 aa, Artificial Sequence
  Synthetic
SAIDRVRKTLEKLVERLERVLEESSKAVEDVKEKVERLLRELRERTKRIVDEVEDMVRKAN

SEQ ID NO: 22658 - protein, 59 aa, Artificial Sequence
  Synthetic
EEELDRLVKKVEDLVRRLEELARKSLKDIKKLLKDIEDRLRKSVEKSRRLAEEIKERLR

SEQ ID NO: 22659 - protein, 60 aa, Artificial Sequence
  Synthetic
DKADEAVKRVKDLIDDLKRRIDEVVKRSREVVRDIEKHAEDVVKESRRVVDEIKKLVTRG

SEQ ID NO: 22660 - protein, 55 aa, Artificial Sequence
  Synthetic
EEVEERVREVLRRVEKRVKEVNEESERTIRELERVSRRVNEESRRSIEEAKRAAD

SEQ ID NO: 22661 - protein, 61 aa, Artificial Sequence
  Synthetic
DAVERAKEESKRVLEDAERVVRRVEEEVRKMERKAEESLKDVRRKSEEVIRKVEEVVRRKG

SEQ ID NO: 22662 - protein, 59 aa, Artificial Sequence
  Synthetic
DKEVREVVEDSRRSVRRVEELVEKVVRDVKKLIEDHERRNRESVRESERSIKELEEKVR

SEQ ID NO: 22663 - protein, 59 aa, Artificial Sequence
  Synthetic
DDLERVLREVKRLVEENEKKVRRIVEESRELVERNKELLRRVVEEVRRLVKEVRDILRN

SEQ ID NO: 22664 - protein, 59 aa, Artificial Sequence
  Synthetic
EDKLREVRERIKRLLDRSHEAVRRASEKSKRSLEESHRAVREVEKRLKELLEDVREDVR

SEQ ID NO: 22665 - protein, 59 aa, Artificial Sequence
  Synthetic
DRLEEVVERVERLVRENVKRLEKVAEENRELVERNKRRLEEIVRRVRELIERAKRIVRD

SEQ ID NO: 22666 - protein, 59 aa, Artificial Sequence
  Synthetic
EDKLRDVERRAKELLEESHRVIRTVEERSKTVLADSHRVIEDVRRRLEELLREVAEEVR

SEQ ID NO: 22667 - protein, 60 aa, Artificial Sequence
  Synthetic
DEADEVVKEVEDRVRKLVRRLEESAKKSKELVERILKRVEDSVRRSEELVERIKREVERR

SEQ ID NO: 22668 - protein, 55 aa, Artificial Sequence
  Synthetic
EKVEEMLRRVLEEVRRAVRKSSEDNKRSVEEVKRVLEKAEEDNRRVVEEVDRELK

SEQ ID NO: 22669 - protein, 60 aa, Artificial Sequence
  Synthetic
SKLEEVEKMVRKVIEDSRRVNEEVNRRSEEVVRELEKVHREVNDASRRVVEKARRVLKEG

SEQ ID NO: 22670 - protein, 58 aa, Artificial Sequence
  Synthetic
KEADEVVERAERISEENKRRVEDVARKSKELVEDVRRHSEEVVRRVEELVKEVEERVR

SEQ ID NO: 22671 - protein, 60 aa, Artificial Sequence
  Synthetic
SLLEDVKRTVREVVRESRRVHKEVNDDSRRVLKRSDEAHERVNRDSRRVIERIREVLSRG

SEQ ID NO: 22672 - protein, 58 aa, Artificial Sequence
  Synthetic
EEVRELAEDARRISEDNRRNSKRVVDRVREISKENEDNSRRVVDRVRKLAEEVEREVR

SEQ ID NO: 22673 - protein, 60 aa, Artificial Sequence
  Synthetic
DDLERVKETVKKVIKRSRDSTKKVADTLREVVRESERVHREVNETSRRVEEEAKRVASRG

SEQ ID NO: 22674 - protein, 58 aa, Artificial Sequence
  Synthetic
EEVDKLADRARRLVAKSEEDNKRVMKEVTDISKENEDNSRRVVDEVRKLVEEVRRRLE

SEQ ID NO: 22675 - protein, 60 aa, Artificial Sequence
  Synthetic
DKVERVVEEIRDLMRRVEELIKKAADDNRKLVKEVEDLIRDAVRDSERLVAEVEKLLTKE

SEQ ID NO: 22676 - protein, 55 aa, Artificial Sequence
  Synthetic
DEVRKEVKRVIKAVEKVIEDVERTSEEARRRVEKVIKEVEEKNREVIKRVEDRIR

SEQ ID NO: 22677 - protein, 60 aa, Artificial Sequence
  Synthetic
SEADKLVEEVKDVVREDKRRVKEIVETVRELVRRSRETVRRIVETVEEVVRRLLELLRKG

SEQ ID NO: 22678 - protein, 55 aa, Artificial Sequence
  Synthetic
EKVEEVLRRVKRESEKVIEDVERELKRVEDDDRRVIEEVKKRLKRVLERVRTESK

SEQ ID NO: 22679 - protein, 59 aa, Artificial Sequence
  Synthetic
READELVDRVKKVVEEDKRLSKELVDEIERVVDELEKVSRELVERVRDLVRRLLEVAAK

SEQ ID NO: 22680 - protein, 55 aa, Artificial Sequence
  Synthetic
DKVEKVLKRVEEESREASERNERVIERVERRVDEASKRNEDEIDKVRKEVERVAT

SEQ ID NO: 22681 - protein, 59 aa, Artificial Sequence
  Synthetic
EEVKELVERVRRVVDDLRKKLEKIVEEVRDVVRKDEERSRKLVEDVKDLVRKILEVLRK

SEQ ID NO: 22682 - protein, 55 aa, Artificial Sequence
  Synthetic
DDLRRVLKEVDEEVRKVIEDVARVLEEVKRRSDRASRENEEVIKRVTEEVKRVVK

SEQ ID NO: 22683 - protein, 60 aa, Artificial Sequence
  Synthetic
DRVEKLVEEVKRHVTEVLKTVEDLARRIRDHVRKVEDTSRELVKEIKRLVEEILDRVRKK

SEQ ID NO: 22684 - protein, 59 aa, Artificial Sequence
  Synthetic
EDVVRELRRVLRESNEKLKEVVDRLRKVLEESTKRVEDASRRVERVLEKVEEDVKREAT

SEQ ID NO: 22685 - protein, 60 aa, Artificial Sequence
  Synthetic
SEVEELKERIREIVERIEETVRRLAKRVEDHVREVEKDSKRLADEIRDFVRRITDEVRKK

SEQ ID NO: 22686 - protein, 59 aa, Artificial Sequence
  Synthetic
KRLVDKLRKVLEEVREEVERVVRELEEVLRRSTKRVEDASRELERVLKEVKETLEREVR

SEQ ID NO: 22687 - protein, 60 aa, Artificial Sequence
  Synthetic
DRVEALVDEVKRHVTELLKTAERLADEVREHVDDVRKKSKELVDEIRRVVEKILDEVRKK

SEQ ID NO: 22688 - protein, 59 aa, Artificial Sequence
  Synthetic
EEVVRELRRVLRESNEELKKVVTELEERLKDSNEEVKKASAEVRKVLEEVRADVDREVK

SEQ ID NO: 22689 - protein, 57 aa, Artificial Sequence
  Synthetic
SLVEKLRRVLEEVRRTSEKVIRDVKEVNKRSEDKTREIVRRLEEVNKESKERLDRAG

SEQ ID NO: 22690 - protein, 59 aa, Artificial Sequence
  Synthetic
KELAEKLAREVKRLVDESKKNMDKSVEDSRRLVRESEENVRKSVEDSRRLVKRAVEETK

SEQ ID NO: 22691 - protein, 60 aa, Artificial Sequence
  Synthetic
RVDEDLRRVLKEVKERNEEVVRRSKEETDRVEEDIERVIRDSERVSEEVKRRVDKAKKDV

SEQ ID NO: 22692 - protein, 59 aa, Artificial Sequence
  Synthetic
EELAKEVVKRVRELVDRSRRLMTESVRKVRELVEDIRRRVRESVEKLRRLVEEIERRIR

SEQ ID NO: 22693 - protein, 60 aa, Artificial Sequence
  Synthetic
KEVEKLVKDVERMVEESLKENERLVKKSDELVKESEKRNKELAERSRRLVKEITDRLAEE

SEQ ID NO: 22694 - protein, 59 aa, Artificial Sequence
  Synthetic
EDVLRDLRRVVEEVTEKIKEVNRRSEEANKRSKDRIEEVNRRSEKVNEDVEREIERALR

SEQ ID NO: 22695 - protein, 60 aa, Artificial Sequence
  Synthetic
DELEKAVERVKDIVRKSLELLKRLADRVRDIVREILDEVRRNVEEVRRIVKEIVEEVRRR

SEQ ID NO: 22696 - protein, 59 aa, Artificial Sequence
  Synthetic
EEALKRLERVVREVAEESDRANKELDRVVEEVKERVERVLRESNKVVKEVEDRVREETR

SEQ ID NO: 22697 - protein, 57 aa, Artificial Sequence
  Synthetic
SVKETVEEEVRRVSDEDRRINRDVERVSEESNRRLDKVHKELEEVVKEVLKELDDTG

SEQ ID NO: 22698 - protein, 59 aa, Artificial Sequence
  Synthetic
EETARRVVEEARRIVAESKELVKEVVRRSDELVRDVEKHSRDVAKTVRKIVTDVARRTR

SEQ ID NO: 22699 - protein, 57 aa, Artificial Sequence
  Synthetic
SAEETLEKVIRDVEEEDKKAHEDSRRVIETVKEEIDRVHKDSKRKIDEVKERIRREV

SEQ ID NO: 22700 - protein, 60 aa, Artificial Sequence
  Synthetic
LEERVRRIVKEVREIVKRSKERSDEIVKEVKRIVKEALDLSREIVERVERIVREVVERAR

SEQ ID NO: 22701 - protein, 57 aa, Artificial Sequence
  Synthetic
EADERLRKRLKEVNERDKKAHEDSKRAIDRVREEDKRVLDTVREEIKRVKDEIRRAL

SEQ ID NO: 22702 - protein, 60 aa, Artificial Sequence
  Synthetic
LERLVREVVRENEELVTRSEELSRRIVEEVKRIVDESRKRAKEIVDEVRKRVKELVDTDK

SEQ ID NO: 22703 - protein, 57 aa, Artificial Sequence
  Synthetic
DVREKLEKVLREVERRVEKASRESKETLDRVRKRLKDVSDESKRELERVKKRVDDAD

SEQ ID NO: 22704 - protein, 59 aa, Artificial Sequence
  Synthetic
KKVIEELVEEVRRLVTEHERLSRELVDRVEKLVARHEELSKKLVTDAERIVKEVEERAK

SEQ ID NO: 22705 - protein, 57 aa, Artificial Sequence
  Synthetic
SALERLREVLERVLRRVKKVTDDARRVNERVNRKVDRVSEDSERELRRVLKRVREAS

SEQ ID NO: 22706 - protein, 59 aa, Artificial Sequence
  Synthetic
EEVLRELVERAKKLVDDHLELVERLVRESEKLVEDHLRRSKKIVEDVKRIVEDVERRVK

SEQ ID NO: 22707 - protein, 60 aa, Artificial Sequence
  Synthetic
DEVDKARKEVDRVVKESRKLVEKNVREVEEVVKTVEKLVEDVIRRVEDVVREVKELVTRG

SEQ ID NO: 22708 - protein, 59 aa, Artificial Sequence
  Synthetic
EELLDRVRKVVEDVSRKSKKALDESHEVVKRVKDRADEVLDKVRRAVEEVERRIETEAR

SEQ ID NO: 22709 - protein, 60 aa, Artificial Sequence
  Synthetic
DEVEKAVKEVERVVREVKELVDRNIDEVRKVVEDSKRLIDELVEDAKRVVKRVKELRDRG

SEQ ID NO: 22710 - protein, 59 aa, Artificial Sequence
  Synthetic
EELLDRVRRVVEEVKKEADRLLEESHRVVREVSERSKRALEEVKRVVDEVTERIKKDKD

SEQ ID NO: 22711 - protein, 57 aa, Artificial Sequence
  Synthetic
STKEKLDDVLRRVEEKAREVVEDNRRADRDVHRKARKVVEELRRVDEEVHETVKRVD

SEQ ID NO: 22712 - protein, 56 aa, Artificial Sequence
  Synthetic
VDEVVDRLRRLVEEVLRHSKKNSRESDEMVRRVTEEVREVVKESKERVDDVLKRVE

SEQ ID NO: 22713 - protein, 60 aa, Artificial Sequence
  Synthetic
KKVEEIMERLRRVAKEIKERVDRLVEKNRKSAKDLLDTIEDIVRKNRDLAEKIKDLARRR

SEQ ID NO: 22714 - protein, 56 aa, Artificial Sequence
  Synthetic
KEKLRRVLREVEEVVRRVKKKLDDSVRELREIIRRAERELREVDEEVRKVVEDVKR

SEQ ID NO: 22715 - protein, 59 aa, Artificial Sequence
  Synthetic
RVREELKKVEEEVREVVRRAKEKTRRVLEEMRKVVKDVDDESKRVVDEVKKVLEEVRAR

SEQ ID NO: 22716 - protein, 59 aa, Artificial Sequence
  Synthetic
EEVVKKVVDDIRKLAKDMDDHSKEVVDRIREVARRIEELNRELVRDLKDEVRRVKEKAK

SEQ ID NO: 22717 - protein, 59 aa, Artificial Sequence
  Synthetic
SVRETLKTVEEEVKRVIDRARKRDERVVREVERVLRDAMRKDEDVNRDVERVLRDVVRR

SEQ ID NO: 22718 - protein, 59 aa, Artificial Sequence
  Synthetic
KDVFKRVVEELRRLVKRVEELVTRTVEEIDRIAKEVTRHSEETVRRLKKLVKTVTDEAN

SEQ ID NO: 22719 - protein, 59 aa, Artificial Sequence
  Synthetic
SSVREVVKEARDIAKENLERVKKTVKENRDLARKVAEDVKKSVEELRKLAEDVEEIARK

SEQ ID NO: 22720 - protein, 59 aa, Artificial Sequence
  Synthetic
EELEKELRTVVREVEEVLRRSEEDDRRVHKEAEDVIKKVEEDDKEVVDRVKKVIRDVRT

SEQ ID NO: 22721 - protein, 59 aa, Artificial Sequence
  Synthetic
SEVEKIVKEAEDLVREVKRRVEDTVRKNRELADRVRKEVDKSVRELRELVKRVLDIAKD

SEQ ID NO: 22722 - protein, 59 aa, Artificial Sequence
  Synthetic
EELRRELERVIKKVEEVIRKAEEDDRTVHRELNKIIKDVEDKDRTVVEEVERVIEEAER

SEQ ID NO: 22723 - protein, 59 aa, Artificial Sequence
  Synthetic
SEVDEVVERARRIAKENLDRVKKIVRENRELVEKVRKDVEDSVRTLKKLVDDVTEIARK

SEQ ID NO: 22724 - protein, 59 aa, Artificial Sequence
  Synthetic
DDMRRKLETVVKEVEDILRRSREEIRTVNEEVEKVIEEAEREDERVVREVEEVIKRVEK

SEQ ID NO: 22725 - protein, 59 aa, Artificial Sequence
  Synthetic
SSVEDVVRKMRKIVEDNKREVEKIVRENRKMAKDNEDLVKESVKDLKRLAKELEDLAKD

SEQ ID NO: 22726 - protein, 59 aa, Artificial Sequence
  Synthetic
EDLERTLRTVVKEVKEVLDRSRDLVRRVNEEVKRVLDRSREEDERVVREVEEVIRRVET

SEQ ID NO: 22727 - protein, 59 aa, Artificial Sequence
  Synthetic
REVDEIVDRLRRIAKENKDRVRELVERNRKLAEEVRRRVEESVKRLRDLVRTIEELARR

SEQ ID NO: 22728 - protein, 59 aa, Artificial Sequence
  Synthetic
EDLERKIREVVREAEEVLRESKREMDTVNKEVREVIEDVRKRDEDVIREVEKVIREVEQ

SEQ ID NO: 22729 - protein, 59 aa, Artificial Sequence
  Synthetic
SEVDEIVKEIREIARKNKEDVRRTVEDLRRLVKEVEKRVEDSVRTMRDLVRRLEETARR

SEQ ID NO: 22730 - protein, 59 aa, Artificial Sequence
  Synthetic
EELERKLKTVIDEAEKVLRESEEDDRRVVEEVERVIKKVEEEDRKAVREVEKVLEDVRK

SEQ ID NO: 22731 - protein, 60 aa, Artificial Sequence
  Synthetic
REVDELLKRIKEVADDIKRLSDENVKEIEKLAREVEKLVRDVVRENEEVAKEIEDLARRR

SEQ ID NO: 22732 - protein, 56 aa, Artificial Sequence
  Synthetic
KKKLRDVLRELEKVVRDVAKEDEDANRRLKEVAERVKREIDEVDKKLKKVLDDVRK

SEQ ID NO: 22733 - protein, 60 aa, Artificial Sequence
  Synthetic
REEEKLRKVLEDAKKVSKEVNEEDDRVNKEVEDVLREVKKEIDEVLKRATETVERVKREN

SEQ ID NO: 22734 - protein, 56 aa, Artificial Sequence
  Synthetic
VDEIVKRIKELVDRSRKLSEENVRRLKKIVKRVKERVKELLDRIKEMAKEIEDRVR

SEQ ID NO: 22735 - protein, 60 aa, Artificial Sequence
  Synthetic
DEEKKLKEVLDRATKVVKDVAEELDRVLEDVERVSRDVNRRDEKVNRDADRVLREVKDEN

SEQ ID NO: 22736 - protein, 56 aa, Artificial Sequence
  Synthetic
VEEIVRRIEEVAKTLREIVRRVLEELKEVVKESERLSRENVRRIEKLAEEIRRRVK

SEQ ID NO: 22737 - protein, 60 aa, Artificial Sequence
  Synthetic
DEDEKLRKVLEELRRVVEEVKRRSDKALEDAERVLRRVKKEDRDANKKAEDELRRVIDEN

SEQ ID NO: 22738 - protein, 56 aa, Artificial Sequence
  Synthetic
VDEILKRIEELMKEIRKLVKEDVDRIRDLVRRIDEESKENVKEIERVADEIRERIR

SEQ ID NO: 22739 - protein, 60 aa, Artificial Sequence
  Synthetic
KEVEDVLREVEKVVEKIKRDVEKIVKDSKELAKRVEELVKESEDRSKEIVDRVEKLRREG

SEQ ID NO: 22740 - protein, 56 aa, Artificial Sequence
  Synthetic
EEKVEKVLRKVRDVVRRVKEKVEEVHRRSREMLKRVEDRDREAHERSRKVAEDVKR

SEQ ID NO: 22741 - protein, 60 aa, Artificial Sequence
  Synthetic
SEVDEVLETIERIVREVKKLVKRSVEESERLVDEVEKLVEKSVREIKEIVDRIRDMKTKG

SEQ ID NO: 22742 - protein, 55 aa, Artificial Sequence
  Synthetic
EKVERVLEEARRVIEEVEREDDDAHRKSKEVLKRVLEKDRKALEDAKKVVEEVKR

SEQ ID NO: 22743 - protein, 59 aa, Artificial Sequence
  Synthetic
KEVEDLERRNKELVERVDKLSRENVERNKKLAKELKEISEENVRRNRKLAEELKEVADR

SEQ ID NO: 22744 - protein, 59 aa, Artificial Sequence
  Synthetic
EDLRRRVKKSHDEVERELRRVDREDETSHEELRRVLEKVKREDRKSHEEVKRRLDEVRR

SEQ ID NO: 22745 - protein, 59 aa, Artificial Sequence
  Synthetic
SEVDEIVKRNDDLAKEVKRLSTENVKRNKELADRVKRLSTENVKTNEKLAKDLERVVRR

SEQ ID NO: 22746 - protein, 59 aa, Artificial Sequence
  Synthetic
ERLRRKVEKSHRDLREVLERVRREDERSHEEANKVLEDVKREDEKSHRDVKKRLDDVRR

SEQ ID NO: 22747 - protein, 60 aa, Artificial Sequence
  Synthetic
SEVDRLLEKLEELVRKVRRDVEENVKKNDELAKEVERLSKRNVERNEELAKEIEDLARRG

SEQ ID NO: 22748 - protein, 59 aa, Artificial Sequence
  Synthetic
EELKEKVKRVMEKVKRVLDRVREEDEKSHRKADRVLREVEKRDRDSHERLRKVLDDVRR

SEQ ID NO: 22749 - protein, 59 aa, Artificial Sequence
  Synthetic
DEVREIVERNERLAREDKKIAEENVRRNEDLVRRLRELSRKNVEDNRRLAKELEEVAAR

SEQ ID NO: 22750 - protein, 59 aa, Artificial Sequence
  Synthetic
EELKKRVKDSHDKLREVSKRSEELDRKSHEDLKEVLKEVRERDDRSHEELRRVLEEVKR

SEQ ID NO: 22751 - protein, 60 aa, Artificial Sequence
  Synthetic
DEVERILERIDELVKRVKELSRRNVERNKELVERVDRLVKDNVDRNRRLAEEVDRLKKEG

SEQ ID NO: 22752 - protein, 59 aa, Artificial Sequence
  Synthetic
EELTKKVEKVVKDAKKTLEEVKREDEDSHKKANDVLRRVRELDKRSHDELKRVLDEVER

SEQ ID NO: 22753 - protein, 59 aa, Artificial Sequence
  Synthetic
SEVEDVLKKLDDIAKEVTERVKRVLDRNEEIVDEVEKLVEEVVRRNKEIVKEVKRLKDE

SEQ ID NO: 22754 - protein, 58 aa, Artificial Sequence
  Synthetic
DLEREVRRVIREVEKVIDDVRREVERSIRKSEKDIREVEKRVEDVNREVEEAIRRVRT

SEQ ID NO: 22755 - protein, 60 aa, Artificial Sequence
  Synthetic
REVEELVKKLKELAERSLTAVERIVEENERLLKRLEDESKRNVDDIERLARELLRRVEEE

SEQ ID NO: 22756 - protein, 59 aa, Artificial Sequence
  Synthetic
ERVERILTKVIEDLERVDKAAHDILREVNERLREVMERVEKTNRTVNRRLEEVLKEIER

SEQ ID NO: 22757 - protein, 59 aa, Artificial Sequence
  Synthetic
DEVEEIAREMREIVDRVLKLSEKTVRENRESVERLLRLSEETVRRIRDLVRRLEELARD

SEQ ID NO: 22758 - protein, 59 aa, Artificial Sequence
  Synthetic
EEMKEKVERAVEEVKRVLDRVRETDKRVNEEVRKVNEEAERIDEKVVREAREVLKRVRD

SEQ ID NO: 22759 - protein, 60 aa, Artificial Sequence
  Synthetic
RVAERLEDVLRELDRTLKDVARKLEEANRDNKRVLEEVAEILKRVLDDLRRVLDEVAKRL

SEQ ID NO: 22760 - protein, 59 aa, Artificial Sequence
  Synthetic
EKVVDDIVKEVRELAERIKEVVTESVKHSKKNVDEMRKLVDDVVKKVKKLVEDVRREIK

SEQ ID NO: 22761 - protein, 60 aa, Artificial Sequence
  Synthetic
SVAEKLRKVLEELRDVLRRVKEISRRSLERLKKVLKELADRLKELNDKLRKTLEELRKDV

SEQ ID NO: 22762 - protein, 59 aa, Artificial Sequence
  Synthetic
EELVEEIVKEIKKLAKEVAETVDKVAKENEKLAKEAKEKVEESERDVERLLEELKREAD

SEQ ID NO: 22763 - protein, 56 aa, Artificial Sequence
  Synthetic
DEEKILEDVLRELKKVLDEVRKTNEDANKRLKDVDDKSHEILKRVEERLREVVKRV

SEQ ID NO: 22764 - protein, 56 aa, Artificial Sequence
  Synthetic
VEDVVRRVRKVAEDVRRSSEETVKRIEDVVRRSEETVRELVKRVEDLVREMEEEAK

SEQ ID NO: 22765 - protein, 56 aa, Artificial Sequence
  Synthetic
SDEEKLRKVERELEEADKESHEINRTVNEDLRRVDRESKEILDRVRKELEEVKDKI

SEQ ID NO: 22766 - protein, 56 aa, Artificial Sequence
  Synthetic
VEDLVRRVRKVAEDSRRSSEDTVRRVERVVRESKRLVDDLVRRARRVVEEIKRTAK

SEQ ID NO: 22767 - protein, 56 aa, Artificial Sequence
  Synthetic
KEDEILKTVVDELRDALREVEERNRTVNEELRRADKESEDRLRKVVRELTEVMKRV

SEQ ID NO: 22768 - protein, 56 aa, Artificial Sequence
  Synthetic
VEELVRRVREVVKRVRDSSRETVERVKRVVERSRRLVERLVRKVEEVVREVEERAR

SEQ ID NO: 22769 - protein, 60 aa, Artificial Sequence
  Synthetic
SDVDRFLREVERLVERARKLSERDERETRKVVKEVRDSSRKSVEDSKRVVEKLEEEARRG

SEQ ID NO: 22770 - protein, 56 aa, Artificial Sequence
  Synthetic
KEKLDKVLEDLRRVVEEVKRRNDEVLKRLKEVVDEVTKRNRKALEDAKERLKKVTE

SEQ ID NO: 22771 - protein, 60 aa, Artificial Sequence
  Synthetic
SEVDEVAKRVREIVERLRDLVRKVVEDNERIAREVKRSSDETLKEIRDIVRKAKEVADRG

SEQ ID NO: 22772 - protein, 56 aa, Artificial Sequence
  Synthetic
ERKIDKVLKELEEVITDVRRTLDDVDRKLREVVKKVEEINRRANEELERVIREVRR

SEQ ID NO: 22773 - protein, 60 aa, Artificial Sequence
  Synthetic
DDVERLLKKVEDIVRELRESSRKSVEEIKRIVKEVKRLVDEVVKENERIVEEAEDVMRRG

SEQ ID NO: 22774 - protein, 56 aa, Artificial Sequence
  Synthetic
REKLDEVLKRARDVLREVEKENDKANKELEEVAERVKKTLDDVDKKLEDVMRKVTK

SEQ ID NO: 22775 - protein, 60 aa, Artificial Sequence
  Synthetic
KEEEIVERVREKIKRVLDEVREIDKRAHDELRRVLKEVEDIVRKVHEDLKRVLEEVRREV

SEQ ID NO: 22776 - protein, 56 aa, Artificial Sequence
  Synthetic
VKTVVETVDKIAKEVRDLSRRSVEENRKLAREVREVVRKVVEDNRRLAREVRERVR

SEQ ID NO: 22777 - protein, 60 aa, Artificial Sequence
  Synthetic
DEDEKVEKVTREVEKALDEVRKIDEEAHRRLKRVLDEVRRIDETVHRDLKRVLDEVRERV

SEQ ID NO: 22778 - protein, 56 aa, Artificial Sequence
  Synthetic
VETVVERLRRLVEDIRRKSRESVERNRELVKEAKDVSRKSVEENKKLVRDITREAT

SEQ ID NO: 22779 - protein, 59 aa, Artificial Sequence
  Synthetic
SVDEIVERVERELKRVLDEVREIHDRARDELRRMHERSERIIRKVEEELERALKEVRDR

SEQ ID NO: 22780 - protein, 59 aa, Artificial Sequence
  Synthetic
DKVVREAVREVERVVTELLEESRRSVEKTERLVRRSEELIRKIVKEVKKVAREIREEVR

SEQ ID NO: 22781 - protein, 59 aa, Artificial Sequence
  Synthetic
SVDEILRKVKEELDRVLEEVTEIHRKAKEELDRAHDTSERIHREVKRELDRVREEVERQ

SEQ ID NO: 22782 - protein, 59 aa, Artificial Sequence
  Synthetic
EKVVKEVVDEVRKVVEEIRKKSKDSVDKTKRVVEESIRTSDEVVKKTEKLVREIEKEVR

SEQ ID NO: 22783 - protein, 59 aa, Artificial Sequence
  Synthetic
SVEEIVRKVTKELRDAHRRTEKILRDVDKELKEVLDRVRKIHRDVKERLEKVLDDVRKR

SEQ ID NO: 22784 - protein, 59 aa, Artificial Sequence
  Synthetic
EEVVTRAVERVKRAVKKSEDDVRRIVDENRKLVKEIEDRSRESVKKTEELIERIRKRVE

SEQ ID NO: 22785 - protein, 60 aa, Artificial Sequence
  Synthetic
NVEDILRKAEEEVRRMLAENERIVEEAKERAKRMLDESRKRLEEVLRRAREVLEEVDKRK

SEQ ID NO: 22786 - protein, 59 aa, Artificial Sequence
  Synthetic
EDVVRAVVEELRRLLEESIRHVRKVVREIEKLLREDIELVKEVVRRIERLLRELDKEVR

SEQ ID NO: 22787 - protein, 60 aa, Artificial Sequence
  Synthetic
RKVDELRKEVRRVVKESRDKAKRVVEEVKRLVEKSRRDVKRVVDENRRVVEEMRRKVKDR

SEQ ID NO: 22788 - protein, 56 aa, Artificial Sequence
  Synthetic
DKEVKDAEDELDKAHEDTKKILDEVKKELDDAHDETRRILEEVNKESETVLEEVER

SEQ ID NO: 22789 - protein, 60 aa, Artificial Sequence
  Synthetic
SLARRVEEEVKRVVDESEEKVRRVVKVNKEMVDDVRRLVKEVVDENEEVVKEVRDTVTKR

SEQ ID NO: 22790 - protein, 56 aa, Artificial Sequence
  Synthetic
REDVRRVEEELKKAHDDTKKILDDVDERSREALDEVRKELDRVNKRSDKALKDVRK

SEQ ID NO: 22791 - protein, 60 aa, Artificial Sequence
  Synthetic
SKAEELVKRVKEVVDKVRKLVEEIEEKVKRVVEKSRRDVTEVVKKNREVVKRVKDTVRRR

SEQ ID NO: 22792 - protein, 56 aa, Artificial Sequence
  Synthetic
EEIVRRAREELERVLDEAKRILEKVTRELDEAHKETEKILRDVNRESDKALEEVER

SEQ ID NO: 22793 - protein, 59 aa, Artificial Sequence
  Synthetic
SEDEKLDKVRKRLERAHEESKKISDKSEKDTRDAHRKTEEILDRVRKEMEEVLKRVRDR

SEQ ID NO: 22794 - protein, 56 aa, Artificial Sequence
  Synthetic
AEEIVKDVERVVKESEDLVRRIVEINERIVRESERLVKEVKDRVRDMVRRLAEEAR

SEQ ID NO: 22795 - protein, 59 aa, Artificial Sequence
  Synthetic
SVEDIIRKVEKEVEEVVEKVERILDTVRRRSEKVLRENKEILEEVKRRADKVLRDVERN

SEQ ID NO: 22796 - protein, 59 aa, Artificial Sequence
  Synthetic
EEVAKRLEDRVREIVRTLEDLVREIVRRSEESVRRSRESAKRVVDTVKRIVDELEKRVR

SEQ ID NO: 22797 - protein, 60 aa, Artificial Sequence
  Synthetic
DVEEIIRRVSDKARKVLDRNRKILEDVKRRSEEVLEENKRIVDEVDEIIDEVLKRVKKRS

SEQ ID NO: 22798 - protein, 59 aa, Artificial Sequence
  Synthetic
REVVDRAVKRVEELVKRSERSADEVRKRSTESVKESKRSAKKVVEDVRRLVEELERRVR

SEQ ID NO: 22799 - protein, 60 aa, Artificial Sequence
  Synthetic
SEEDIIREAERIAREALKRARKIAEDARRISEKALEDARRIAKEAHDISKKALEDAARKR

SEQ ID NO: 22800 - protein, 56 aa, Artificial Sequence
  Synthetic
AKRAAEEAKRLAEEAEEAAKRVADRNRKLAKEAADLAREVAKRSEELAREAAKKAQ

SEQ ID NO: 22801 - protein, 60 aa, Artificial Sequence
  Synthetic
REDEKIEEVKRRAEEVLKESKKIIEDVLKKSEEVIKEVREILEKAHRISAKVLDEVRKTR

SEQ ID NO: 22802 - protein, 56 aa, Artificial Sequence
  Synthetic
VDEVVERVERIVTKNLRLAERVVEENEKLVEDLRRLVADVVRTSKKLVDDVRERVR

SEQ ID NO: 22803 - protein, 60 aa, Artificial Sequence
  Synthetic
SEDEKVDEATKEAERVLREVRKIIKRAHDRSRDAEREVKRTLDEVRRETKRVLEDVDRTR

SEQ ID NO: 22804 - protein, 56 aa, Artificial Sequence
  Synthetic
VDEVVRRVKEIVRRLEELAKEIERRSDEIVEEIRRLVKKVVDENRKIVKKAEEDAR

SEQ ID NO: 22805 - protein, 60 aa, Artificial Sequence
  Synthetic
DEDEIIDEAKKRADEVLKRSEDILRRAREEVEKVLEEVRKIIEDVHRRSRKVLEDVRRKA

SEQ ID NO: 22806 - protein, 56 aa, Artificial Sequence
  Synthetic
VETVVRRVDEIVKRNEELARRLVEEAKKIVDDLRRLAEEIVKRSEDLVEKLKEDAR

SEQ ID NO: 22807 - protein, 60 aa, Artificial Sequence
  Synthetic
SIEDVLRDVARKLRTVVDEARKILDEVDKATEKVLREAERVIREVAKRDKKVVDEVRKGG

SEQ ID NO: 22808 - protein, 56 aa, Artificial Sequence
  Synthetic
AEDLLKLVEDVVRRIRKLAEDVKRENDKLVERIREVAEDVLRHSEETVEEARKAAE

SEQ ID NO: 22809 - protein, 60 aa, Artificial Sequence
  Synthetic
SSEEALKEVERRLEDVRREVKRVAEEIKKKDDKVNDDAREKLERVNRETKRVLEELAREG

SEQ ID NO: 22810 - protein, 56 aa, Artificial Sequence
  Synthetic
VEELKDKVRRLLEELKRLLEELDKHSARTIKEIRDLIETLRRINEKVIEDMKRRRD

SEQ ID NO: 22811 - protein, 60 aa, Artificial Sequence
  Synthetic
SELDEAKRLVDEVVRRLEELLREDKKLVAEVEREVRELLERNARLLKEVADRIRRLKEEG

SEQ ID NO: 22812 - protein, 59 aa, Artificial Sequence
  Synthetic
EKVVREIERLLRELEKALEDVERELRRSKDRLRKLAEEVKKVLDDSRRELERLREELRT

SEQ ID NO: 22813 - protein, 60 aa, Artificial Sequence
  Synthetic
KDIEDAVRDVRRKVKELIENSERVVRTVEKLVRELIDHSRKVVREVEKLAKELIELKRRG

SEQ ID NO: 22814 - protein, 56 aa, Artificial Sequence
  Synthetic
EEVLKEVDRVLREAEKRSKEINEESKRVLDKAERDSRRIDRKSEEVVKRAEEEVRT

SEQ ID NO: 22815 - protein, 60 aa, Artificial Sequence
  Synthetic
EEIERVLRRVTERLKELERHSEEVLREVERLVKEDEDLAREVVKRVEELIRTLRELKKRG

SEQ ID NO: 22816 - protein, 56 aa, Artificial Sequence
  Synthetic
RRVLEEVREVVDRAEKKIKELDDRSREVLKEVEKRSRDIIREIEEKLKDVEERVKD

SEQ ID NO: 22817 - protein, 60 aa, Artificial Sequence
  Synthetic
SKAEEVAKRVEDLAREDIKLAERAAREVERLARENIKLAREVAKRVEELARRLIEAARRG

SEQ ID NO: 22818 - protein, 56 aa, Artificial Sequence
  Synthetic
EKALKDAEDAARKAAEDSERAIERAERAAKDALKKSEDAAEEAKRAADKALEDAAR

SEQ ID NO: 22819 - protein, 60 aa, Artificial Sequence
  Synthetic
DEVRDLVRRVRELSEELIRRVRTLLREVEELSRRLIEESERLLREVRKIVEELIRRVERR

SEQ ID NO: 22820 - protein, 56 aa, Artificial Sequence
  Synthetic
ERVVKEAEEVVERANRESEKLLEDVKRVVEEANKTSEDILRAVEEIVRRVLEELKK

SEQ ID NO: 22821 - protein, 60 aa, Artificial Sequence
  Synthetic
SSKEVLERVAEKLKEVNERLKDVLRRVAEKLKRANEENKKVLERVRDILREVLRRLREKV

SEQ ID NO: 22822 - protein, 56 aa, Artificial Sequence
  Synthetic
VEEAERVVEKSVEEARRLAERVKEEVDRSVKHSEDNVREMRRLVEEIVKRVEEAAK

SEQ ID NO: 22823 - protein, 60 aa, Artificial Sequence
  Synthetic
REKEVLDRVEEILRDANRRNEKVLREVAEIIRTVIEDNKRVLKEVADELRRVLEELRDKV

SEQ ID NO: 22824 - protein, 56 aa, Artificial Sequence
  Synthetic
VEEMEDVVRRSLDHSRRNVEEAKKAVTKVVEDNKDNVRRIKEVVARVVEKAREEAR

SEQ ID NO: 22825 - protein, 60 aa, Artificial Sequence
  Synthetic
SEVEEVLRRSRESAKKSKEHSRELLEKVKRIIDDVKRLVREVLKRSRDSIKRVEDLTRRG

SEQ ID NO: 22826 - protein, 58 aa, Artificial Sequence
  Synthetic
EKVKEAVKESRDLLRKVEETNRRVNDEVRKLLEDIRRDVERAVEESERLLEDIVRKVK

SEQ ID NO: 22827 - protein, 57 aa, Artificial Sequence
  Synthetic
SDVERVLTEIRKLVEDIKRDVERVVDESRKLVEEAERDVERVITEVEKLVERIKREV

SEQ ID NO: 22828 - protein, 56 aa, Artificial Sequence
  Synthetic
ARELLKRVRELIKEHNRLNRESLKTSRKNIEDHHEDNKRSLEEARRIIEEVREAAR

SEQ ID NO: 22829 - protein, 60 aa, Artificial Sequence
  Synthetic
KELEDVEKEVEEVAKRVEDSIRRNREVVEKVKDEVRRLLDRNDELVDRVAKEITEAIKKG

SEQ ID NO: 22830 - protein, 58 aa, Artificial Sequence
  Synthetic
EKVKKVLEDVRRRLEELIKRSEDSAREVEKRLEDLRREVEESLERVERTLEDLVRRVK

SEQ ID NO: 22831 - protein, 60 aa, Artificial Sequence
  Synthetic
SELERLEERVRRIEEEVKRLLEEHREVSDRVAKENRRSNEESKREVRRIEEEVKDLSRKG

SEQ ID NO: 22832 - protein, 58 aa, Artificial Sequence
  Synthetic
EEVKKVVEDVKRRLDDLIRKAEKVVRDSERELKKLVDHSKEVVDRVRERLKELIEEAR

SEQ ID NO: 22833 - protein, 60 aa, Artificial Sequence
  Synthetic
SEVEDLERRVKRILEESDELVKRHEEKSRKIVKDLEDLLRRNEDTVEKILRELEKRIRDG

SEQ ID NO: 22834 - protein, 58 aa, Artificial Sequence
  Synthetic
ERVTRVVEKVRRLLEESKRRSKEVVKRSKDLLKEAEDRADESVRELRRKLKELEEKAE

SEQ ID NO: 22835 - protein, 59 aa, Artificial Sequence
  Synthetic
SELEDIRRLLEKLDREVKELLKRSRDLAKEMEERVRKLVKESEDELRKLAEKVDRIKKN

SEQ ID NO: 22836 - protein, 58 aa, Artificial Sequence
  Synthetic
DEAREVLKDVRRKVEELRKELTKVDKEIEEIVRELEKRLREVNERVRTIVDELAKRLK

SEQ ID NO: 22837 - protein, 56 aa, Artificial Sequence
  Synthetic
SMLEELDKEARELLKEVRRLVEDNDRLLEELLRRARELLERNDRISEKVADEVRKI

SEQ ID NO: 22838 - protein, 58 aa, Artificial Sequence
  Synthetic
ERMREVAKKVKDILKRAEEEVRESLERVRRELERVIRELEDSLRRNDKTLRDLIEERR

SEQ ID NO: 22839 - protein, 56 aa, Artificial Sequence
  Synthetic
SDLERLDELLKRVLEKARKLVKENDEHSEEVRKTVEKVVRDNDKLAEDLADKVEKI

SEQ ID NO: 22840 - protein, 58 aa, Artificial Sequence
  Synthetic
ERVKEVLDRVDEILKRVIKAAEESLKRSHEINRRLIKAAEDSLRRVKKILDELEERVR

SEQ ID NO: 22841 - protein, 56 aa, Artificial Sequence
  Synthetic
STLDKLRELLRRVEETVREVLERNDEHSKEVKRRVDKLLRENDEHSKELADLVRKI

SEQ ID NO: 22842 - protein, 58 aa, Artificial Sequence
  Synthetic
REMEKVLTDARRSLRRLEERVRESLERSHRINRKLRKDVRESLERSKRILDKLREEVR

SEQ ID NO: 22843 - protein, 56 aa, Artificial Sequence
  Synthetic
SVLEELRKLVEKVLREVDKLLKDNNRHSEEVEKTVKRLLDENDRLLEELADRVEKI

SEQ ID NO: 22844 - protein, 58 aa, Artificial Sequence
  Synthetic
EEAKKVLTEVRRTLEELERRVRKSLKDSHDINRKLEKEVRDSLKRVKDRLDELIKRVR

SEQ ID NO: 22845 - protein, 57 aa, Artificial Sequence
  Synthetic
RKAEEVLKRAKKIVDEVDKKNRESLERTRKIVEDVNEENREVLDRLRRRAEELKKEV

SEQ ID NO: 22846 - protein, 59 aa, Artificial Sequence
  Synthetic
DDVVRRIEEVIEKARRENDESVRRDEKLMKEVKDENKKTVDDIRRLLKDIEDKVREAKR

SEQ ID NO: 22847 - protein, 57 aa, Artificial Sequence
  Synthetic
SKLEEVVKRLEEIVRRVKRADEESLKRTRKIVEEVNRDNRRSLKESRDRVDELKKRV

SEQ ID NO: 22848 - protein, 59 aa, Artificial Sequence
  Synthetic
DEVVKRIEEVAKRNEELNRETVKRDEDLVREAKRRNEETVERDKRLVEKITKEVDETKK

SEQ ID NO: 22849 - protein, 56 aa, Artificial Sequence
  Synthetic
SLIETIRDLAKKLKEESDKSVETDKRLVEELRRRSKKTVDDIDELVKRLERMVEDD

SEQ ID NO: 22850 - protein, 58 aa, Artificial Sequence
  Synthetic
EDAKRVLEELKRIIEDLLRKNKKSLDDTEREVRRLIKENETVVRKLEEIVKRLEEKIR

SEQ ID NO: 22851 - protein, 56 aa, Artificial Sequence
  Synthetic
SLLEEIAELVERLRRESKESVKRDEELVDELKKRSEETVKEDKRLAEELDRLAKKI

SEQ ID NO: 22852 - protein, 58 aa, Artificial Sequence
  Synthetic
EEMKKVLDDLRREIKKLEEENERSLERTRDIVRKLDRTNEESARESEKIIREVVKEVK

SEQ ID NO: 22853 - protein, 56 aa, Artificial Sequence
  Synthetic
SLLERIKEEVEKLRKESEESVETDERLVEELKKEVKDLVEKDRKLAEDLKDEVDKD

SEQ ID NO: 22854 - protein, 58 aa, Artificial Sequence
  Synthetic
ERAKEVLRDLRRTVKELTDENEKSLERTRREVEKLIRELEESLRESRRRVKRLLEKVK

SEQ ID NO: 22855 - protein, 56 aa, Artificial Sequence
  Synthetic
SLLEEIERRVEELEDRSRKSVERDKELAKEVDDRNEESVRTDEELAKRLADLVRKR

SEQ ID NO: 22856 - protein, 58 aa, Artificial Sequence
  Synthetic
ERMEEVLKRLKEIVKELEERNRESLERTRRILEEVDRKNEESLKRSREIVRELDERVR

SEQ ID NO: 22857 - protein, 56 aa, Artificial Sequence
  Synthetic
SLVEEIERRVEKLAEEVKRLVERDRKEVEKLEKESRDTVREIEELADRLRDAVEKE

SEQ ID NO: 22858 - protein, 58 aa, Artificial Sequence
  Synthetic
DEMRKVLTRLREEVRRLLDELRRSLEDTKRTVEDLERKNKTVVDELRKTVAELERRAR

SEQ ID NO: 22859 - protein, 59 aa, Artificial Sequence
  Synthetic
SIDEVLKRIREISDDAKRKIKEVVEEIKKNADRLRREIERVLDEIRKVIRELLERIKRV

SEQ ID NO: 22860 - protein, 59 aa, Artificial Sequence
  Synthetic
DEDLERLLREVERRTRRHEEELERLLRHNNKVSKEVREELKRLLDRVREMLEDVDRKLK

SEQ ID NO: 22861 - protein, 59 aa, Artificial Sequence
  Synthetic
SVEEVRKEVKRISDEAREEIERVLERIKENAKRLIEDIRRVLEEIEEIIRRLEDEIRRV

SEQ ID NO: 22862 - protein, 59 aa, Artificial Sequence
  Synthetic
DEDLEELLRRLERISRESRKRLEELLKHNNKESEEVRKRLKELLDDVRRVVEEVRRKLK

SEQ ID NO: 22863 - protein, 59 aa, Artificial Sequence
  Synthetic
SIDEVLEELKRISTEAVERIRRVAERNRKSVEEVRKRIEEVAKRIREIATRLLERIRRV

SEQ ID NO: 22864 - protein, 59 aa, Artificial Sequence
  Synthetic
DEELKKLLDELEKISRDSDERLKESTKKVRDVNRESDKKLKELLKRVEDVLEKVDRELK

SEQ ID NO: 22865 - protein, 59 aa, Artificial Sequence
  Synthetic
SVDEVLERIRESAETILEEIRRVLERNKRSAETILEEIRDVARKIEKRIRDVLKKIEDV

SEQ ID NO: 22866 - protein, 59 aa, Artificial Sequence
  Synthetic
DEELRKLLEEVKKINDDSRRKLEKSTRDVKKVNDDSRRELERLLRKVEEVIRRVDEELR

SEQ ID NO: 22867 - protein, 60 aa, Artificial Sequence
  Synthetic
KLEELVEEVEKVVREVKKELEDVVRTVREVVKRSKDDLREVVKEVERINRELEERLRRLA

SEQ ID NO: 22868 - protein, 55 aa, Artificial Sequence
  Synthetic
TELLERVKTLIKEIRDRLRRLLEEVKRLVEESKKDLKRLLDENKRLVDEATKTAK

SEQ ID NO: 22869 - protein, 60 aa, Artificial Sequence
  Synthetic
SLEELLKEVEKVIRDVKRELEKVVRDIEENVRRSAKRLREAEEEVERINRRLEEELKKKT

SEQ ID NO: 22870 - protein, 55 aa, Artificial Sequence
  Synthetic
TELLKRVRDLIRRIRETLEKLLKENHDLSKRSKEDVERLLKENADLVKELTDRAE

SEQ ID NO: 22871 - protein, 60 aa, Artificial Sequence
  Synthetic
SLEDLLREVKRVIEEVKRELEEVVRRVKEIVERSVRDLRRVVDEVRRINTELEERLRRLT

SEQ ID NO: 22872 - protein, 55 aa, Artificial Sequence
  Synthetic
TELLRRVEELIKEIRKELKRLLDEVKDLVDKSKENAKKLLEDNKRLVEKIARDAT

SEQ ID NO: 22873 - protein, 60 aa, Artificial Sequence
  Synthetic
KLEELVREVEKVVDDIRKELEEVVRRVEEVVRRSKRTLEDVVRRVKKINDDLEKELRERS

SEQ ID NO: 22874 - protein, 55 aa, Artificial Sequence
  Synthetic
TELLEDVKRVLDEIRETLERLLRKVEELVERSKRNAEELLKRNEDLAKKVRDDAK

SEQ ID NO: 22875 - protein, 56 aa, Artificial Sequence
  Synthetic
DVEDVLRKIEEIIRRVLEEIKTVLDEIRKNNEKLKEDVDRVLAEIEKDSEDLKRKI

SEQ ID NO: 22876 - protein, 58 aa, Artificial Sequence
  Synthetic
ELAETILRRVEELVEEIRRRLKEILDRDHELSKRLKEELKKILDDNHKLSRDAAERAR

SEQ ID NO: 22877 - protein, 56 aa, Artificial Sequence
  Synthetic
SVEDVLREIKETSDDAARKADEVLKEIEKNNRRLKKEIDRVHEHTKEDSRRLKEEI

SEQ ID NO: 22878 - protein, 58 aa, Artificial Sequence
  Synthetic
DLMREMLERNRKLIEDLKRELEDILRRDHRLSKELLARLKESNEENHRLSKEIRERRK

SEQ ID NO: 22879 - protein, 56 aa, Artificial Sequence
  Synthetic
RVEDVLRKVEEIIRRLKEEIDRVLEKIRETSERAVKDIRDVLRRIREDSKRLKEDI

SEQ ID NO: 22880 - protein, 58 aa, Artificial Sequence
  Synthetic
EDAERIVEEVRKLVEEIRKELEDILRKNEKLIEDLKRELKKILEENHRLSREIRERRR

SEQ ID NO: 22881 - protein, 56 aa, Artificial Sequence
  Synthetic
SAEDVLREITKTSERAREDIKRVLDEIKRTSDEAVKTVTDIHEHTRKTSEDLKRKI

SEQ ID NO: 22882 - protein, 58 aa, Artificial Sequence
  Synthetic
EVLRKILEENRELIERLKKELKELLDRNRKLIEDLLREAEKSNEDNKELIKKAEEDAR

SEQ ID NO: 22883 - protein, 56 aa, Artificial Sequence
  Synthetic
SVEKVLEDITRELRRADEESKRALDHSAEVLKDLERRVKEVLDESREIIKELERRL

SEQ ID NO: 22884 - protein, 59 aa, Artificial Sequence
  Synthetic
DEEAKRVLDEVEKLVRELKKRNDELNEKTERLVRDLRRRLKDSLDKSRDLVRRLEEKAK

SEQ ID NO: 22885 - protein, 56 aa, Artificial Sequence
  Synthetic
SVEEVLDEVRRIIEELLRLSEEMLRHSEEVIRDLERVSREVLERSKRIIDELLREL

SEQ ID NO: 22886 - protein, 59 aa, Artificial Sequence
  Synthetic
DEVAKRAVEDVRRVVEDLERRNRTLNEKTKRLVEKLTRDNERSLKESKKVVDELREEAR

SEQ ID NO: 22887 - protein, 56 aa, Artificial Sequence
  Synthetic
SVEEVLDEIRKRIEDLKREVDEVLDRSRRIIETLKERVDRVLKHSRELIKRLKDKL

SEQ ID NO: 22888 - protein, 59 aa, Artificial Sequence
  Synthetic
DEEMKRALEEVKKLLDRLREELKRSLDESRKLVEELERRLRESNEESERLIRKLEREAD

SEQ ID NO: 22889 - protein, 56 aa, Artificial Sequence
  Synthetic
SVEDVLREVEKIIRELDRKSEKVLEDSKRVIEDLKRKVEEVLRHSETLIRDLERRL

SEQ ID NO: 22890 - protein, 59 aa, Artificial Sequence
  Synthetic
DELAKEMVDRVRELVKKLEEENRRSLEESKKLVEELARRLERSNTESKRLIDKLREEAR

SEQ ID NO: 22891 - protein, 56 aa, Artificial Sequence
  Synthetic
SVEEVLKDIEKKIRDLDRKVKEALRHSEEVIRRLEEEVKRVLDDSERILRDLKEKL

SEQ ID NO: 22892 - protein, 59 aa, Artificial Sequence
  Synthetic
EELMRRIVEKVEELVKELDKRLRESNEDSKRLVEDLSRRAKKSLEESRELVRELKKRAK

SEQ ID NO: 22893 - protein, 56 aa, Artificial Sequence
  Synthetic
SVEEVLDRIRKIIKELLDRSEEALRHSEEVIKDLERKVEEVLERSREVIRELLERL

SEQ ID NO: 22894 - protein, 59 aa, Artificial Sequence
  Synthetic
DEELKTMLEEVKKVVEELLRRNRKSNEDSKELVKELTRRLRKSLEDSKELVRKLEEEAR

SEQ ID NO: 22895 - protein, 56 aa, Artificial Sequence
  Synthetic
SVEDVLREIEEILRRLEKESDDALEHSRRVIKRLEEESDRVLEESRRVIEELERKL

SEQ ID NO: 22896 - protein, 59 aa, Artificial Sequence
  Synthetic
DEEMKKLLEDVKRLVDDLRRKNEESNRRSKELVDKLDKENKDSLKESRELVEKLEREAR

SEQ ID NO: 22897 - protein, 59 aa, Artificial Sequence
  Synthetic
SVEEVVREVEEKLRKLIDDVRRVVEENRRNTERLRKRVTEVVKRNEDILRRLEEDIRRV

SEQ ID NO: 22898 - protein, 59 aa, Artificial Sequence
  Synthetic
EEVAKTALRKVEDLLKKLKERAEDSSRDNHRISKELTEELEESSKRVKTLVDELRKTVK

SEQ ID NO: 22899 - protein, 57 aa, Artificial Sequence
  Synthetic
SVEEVLKESREISTRLAEEVKRVLDEIRRILERVKRINEKVNKDIEEILRRVKKTVG

SEQ ID NO: 22900 - protein, 59 aa, Artificial Sequence
  Synthetic
ERVAEKILKEDRDTVERLRKRVEDLLRDVRRLVEDSERKSRDLLRRVEELVRELKKRVD

SEQ ID NO: 22901 - protein, 57 aa, Artificial Sequence
  Synthetic
SVEEVLKESKRVSEELNELNKKVNDDIRKILEKVNRENKKVNEDIERELRKLEEEVG

SEQ ID NO: 22902 - protein, 59 aa, Artificial Sequence
  Synthetic
EEVAREILRDDKRTVEESKRESKRLLERVKKLVDRSAEESKKLLEDVKRLLEELRERAR

SEQ ID NO: 22903 - protein, 57 aa, Artificial Sequence
  Synthetic
RVDEVLDESKKVSDRLHESIRRVLEKIEEILRRVNEENRRVNEEMKRILDELARTVG

SEQ ID NO: 22904 - protein, 59 aa, Artificial Sequence
  Synthetic
ERVAREILKADRETVRRLEKRAKDLLDEVRDLVRESEKRSRELLKEVEDLVRKLTEEAR

SEQ ID NO: 22905 - protein, 57 aa, Artificial Sequence
  Synthetic
RVEEVLKRMRDILRRVNEINRRVNRELERSSREILERIREILDRIRRILERLEERVG

SEQ ID NO: 22906 - protein, 59 aa, Artificial Sequence
  Synthetic
EKVARDLLREVEELVKESEELSEELLRRSRRSNEESLRKAEKLLETVRRLVEELEKKTT

SEQ ID NO: 22907 - protein, 60 aa, Artificial Sequence
  Synthetic
SEAEAVEEEVRRLVEESEKRSKELLEDVERLVEESERRSKKLLDDVRKLVDDLKKELRRV

SEQ ID NO: 22908 - protein, 56 aa, Artificial Sequence
  Synthetic
DRVIERLKRILKEAHDKNKEVSDRIRKILEELHRKNRKVLEDIKRILDDVRREVER

SEQ ID NO: 22909 - protein, 60 aa, Artificial Sequence
  Synthetic
KEAEDLLREVEKLVRESKKLSEDLLREVRKSNERSKRESERLLREVERLVRELKDLRDKV

SEQ ID NO: 22910 - protein, 56 aa, Artificial Sequence
  Synthetic
DRIIERIKRILEKVHKINREASKRIKESLDRAHETNKRVLDRIRKIVDDVRREVER

SEQ ID NO: 22911 - protein, 56 aa, Artificial Sequence
  Synthetic
RLEEVKEELKRIATKLKEEIKENIRRLEESVEKIAKELAENIKRLEDILRDVKRKL

SEQ ID NO: 22912 - protein, 56 aa, Artificial Sequence
  Synthetic
GEELVERLRRVVEEVRERLKDSSRELRKINEDSRKKVEDSSREVKKVVEELERRDT

SEQ ID NO: 22913 - protein, 57 aa, Artificial Sequence
  Synthetic
KELEDVARKVEDLLRRIEKTNRDAIRESERLVRELKREVEKVEEESRRLLEEVERRI

SEQ ID NO: 22914 - protein, 56 aa, Artificial Sequence
  Synthetic
AKKLLDEVRKVIEDNRKRSEELLEENRKVVEDVSRTLERILRENERVADEVDKEER

SEQ ID NO: 22915 - protein, 57 aa, Artificial Sequence
  Synthetic
DELERVTEEIDKLSKDLERRVREVLEESRRLVEDVERVVREVLEEARRTAKDIADKV

SEQ ID NO: 22916 - protein, 56 aa, Artificial Sequence
  Synthetic
VDKLLEEVRKISEDSKERLKEILKRNEEVARRVKRELKRLLETNREIIRRVEERER

SEQ ID NO: 22917 - protein, 56 aa, Artificial Sequence
  Synthetic
RELEELLDKVRKIVEESKKRNEDLLREVREIVERSKEKIKKVLDEVRKIIETVRKS

SEQ ID NO: 22918 - protein, 58 aa, Artificial Sequence
  Synthetic
KEVEKVLRDVEELIRDSERASDRVLKDVEELIKDSERMSKKAEEDVDRLLRELDKDVR

SEQ ID NO: 22919 - protein, 61 aa, Artificial Sequence
  Synthetic
DSVERVAEEVRKLLEDIKRVSDEVTKRLRDLLEDLKRVSDKVRKDIERLLEDLEREVRRKG

SEQ ID NO: 22920 - protein, 59 aa, Artificial Sequence
  Synthetic
DRVLEEALRRVEELARRIKEHSKRVLETVRRLVEEIKKHSRKVLEEVRERIKRIKDELR

SEQ ID NO: 22921 - protein, 61 aa, Artificial Sequence
  Synthetic
SEVEKAEKDVRDLLKDLRRVSEKVKRAVEDLLRDLKRTSDKASEDAKRLLDDLRRKVEERG

SEQ ID NO: 22922 - protein, 59 aa, Artificial Sequence
  Synthetic
DRVVKEILDEVEKLIREIKKHSEDLLRKVRKDIKRVKDHTKRVLDRIRKLIEDIKRRLE

SEQ ID NO: 22923 - protein, 60 aa, Artificial Sequence
  Synthetic
DEVKELLDRVREEIRRDKERVKKLLEDSKRLNERDKREVKRLLEEVRELIKRLEDIIRKS

SEQ ID NO: 22924 - protein, 55 aa, Artificial Sequence
  Synthetic
EEVVKDLERLLRDLERVNDEVEKRLRDLTEDSKRFNDEVAREIEKLLEDVARTVK

SEQ ID NO: 22925 - protein, 60 aa, Artificial Sequence
  Synthetic
REAEELLKRVEDLIRRLKDMIRKLLEDSKRLNERDVETVKRLLEDVERTIREIKDEVRRD

SEQ ID NO: 22926 - protein, 55 aa, Artificial Sequence
  Synthetic
ERIVREVEKLLEKIKRDVDRVRRELERLTEESKRINDKAVRDIEELLEDLKRAVK

SEQ ID NO: 22927 - protein, 59 aa, Artificial Sequence
  Synthetic
DELERLLEDVERVSRETKKLLKKLLDDAKRVIDKNREDSRRSLEEVERVIREAKELLKD

SEQ ID NO: 22928 - protein, 62 aa, Artificial Sequence
  Synthetic
KDTERRVRDVVKKIRELSEDVEREAKKVIDRLKELLEDIERENRRVEEEIKKLLEDVERTAR

SEQ ID NO: 22929 - protein, 59 aa, Artificial Sequence
  Synthetic
KLVERLVKEAEDLTEEHKERLDRLLKENEKISRESKKRLKEILEENERVVEEVKKLLRD

SEQ ID NO: 22930 - protein, 59 aa, Artificial Sequence
  Synthetic
RKKVDEVRRRLEELHKELEKVVRDVKRTSEKLVRDSEDMARKVVKTSEDLLRELEEEAR

SEQ ID NO: 22931 - protein, 59 aa, Artificial Sequence
  Synthetic
SRAEDLVRRVEEMTRKHKKDLDDLLRENEEVSRRSKERIRKLLKDIKDVVDDVERVLRA

SEQ ID NO: 22932 - protein, 59 aa, Artificial Sequence
  Synthetic
RDKVEEVRERLKKLHTELEKRVREVKRDSERLVEDSERTVEELLRRVRKLLKEVRDSVK

SEQ ID NO: 22933 - protein, 60 aa, Artificial Sequence
  Synthetic
SEAERLVEEAERVTREHKKRLDDLLKEVRRVSEDSKRKLEKILKENEDVVEEVKELLKAG

SEQ ID NO: 22934 - protein, 59 aa, Artificial Sequence
  Synthetic
KEKVDRVRRELDRLHKELAEVVERVKRAVDKLLRDSEEEVKRVEERSERLLKEVADALR

SEQ ID NO: 22935 - protein, 59 aa, Artificial Sequence
  Synthetic
SDVDKLVDDVRRETEKHKKTARDLLDELRKVSEESRRRLKRLLEEITEVVERIKRVLEA

SEQ ID NO: 22936 - protein, 59 aa, Artificial Sequence
  Synthetic
EEEVRRAKEELDRLHKEVEDVVRDVTRELDRLLKRSREVVERVREEADRLLEEVERTLK

SEQ ID NO: 22937 - protein, 59 aa, Artificial Sequence
  Synthetic
SEVDELVERAERISRESKKTIKKILEDNERVSKRHKDELKKLLDELKRVVDEVRKVLER

SEQ ID NO: 22938 - protein, 59 aa, Artificial Sequence
  Synthetic
KEKVERALRELDRLLEESKRVVDEAEKTSDKLNKEVEEMARRVEEEVDRLLKEVRDDAK

SEQ ID NO: 22939 - protein, 59 aa, Artificial Sequence
  Synthetic
SEADELVKEIEDVSRRSKEELTRLLEEAEKVSREHKKTLEELLRRIEKVVRDIKEVLRG

SEQ ID NO: 22940 - protein, 59 aa, Artificial Sequence
  Synthetic
EKKVREVEKLLDKLLEESRKRAKEVLRALRELNREVAEVVRRVEERLRRLLKEVEEAVR

SEQ ID NO: 22941 - protein, 59 aa, Artificial Sequence
  Synthetic
SDVDKIVEEIERISRDSERRIREIVERNKKVSEDHKRELERLLKEMEKVVEDVKKVLKD

SEQ ID NO: 22942 - protein, 59 aa, Artificial Sequence
  Synthetic
KKKVDEARKKLRDLLERSKEVVKEAERRLEKSNRDVRREAERVRKALDDLLKEVDEAVR

SEQ ID NO: 22943 - protein, 59 aa, Artificial Sequence
  Synthetic
SRADELVERAKRMTDEHKKTAEDILRENKRVSDEHKKTLEKILRENEKIVDEVAKLLEE

SEQ ID NO: 22944 - protein, 59 aa, Artificial Sequence
  Synthetic
KDKVREVEEELKRLHKEVEDVVDTVRRTSEKLNDEVRKVVETVTRRSEELLEELRRRAK

SEQ ID NO: 22945 - protein, 59 aa, Artificial Sequence
  Synthetic
KEVEKLVTEIREMTERHKRTLEELLKEAEEVSRRHKEDLKRLLDENRKIVEEVARVLEK

SEQ ID NO: 22946 - protein, 59 aa, Artificial Sequence
  Synthetic
KDKVERVLREADRLHEEVRKVVEKVREELRRLNEEVRKVVEEVRRDSERLVREVEERAR

SEQ ID NO: 22947 - protein, 59 aa, Artificial Sequence
  Synthetic
SRVDELVDRARKMTEKHKEELKRIVEENRRVSKEHKERLEDILRRNAEIVERVKEVLKR

SEQ ID NO: 22948 - protein, 59 aa, Artificial Sequence
  Synthetic
EDKVRRALEELKKLHDELAKEAKRVEELLDKSNEEVEKVVRDVREASERLLEELERTAK

SEQ ID NO: 22949 - protein, 59 aa, Artificial Sequence
  Synthetic
DEVKKLVDDARRLTEKHKTDLERLLDEARKVSEEHKKRLEELLREIAEVAKEILKVLRK

SEQ ID NO: 22950 - protein, 59 aa, Artificial Sequence
  Synthetic
REKVKRVEETLERLHKEVEEVVRRVKKALRDLNDEVRRVVDEVRRRLEELLKRVEEEAR

SEQ ID NO: 22951 - protein, 63 aa, Artificial Sequence
  Synthetic
REVDEVEERVTRLLKKVRDVAEESRRRSEELLKKSRDVVEEVKKEVDKLLEEVRDMVRRVKDK

SEQ ID NO: 22952 - protein, 59 aa, Artificial Sequence
  Synthetic
GRVLKKLVEEVKKLADEIERELERTSKEIEELSRRSEEDLRRLVRKLREVVRKIEEDLR

SEQ ID NO: 22953 - protein, 63 aa, Artificial Sequence
  Synthetic
REVERVERELERLLEEVREVAERSERESKKLLEDTRRVVRKVKEDVRRLLEEVRDVVRKVKDK

SEQ ID NO: 22954 - protein, 59 aa, Artificial Sequence
  Synthetic
GDVIRRMVEEVEKLARRIKETLERTVRRLEELVRRSEKNLRTLVEEVRKAVERIKETLR

SEQ ID NO: 22955 - protein, 63 aa, Artificial Sequence
  Synthetic
SEAERVEEDVRRLLKRVEEVIKRSEERSRELLKKTEDVVREVRKRVKKLLDEVKDTLDKVRDK

SEQ ID NO: 22956 - protein, 58 aa, Artificial Sequence
  Synthetic
EVLDRLVEELRKLVEEIERDLERTVREIEKLVKDSDRNLEDMVRELRRVAERIKEELR

SEQ ID NO: 22957 - protein, 60 aa, Artificial Sequence
  Synthetic
REVDEVRRRAEELLKEVRDVVTESEKESRRLLEDTRRVVEDVKRRVDRLLEEVRDLLREV

SEQ ID NO: 22958 - protein, 58 aa, Artificial Sequence
  Synthetic
DVLRELVKRLEDVAREIKKRLEDTLRKLEEVSRRSKENLRELVERLRRIADEIRERLR

SEQ ID NO: 22959 - protein, 61 aa, Artificial Sequence
  Synthetic
DEVDRVREEIERLLREVEEVLERSERESRRLLREVEEMLERSDEEVRRLLKEVEEVLRDEL

SEQ ID NO: 22960 - protein, 58 aa, Artificial Sequence
  Synthetic
EVLEEILRRAKEEVEKLKRELERTVERLAELVEELKRELERSTREVRKTVEELKRRIK

SEQ ID NO: 22961 - protein, 61 aa, Artificial Sequence
  Synthetic
DEAEDLERRARELLEEVERVLEESIRRSEETVKEVEDMLRRSTEEVERLLKRVEDVLREEL

SEQ ID NO: 22962 - protein, 58 aa, Artificial Sequence
  Synthetic
ELLKRLIDEVRRLAEKIKEELKESSKRDEEKVEKLKKELKDSTDAVRELVERLEREIK

SEQ ID NO: 22963 - protein, 60 aa, Artificial Sequence
  Synthetic
DEVEELVKEVEERIKKVHKENEDVLRESEELMKRLHEENERLLREVEELVRRIRELRKRG

SEQ ID NO: 22964 - protein, 55 aa, Artificial Sequence
  Synthetic
REARERIRRLLTESRKSVEEVEKRLRELSKRSEESVERVERTARRLLKELEDMTR

SEQ ID NO: 22965 - protein, 60 aa, Artificial Sequence
  Synthetic
EEVKRLVEKVRKLIEDSKRRNRDVLRRVEELVRRVHRRNEEVLRRVEKLVEDIKELLRRG

SEQ ID NO: 22966 - protein, 55 aa, Artificial Sequence
  Synthetic
EEAEREIERLLEESKRSVEEVEERIRRLIRESEESVREVKERIDELLKDADRATK

SEQ ID NO: 22967 - protein, 60 aa, Artificial Sequence
  Synthetic
REVEELVKDVERLMREVHRRNEKVVEEVEALIRKSKEDNERVAREVERLVREVEKMLRRG

SEQ ID NO: 22968 - protein, 55 aa, Artificial Sequence
  Synthetic
REAKERIKDLVRKSRDSVREVRERIRRLLEDSKRSVDDLARRIRELLRKAAEKAR

SEQ ID NO: 22969 - protein, 60 aa, Artificial Sequence
  Synthetic
DEAEELVDRVRKLAEDVHKKNEDVLRESDALVKDSDRRNREALRRVEKLVEDVEELLRRG

SEQ ID NO: 22970 - protein, 55 aa, Artificial Sequence
  Synthetic
EEVKRRIKELLKRVEESVRTVEEELRRLSKESEESVKRVEDRIRELLKRLRDAAR

SEQ ID NO: 22971 - protein, 60 aa, Artificial Sequence
  Synthetic
DEAEDLVRKVRKLIEESKKENEDLLREVRELVARVHEENERVLREVEKLVEDIRRLLRRG

SEQ ID NO: 22972 - protein, 55 aa, Artificial Sequence
  Synthetic
REVKKAIEDLLKESEDSVREVEEEIRKLLKDLEKSVRDVERAIEKLLDELRKDTK

SEQ ID NO: 22973 - protein, 60 aa, Artificial Sequence
  Synthetic
REVEELVREAEELVRRVHKRNEDALRRSKKLVEDVHRKNEEVLKRVERLVERIEELLRRG

SEQ ID NO: 22974 - protein, 55 aa, Artificial Sequence
  Synthetic
KEAAERIKRLIDEVRKSVEEVERRAEELSRELRRSVKEVRDALKRLLDDLRRATT

SEQ ID NO: 22975 - protein, 60 aa, Artificial Sequence
  Synthetic
REVEELVKEVRRRVREVHERNRRVLEDSERLVREVHKRNEEALRRSEELIKRVEDMRRRG

SEQ ID NO: 22976 - protein, 55 aa, Artificial Sequence
  Synthetic
ERAEREIRRLLEEVKKSVEDLTRKARKLSRDLERSVREVEERARDLSRRLREKTR

SEQ ID NO: 22977 - protein, 60 aa, Artificial Sequence
  Synthetic
SEVEKLVKDVEDLAREVHKRNKELVDEVRDRVRRVEERNKRVVDEVREEVKKLIDLLRRG

SEQ ID NO: 22978 - protein, 55 aa, Artificial Sequence
  Synthetic
EEAKDRIRELLKRVEESVEKVKRDIERLIERSKESVRRLEERIKELLRELEEAAR

SEQ ID NO: 22979 - protein, 60 aa, Artificial Sequence
  Synthetic
SEVEDLVRKVKKLMEDSDRENKRLVDEVRERVEEVKKRNKEVVDEVRERVKRLEEMLRRG

SEQ ID NO: 22980 - protein, 55 aa, Artificial Sequence
  Synthetic
KDAAEAIKDLIRKSEKSVDEVRREIERLIKESEDSVKRVTDEIRKLLKRLRDTTT

SEQ ID NO: 22981 - protein, 60 aa, Artificial Sequence
  Synthetic
SELEEILKTVKKLVDDHKRLSEEILRRVRKLVEEHKRKSEEILKRVTDLAEDVKDKIRKD

SEQ ID NO: 22982 - protein, 54 aa, Artificial Sequence
  Synthetic
EVEKELDRLLKELERVSRESEKELRRLLKELEEASRESEERLRRLLRDVEEALK

SEQ ID NO: 22983 - protein, 57 aa, Artificial Sequence
  Synthetic
DEIETVKEELKKLLERLEESSRKVERDLEDLLRRSEESTREVEKRLKELLEDVRRKL

SEQ ID NO: 22984 - protein, 56 aa, Artificial Sequence
  Synthetic
VKEVLDRVRELARTHHELNRELLREAEESSREHHRLNEELVDRVRKLVKEVEDRAR

SEQ ID NO: 22985 - protein, 57 aa, Artificial Sequence
  Synthetic
SEIERVKKALRKLLEDSRKSSEDLARELKRLLEESRKSTEKVERDLTDLLREIEEKL

SEQ ID NO: 22986 - protein, 56 aa, Artificial Sequence
  Synthetic
LDTILERVERSSREHHKLNERLLETLRRSSEEHHKRNEELVRRVERLLEEVERRRK

SEQ ID NO: 22987 - protein, 57 aa, Artificial Sequence
  Synthetic
SKIERVKEEIRRLLDTLKKSSETVIREIEKILKESRESSKKVEDDLRRLVREVEKKV

SEQ ID NO: 22988 - protein, 56 aa, Artificial Sequence
  Synthetic
VDKVLRDLEDLVRRHHERNKELLDRVRKSSEEHNRTNEELLKEVERLARKVIKDTT

SEQ ID NO: 22989 - protein, 57 aa, Artificial Sequence
  Synthetic
DEIEEVKRRARELLREATESSKEVAKALDELLERDRDSSRRVKEDLKRLLEEVRRKL

SEQ ID NO: 22990 - protein, 56 aa, Artificial Sequence
  Synthetic
LEKVLRDVEKLMREHHELNRELLKRVEDSSRTSHELNKRLVDTVRKLVTDAAEKAK

SEQ ID NO: 22991 - protein, 57 aa, Artificial Sequence
  Synthetic
SEIEEVDERIKALLKRSTESSKRVEDEARRLMKEDKDSSKEVEDRLRDLLRKVREKL

SEQ ID NO: 22992 - protein, 56 aa, Artificial Sequence
  Synthetic
LKKVLDDLKRSSEEHHRLNEELLKRAEDSSRTSHRLNRKLVEEVRRLVEKVLEEVR

SEQ ID NO: 22993 - protein, 57 aa, Artificial Sequence
  Synthetic
DEIEEVKKTLKKLVEELEESTRRVEEELKKLLKESEDSTRRVEDELRRLLEEVERKL

SEQ ID NO: 22994 - protein, 56 aa, Artificial Sequence
  Synthetic
LDEVLKDVERLVKEHEDLNKELLKKVEKSSRDHHELNKELVRRVEELVREAIKKTT

SEQ ID NO: 22995 - protein, 57 aa, Artificial Sequence
  Synthetic
DEVEKVKEEIRRLLKRLEDSTRDVERRLEELLRESTESSKEVEERLKRLLDEVRKKL

SEQ ID NO: 22996 - protein, 56 aa, Artificial Sequence
  Synthetic
VKKVLEELRELVRKHEELNRKLLEEVRESSERHKKLNKELVDEVKRLAEKITEEAR

SEQ ID NO: 22997 - protein, 57 aa, Artificial Sequence
  Synthetic
KEIEDVKRALEKLLEDDKRSTEELKDRLARLLEDSKRSSDKVIEDLDRLLKEVRDKL

SEQ ID NO: 22998 - protein, 56 aa, Artificial Sequence
  Synthetic
LDEILKRVEDSSRESHKKNEELLRRVRRSSEEHKRLNEELLREVEELVKEIVKEAK

SEQ ID NO: 22999 - protein, 57 aa, Artificial Sequence
  Synthetic
SKIEEVKKALRRLLEDLKRSTDRVKEEAKKLLDESRKSSEEVKRELERLLEEVTRKL

SEQ ID NO: 23000 - protein, 56 aa, Artificial Sequence
  Synthetic
ADKMLRDIERLVEEHKRLNEKLLREVRESSKRHNEKNEELVKTVKKLVEDAEERAK

SEQ ID NO: 23001 - protein, 57 aa, Artificial Sequence
  Synthetic
SEIETVKKELERLLDESRRSTETVEREVEDILRKSTESSEEVKDRLDKLLKEVRDKL

SEQ ID NO: 23002 - protein, 56 aa, Artificial Sequence
  Synthetic
LREVLERVRKSSEDHKELNKELLERLRRSSKEHNDKNKRLVDEVRRLVEEVIRRAT

SEQ ID NO: 23003 - protein, 57 aa, Artificial Sequence
  Synthetic
REIEEVKERLKKLLKDVTDSTDKVRKDLEKLLEDDRRSSRKVEEDLRRLLKDVRDKL

SEQ ID NO: 23004 - protein, 56 aa, Artificial Sequence
  Synthetic
LEKVLREAEKLAREHERTNEKLLKDVEKSSRDSHKRNKEIVDRVKKLAEDIIRKTK

SEQ ID NO: 23005 - protein, 57 aa, Artificial Sequence
  Synthetic
SEIERVKKRLEELLREVEESTRRLEERLKRLLEEAKRSSEEVEKELRRLLEEVRRRL

SEQ ID NO: 23006 - protein, 56 aa, Artificial Sequence
  Synthetic
LDDVLRRVEELAKRAHDENERLIREVEELVRRHNKRNKELVDEVKRLVEKVIEEER

SEQ ID NO: 23007 - protein, 57 aa, Artificial Sequence
  Synthetic
DEIERVKEELERLAKEDKDSTDTVKRELERLLEESKRSSDKLREDVERLLREVRERL

SEQ ID NO: 23008 - protein, 56 aa, Artificial Sequence
  Synthetic
LKRILEEVKRSSEESHKLNEELLDEVRKSSEEHNKLNEKLLRDVERLVRKVLTETK

SEQ ID NO: 23009 - protein, 60 aa, Artificial Sequence
  Synthetic
DELDKLLRDAEEVVRRVKEENKRLVKRDEEVVRRIHELNRKLLEDIRKVVEDVKEEIKEG

SEQ ID NO: 23010 - protein, 62 aa, Artificial Sequence
  Synthetic
EDAKRKVKRVKDELKRLVEEVEEVSRRSEERSRKTLEDVRDSSRRLEEELRKLVKEVEEAVR

SEQ ID NO: 23011 - protein, 60 aa, Artificial Sequence
  Synthetic
DELEKLLEDIRDVVRRIKETLEKLVKEDRDVVEKVKEDNKRLLKEMEDVVRKVKEEIRSG

SEQ ID NO: 23012 - protein, 62 aa, Artificial Sequence
  Synthetic
ERLERRAEEMEERLRRLVEEVREVVERVKEESDRTVEEVRRSSDRVEKEVERLVREVEDKVR

SEQ ID NO: 23013 - protein, 60 aa, Artificial Sequence
  Synthetic
EELERLMRRSEESLKRSEDTVRELIREAREILKRIKEELKRLLEEAERILEEVKKTVRDL

SEQ ID NO: 23014 - protein, 55 aa, Artificial Sequence
  Synthetic
KDLIKTARDTLRESERVSKELEERLKKIVEEVERLVEEVKKELERIVKDAERDVK

SEQ ID NO: 23015 - protein, 60 aa, Artificial Sequence
  Synthetic
DELRKLARDAEEILKRSEEEVRKLKKRSDDSLRRSREEVKKLEDEIREIVDRIKKRVEER

SEQ ID NO: 23016 - protein, 55 aa, Artificial Sequence
  Synthetic
EELKRTLEEIVERSKRVSDRLRERLKRTLDDSRRISDDLRRRLKKLVDDIRREVK

SEQ ID NO: 23017 - protein, 61 aa, Artificial Sequence
  Synthetic
KEIEDVKEELKKVLEEDRDSLRKVEKEHRRLAEEVKRKVRELEESLKRIVEEVERIAREAK

SEQ ID NO: 23018 - protein, 56 aa, Artificial Sequence
  Synthetic
LETVIREVRRILEESKRLNDKSREEVRKLVEELKDIVRRIEETVRRLLEEAKERLR

SEQ ID NO: 23019 - protein, 60 aa, Artificial Sequence
  Synthetic
DSVDRLRRRVDEVLKTVEDALRRNKKDAEDLLRRIEEVLERLERRSEKLLKEIDEVLKRV

SEQ ID NO: 23020 - protein, 59 aa, Artificial Sequence
  Synthetic
DEILTRAVEEIDELLRKLKRELDESTKESRKRVEELEKRLRDNTKRVKKDVDDLKRRVS

SEQ ID NO: 23021 - protein, 57 aa, Artificial Sequence
  Synthetic
SSIERLEEESRKNIKELEDSVKELKEEVDRLVEELERSVRELAKIVEDVVRELKKRA

SEQ ID NO: 23022 - protein, 59 aa, Artificial Sequence
  Synthetic
DEEVKRVLEESHRLVREVHERNKRVAERVRDLVRRVHEENERVAEEIRDLVRRVEEEVR

SEQ ID NO: 23023 - protein, 60 aa, Artificial Sequence
  Synthetic
SEIEDVVKKLRDLSERNVRDIDRLVKEIDELLKRDKEEIKRVVDDIKRRVREIKKIIEED

SEQ ID NO: 23024 - protein, 59 aa, Artificial Sequence
  Synthetic
KEMLDRLRKVVDELVKENKKAVEDLKKRVEDVIRESKRVVEEARRVVDELKKELRDELK

SEQ ID NO: 23025 - protein, 60 aa, Artificial Sequence
  Synthetic
SEIEKLVEEAKRLVKEAEDRLRKLSKESEESVRRVVKTLKDLVRELERLVEEVRKIIERN

SEQ ID NO: 23026 - protein, 62 aa, Artificial Sequence
  Synthetic
DEMRKRVKELEEAVKELTKEIKEVVDRHRETVERSSRKVKTVLDDLRRVVEEILRRVEDAAR

SEQ ID NO: 23027 - protein, 60 aa, Artificial Sequence
  Synthetic
KKIEDLVEEIKRLSDENRRRVERLSEDSKRSLEENKKKLKELVERIKKLLEEVSDKIRKD

SEQ ID NO: 23028 - protein, 62 aa, Artificial Sequence
  Synthetic
EEAEERLRRAEDTVRRLVERNREVLEEHERTLRRSSEESKRALKEVERVVREVLKRVDEELQ

SEQ ID NO: 23029 - protein, 60 aa, Artificial Sequence
  Synthetic
DELEKLVRDLEKRVKEVKDELKRSSEESERSLDEVRKTLKKLVEEMRELLKEVKRIIERN

SEQ ID NO: 23030 - protein, 62 aa, Artificial Sequence
  Synthetic
EEARERLERLRKRVEELLREVEKALEDDEKTVRESSKRIKKVLKELEDTARELVKEVRETAR

SEQ ID NO: 23031 - protein, 60 aa, Artificial Sequence
  Synthetic
SELEKLVRDLERLSEDNKRRLKESSKESKESLDRVRETIKRLVEEAEELLKRVVDTIRRT

SEQ ID NO: 23032 - protein, 62 aa, Artificial Sequence
  Synthetic
EEARERLERLREKVEELARDNERALREDERTVRESSERLRKVLEEAKDRIDKLVKAVEDAAR

SEQ ID NO: 23033 - protein, 60 aa, Artificial Sequence
  Synthetic
SELEKLVEEAKRLSDKNEEDLRRSSRESRESLKENKERIERAVKRLADLVRDVKEKIKRT

SEQ ID NO: 23034 - protein, 62 aa, Artificial Sequence
  Synthetic
EEMKERLERLRDTLKKLKERNKEVLREDRETVTDSSRRSEEVVREAEERVERLLREVEEAAR

SEQ ID NO: 23035 - protein, 60 aa, Artificial Sequence
  Synthetic
DELEKLVRELEELVKRVKEELERSSKESEDSLRDVKKKIEDLERKLDKLLKEVTDEIRRN

SEQ ID NO: 23036 - protein, 62 aa, Artificial Sequence
  Synthetic
DEMRKRLEDLERKVRDLARRVEKALEEDERTVRESSKRIRELLKRLEDKVRKIEKDVDDARR

SEQ ID NO: 23037 - protein, 60 aa, Artificial Sequence
  Synthetic
SELERLVREVRELSDDNRRKLERSSRESERSAKEVERTLEKLVKELRELVERVKRDIERV

SEQ ID NO: 23038 - protein, 62 aa, Artificial Sequence
  Synthetic
EEMKERLKELEKEADDLRRENEELLDRDRRTVEESSKRVEKALRDLEREVRRILREVEETMR

SEQ ID NO: 23039 - protein, 60 aa, Artificial Sequence
  Synthetic
SKLERLVEELKRLSDENVKDLERSSRESEESLKRNKEEIERVVERLRELLEKVVRDIKDD

SEQ ID NO: 23040 - protein, 62 aa, Artificial Sequence
  Synthetic
EEAKERLDRLREAVEKLREDNKRALDRDRETVERSSKKSEDAVRRAEEDVRRLTETVRRAKK

SEQ ID NO: 23041 - protein, 60 aa, Artificial Sequence
  Synthetic
SEIEDLVRKLRELLRDVKKKLKESSKRSEDSLRRVKEEIDKLVEELKKLLDEVKKEIERT

SEQ ID NO: 23042 - protein, 62 aa, Artificial Sequence
  Synthetic
EEAEKKMRELEEEVKKLLEEVDRALKDDERTLRKSSKDIKKVLDDLRRTVKKLKEDVEETMR

SEQ ID NO: 23043 - protein, 60 aa, Artificial Sequence
  Synthetic
DEIERLVEELRKLSERNKRELDRSSEESRESLKRVKEELKKIVEELRRLLEEVKDRIRKD

SEQ ID NO: 23044 - protein, 62 aa, Artificial Sequence
  Synthetic
EEARERAKRLEKEVRDLAKENEKALEEDERTVRRSSEEIADLLRKVEKVVRELLEEVRRAAK

SEQ ID NO: 23045 - protein, 60 aa, Artificial Sequence
  Synthetic
SSLEDLVRRARELSDRNREKLKRSSDESRESLKRNEEEIRRLVEELRELLERVRDLIRKL

SEQ ID NO: 23046 - protein, 62 aa, Artificial Sequence
  Synthetic
EDAKRDLDRLRREVERLIRDNERLAEEDARTVEKSSRDSKKLVEDLEREVEKLRREVERDRK

SEQ ID NO: 23047 - protein, 60 aa, Artificial Sequence
  Synthetic
SSIEDLVRRLRELSKRNTEELKRSSEESEDSVREVEDRVRELVKRLRELLKRVEDLIRKI

SEQ ID NO: 23048 - protein, 62 aa, Artificial Sequence
  Synthetic
EEMEKRAKELEEEVRDLTRRNEDALRRDRDTVKRSTERVDKVLKDLEREVRDIKRRVDEATK

SEQ ID NO: 23049 - protein, 60 aa, Artificial Sequence
  Synthetic
RELDELVKELRKLVEEVKDELRKSSKTSKELVEEIKERLERLVRELKRLVDEVRKTIRRL

SEQ ID NO: 23050 - protein, 62 aa, Artificial Sequence
  Synthetic
EDARRKLEELKETVRELLREVEKALDEDRETVKRSSEEVEEMLKDLRRRVTELDERVEREAT

SEQ ID NO: 23051 - protein, 60 aa, Artificial Sequence
  Synthetic
DEIEKLVEDAERLSRENEKRVRKSSEESKKLVKEALDELKKLVEELEKTVRDVDREIERN

SEQ ID NO: 23052 - protein, 62 aa, Artificial Sequence
  Synthetic
EEAKKRMEDMERRVRELEKRNKKVLDEDRETVRKSSKDLEDAVRELEERVRRLAKKVKESAD

SEQ ID NO: 23053 - protein, 60 aa, Artificial Sequence
  Synthetic
RELEELVKRLRELSRENEERLRRSSDESRKLLERNKERVKKVVDDLRRLVEEVKKEIERD

SEQ ID NO: 23054 - protein, 62 aa, Artificial Sequence
  Synthetic
DDARRRLKELEEEVKRLAKRNEDLLREDERTVRESSRRSEDVVRRAEEMVRRLLEEVERARK

SEQ ID NO: 23055 - protein, 60 aa, Artificial Sequence
  Synthetic
SELEKLVDELRKLSDENRRRLEKSSRDIEKLLKEIRDRIEELKKEIEDLLKEVKERIERL

SEQ ID NO: 23056 - protein, 62 aa, Artificial Sequence
  Synthetic
EEAEELLRRLEKRVEELARENEEMLKRDEDTVEEVRKRVTDVLRELKRVVEEVRRKVEEEAK

SEQ ID NO: 23057 - protein, 60 aa, Artificial Sequence
  Synthetic
SKLEKLVKDAEELSRRNEEELRRSSDESRKLLEKNKRRVERLVEELRKLVKKVRDDIRRE

SEQ ID NO: 23058 - protein, 62 aa, Artificial Sequence
  Synthetic
REAEELLRRLEEMLRRLTKKNRELLRRDEETVRRSSKRSEEVVRRAEEEVERLVKDVEDTRT

SEQ ID NO: 23059 - protein, 57 aa, Artificial Sequence
  Synthetic
KDEERAKKVVEEIKKRVTEIVRRHHKTNEDLVRRVRESSEKHHRRNEELKERVTRKI

SEQ ID NO: 23060 - protein, 56 aa, Artificial Sequence
  Synthetic
IETLVRELEELLKRLEDEVRRLTKRSKEVIDRIHKLNEDLTRESERVLKEVEDRDR

SEQ ID NO: 23061 - protein, 57 aa, Artificial Sequence
  Synthetic
RETEEVKKELDKLVEEAERAVREHHKENDRLVKRLEEVIRRHEKSVRELVEKVRREV

SEQ ID NO: 23062 - protein, 56 aa, Artificial Sequence
  Synthetic
LEKIVRRARELVERLKERLKELTRRSEELVKDLERKIERLSRELARIVKEVLDRDK

SEQ ID NO: 23063 - protein, 57 aa, Artificial Sequence
  Synthetic
SREEEAKKRLEELLREVEKVVRDHHRENEKIREEVERVVEKHKKRNRELVEAVRKRI

SEQ ID NO: 23064 - protein, 56 aa, Artificial Sequence
  Synthetic
VREAVERLKEIVERVRRKVEKLTEDSRRVLEELKRRIEKLTRDSERVLKEIEDRTR

SEQ ID NO: 23065 - protein, 57 aa, Artificial Sequence
  Synthetic
SDKEEVKKEIKKLKEDIKRAVDEHRKVNKRILEEAEKSSREHEKENRDIVRRVREEV

SEQ ID NO: 23066 - protein, 56 aa, Artificial Sequence
  Synthetic
IKEVVKELKKILEKLKRELEDLSRKSEDVLRRLHELNKRLTDDSRRVLDEVREDTK

SEQ ID NO: 23067 - protein, 59 aa, Artificial Sequence
  Synthetic
SEVDRLLKELEDVLKKVEDDIRRHIKRNEDILRESKKLADKLITEIEDMLRKVEEMIRN

SEQ ID NO: 23068 - protein, 59 aa, Artificial Sequence
  Synthetic
EEAVKRLEDTARRVEEEVRRLIRELEDTSRRVLEESRKISKELDERLRRVIEEVEKAAK

SEQ ID NO: 23069 - protein, 59 aa, Artificial Sequence
  Synthetic
SELEKLIKEIRDILKESEDAIKENLDRNEEALKRVAEEIKRLIDELRKMLEDVKRMIRD

SEQ ID NO: 23070 - protein, 59 aa, Artificial Sequence
  Synthetic
RRAVERVREELEKVIRDSRKLSRDLEEASRRVEEDVRRLIEELERRLKEVIKAVEDAAR

SEQ ID NO: 23071 - protein, 59 aa, Artificial Sequence
  Synthetic
DEVEKLAEELREILKRSEEMIRENLKRNRDLLRRSKEEVDKLKDELEEMLRRVRRVIED

SEQ ID NO: 23072 - protein, 59 aa, Artificial Sequence
  Synthetic
RELVKDLERKAREVIRTSEELSRRLAKTSEEVLEESERVVEELERRAERVEEEITKAAK

SEQ ID NO: 23073 - protein, 59 aa, Artificial Sequence
  Synthetic
SEVEDLLRKLEEILRRSKENVERNVRENREMLKKVEKTIRDLIRRAEKLLREVEEAIRN

SEQ ID NO: 23074 - protein, 59 aa, Artificial Sequence
  Synthetic
EDAVRRLEKELERVIKTSRDISERLERESRRVEEEVRKLIEELSRRLEEVRERVKEATR

SEQ ID NO: 23075 - protein, 59 aa, Artificial Sequence
  Synthetic
REVEEALKDLERILKESEDNVRRNIKKNEDLLRRVEERIRELLDEARRLLERVKEVKKD

SEQ ID NO: 23076 - protein, 59 aa, Artificial Sequence
  Synthetic
KDLVERLKEELERVTRDSRRVVDELRKRSEKVREDVRRLIEDLRRRLEKVIRDVEEDAR

SEQ ID NO: 23077 - protein, 59 aa, Artificial Sequence
  Synthetic
DETERIIRDLERVLEEIARLAKKNIDDSRRVLKELAEKLKRDSERAKKLLEDVEEIIRR

SEQ ID NO: 23078 - protein, 55 aa, Artificial Sequence
  Synthetic
EDVDRVVRKVLEDLRRLLEEVKKVNDDSEKEVRRLLEENERKNRRVEEEVKKLLK

SEQ ID NO: 23079 - protein, 60 aa, Artificial Sequence
  Synthetic
SELEDIIRRIEEVLKRNEELNRKNIKESRDLLEEIRRKAKEDSDRVKEVLRRLEDEVRRN

SEQ ID NO: 23080 - protein, 55 aa, Artificial Sequence
  Synthetic
EEVKRKVDKVVEDIKRVSEESTRANDESRRALEKVVKENEDTNREVVKRVRDAEK

SEQ ID NO: 23081 - protein, 59 aa, Artificial Sequence
  Synthetic
SELEEIIDRIRTVLERNRELNERNIRESKRLLDEIKKRVEDDNERSKDIVRRVETEVRE

SEQ ID NO: 23082 - protein, 55 aa, Artificial Sequence
  Synthetic
ERVDEVVEKVLDEMRKVSRTSEESNRKSEEEVRKVLKENNDMNRESVERLRRTEE

SEQ ID NO: 23083 - protein, 60 aa, Artificial Sequence
  Synthetic
DEVRRVIEELERLLEENRRHSKEDNERSKKINKENHDHSKESTDRAEKLLREVEKLIRET

SEQ ID NO: 23084 - protein, 58 aa, Artificial Sequence
  Synthetic
DRVRDVDRTVKRVVKESRRSTRENEKTNTDVVRSTDESLKEDKKEVDRVIEELDRAVR

SEQ ID NO: 23085 - protein, 60 aa, Artificial Sequence
  Synthetic
SEAEKVIEDAKRLLKENEDHSKEDNDRVRELLEEVKRHSEESTRRAEKILEEIRELVEKV

SEQ ID NO: 23086 - protein, 58 aa, Artificial Sequence
  Synthetic
EEVKRVEDEVRKLVKASRESTERNERTNREVAERLKKSLEEDRERVRKVVEDLRRAEK

SEQ ID NO: 23087 - protein, 57 aa, Artificial Sequence
  Synthetic
DELRKVLKESEDSLERLRRTLEESIKRSRDSLRENTELVKDSLRRSEESLERVEKSN

SEQ ID NO: 23088 - protein, 59 aa, Artificial Sequence
  Synthetic
KEMLKRLEDEIRRSIEELRKALRRVEEEHRKVIEASKDLVRRLEEAHKEVIDRLKEKLR

SEQ ID NO: 23089 - protein, 55 aa, Artificial Sequence
  Synthetic
DEIERVIEESRKSLDDLRRKAEESIRRSEESLREVEERLKRSIREAEESLKKVEN

SEQ ID NO: 23090 - protein, 59 aa, Artificial Sequence
  Synthetic
DEVVRELKKMIDKSERDLEELLDRVRRKHERVIEELKKLLKRVKDAHERVIRELEKTRK

SEQ ID NO: 23091 - protein, 59 aa, Artificial Sequence
  Synthetic
SEVEDLIRRVRKSNKESEDVLRESIERSEESNERSERTARRIIEEAERILEEMEESLKK

SEQ ID NO: 23092 - protein, 59 aa, Artificial Sequence
  Synthetic
EEVVRRLEEEVKRVAEHTRKLLKDVRKKHEESIRHSEEVLDRLEKKLREIMKRVTERTK

SEQ ID NO: 23093 - protein, 59 aa, Artificial Sequence
  Synthetic
KEVEDIIEDVKRSLEESKRMADKSITDSRRSNEESKRIVEEIKRKIDEILERIERKARK

SEQ ID NO: 23094 - protein, 59 aa, Artificial Sequence
  Synthetic
EKVVRELEKRVKEVVKTTEDVLREVERTHRESIKHSEDLVRRLEERLRRVAKEVERTRK

SEQ ID NO: 23095 - protein, 59 aa, Artificial Sequence
  Synthetic
SEVEKAIKEARDSLRESKRLLEESIKRSEDSLEESRRVVEEIKKRLEELLREVKESVDQ

SEQ ID NO: 23096 - protein, 59 aa, Artificial Sequence
  Synthetic
EKKVRDLERMVKRVMEETEKALEDVERRHEKSIRDTRRVLKELEDTVRKVLKEVDRERQ

SEQ ID NO: 23097 - protein, 59 aa, Artificial Sequence
  Synthetic
SKLEKVITEVRDSLRRSRKMAEDSIRRSEELLKELEDLLKKVRDTLRKILKDIEDLARK

SEQ ID NO: 23098 - protein, 59 aa, Artificial Sequence
  Synthetic
KELVDDVRREVEKVVEDTRRVLEEVERTHKESIDRLRKLVERVRREIEEIARRVKETRD

SEQ ID NO: 23099 - protein, 60 aa, Artificial Sequence
  Synthetic
SVVEKLKDEADKLVKRNEDLARRLEEVSKDTIDRLEDVLRKLREVLKRLRRRLEEVLKRV

SEQ ID NO: 23100 - protein, 59 aa, Artificial Sequence
  Synthetic
REKFEEVIKRLRDSSKRSEDKIRKVLKDSRDLLEDVRRKIEDVIRRMEKLIKEVEDRVR

SEQ ID NO: 23101 - protein, 60 aa, Artificial Sequence
  Synthetic
SVVEELERVMRELKKRNEELSRENHESVKEAEKRNKRLSEELEKVSRDVIKDLERVVEEV

SEQ ID NO: 23102 - protein, 59 aa, Artificial Sequence
  Synthetic
EREIRRIIEELKRLSDENEERIRRISEEIKDLSRRNEETVRRVIEENRKLLEDATRRTK

SEQ ID NO: 23103 - protein, 60 aa, Artificial Sequence
  Synthetic
SLREKLKEVIRRLEEENRRVSEENHRSVREVEEENRKVSDELRKVAEELKRRLEEVVRRV

SEQ ID NO: 23104 - protein, 59 aa, Artificial Sequence
  Synthetic
SREIEDIIRRVKKLSKENKETIERISREIRELSKRNEEEVRRVIRRLEELLEELERTAK

SEQ ID NO: 23105 - protein, 60 aa, Artificial Sequence
  Synthetic
RVIEKAEEVVDRLKKRNKEVLKENHDSVREVEKENRELLEKAEKVVRELEERLKEVVEEV

SEQ ID NO: 23106 - protein, 59 aa, Artificial Sequence
  Synthetic
EREIERIIKEAEELSKRNEEVIDEISKRIKELSERNRERVEKVIEEAKELVKRVTDKVK

SEQ ID NO: 23107 - protein, 60 aa, Artificial Sequence
  Synthetic
KDEEKAEDVVRRLTEEVRRVHEKTRDVVRRVTERSNDVSRRSKEEVRELLERADDLARKG

SEQ ID NO: 23108 - protein, 56 aa, Artificial Sequence
  Synthetic
VEDLIRELKRLVDELRERSEDLIRKAERVLERLEEESRRLLKELRDLLEDVTRKAE

SEQ ID NO: 23109 - protein, 60 aa, Artificial Sequence
  Synthetic
SETEKAREVVRELEKRNDEVHKETRDVVRRLEETSDEVSKDSERKVDRLREEVKKVRDDG

SEQ ID NO: 23110 - protein, 56 aa, Artificial Sequence
  Synthetic
VEELIRRMEKLTEDNERRSRKLIEELKRLLEDLREKSERLIRELERLVKELRDRAE

SEQ ID NO: 23111 - protein, 60 aa, Artificial Sequence
  Synthetic
SEKEKAREVVKKLKKRVDEAHKKTKDVVEELRKRNRDVHRTTREVVRDLLKKVKDVERRG

SEQ ID NO: 23112 - protein, 56 aa, Artificial Sequence
  Synthetic
VETLIERLRELIDELRRRSEKLIKELREVTKRNKERSDRLIKELEDLVKKLKDDAT

SEQ ID NO: 23113 - protein, 59 aa, Artificial Sequence
  Synthetic
DEVEKLIEDLKRIVERDEREIRELIKELDDHVRKDEKIARDLERRLKEILDEVRKMVTD

SEQ ID NO: 23114 - protein, 59 aa, Artificial Sequence
  Synthetic
KELLEKVKRVLEEVRRRSRETLERLREVLERSIRDSERTLEKVREMLERVRKEIEKLRK

SEQ ID NO: 23115 - protein, 59 aa, Artificial Sequence
  Synthetic
SEVEELDKRLRDHVRRDEEIVERLIRELKRHVERDREEARRLIEELRRLLEEVKRMMED

SEQ ID NO: 23116 - protein, 59 aa, Artificial Sequence
  Synthetic
RKLVRDVEKSLEESIRRSEETLKTVKDVLDKSKEDSKRTVEDVERVLREAEKEAKRATD

SEQ ID NO: 23117 - protein, 59 aa, Artificial Sequence
  Synthetic
SEAEKLIKELEDHVKRVEDRARELIDELRKHVEEDERRARKLIEELRRLLKEVKRMVDD

SEQ ID NO: 23118 - protein, 59 aa, Artificial Sequence
  Synthetic
EDLVRRVRKVLRRSEEDVRRLIEEVERVLKRSEEESRRTIREVEEVLKEVERAVEELAR

SEQ ID NO: 23119 - protein, 60 aa, Artificial Sequence
  Synthetic
SLEDRVREVVERSERDLRRSTDEIRRVVEEAEKALRRLVREVEEVVREVKERLERVVREG

SEQ ID NO: 23120 - protein, 59 aa, Artificial Sequence
  Synthetic
EDTVRKVIEDSDRSLEENKRLVKKVIDEIKERLKEMKKRAEEIIERLKKLLEEVEERAR

SEQ ID NO: 23121 - protein, 60 aa, Artificial Sequence
  Synthetic
DLTKRVEEVVRRSRERLERSTRDIKRKAEEVKERLKKSSKEVEKVIREVETELERLRREG

SEQ ID NO: 23122 - protein, 59 aa, Artificial Sequence
  Synthetic
EKKVEEVLRRSEKSVRDNKKRVEEVAETLKKILTDNRRLVKRVKEELDKLIRDVEERAR

SEQ ID NO: 23123 - protein, 57 aa, Artificial Sequence
  Synthetic
SEKEDVERVVERVKREADELLKENHKSVKDVDERVKETVERNHRSVRKAEEDVKRVE

SEQ ID NO: 23124 - protein, 56 aa, Artificial Sequence
  Synthetic
VREVAKELEDIVRRIKELVERSNRELKKIVEDNERVVEESDRRIKEILERITEASR

SEQ ID NO: 23125 - protein, 57 aa, Artificial Sequence
  Synthetic
SEKETVEEVVDKVRRDLDKSLEDNHKSVEEVRRRVEKTLRENHESVERARKRARDLE

SEQ ID NO: 23126 - protein, 56 aa, Artificial Sequence
  Synthetic
VREVVERAKRILEDNKKKIDESNERLERIVRENKEMVERSDRRIEEIVERIERETR

SEQ ID NO: 23127 - protein, 57 aa, Artificial Sequence
  Synthetic
DEKEEVEKRAEEVRKKVDKLLKENHESVEDARRRVDKTLRENHESVEEVKRRVDEVR

SEQ ID NO: 23128 - protein, 56 aa, Artificial Sequence
  Synthetic
AEDVMEELDRLVEDLRRKVEDSNRKIKRIVDENKREVEKSNRKLRELLKELEDRAR

SEQ ID NO: 23129 - protein, 57 aa, Artificial Sequence
  Synthetic
SKKEDAERVVREVTREVRRLLKENHDSVREVLKRVDETVERNSRSVKEVLRKVREVE

SEQ ID NO: 23130 - protein, 56 aa, Artificial Sequence
  Synthetic
LKEVVDRARDLIRDLTRKVKESNERLEEIVERNEREVRKSDEDLKRLADDLERKAT

SEQ ID NO: 23131 - protein, 57 aa, Artificial Sequence
  Synthetic
REKEEVERVVEDVRRRLDESLERNHKSVRDALREVDRTVEENSRSVEKVRKRLKEVE

SEQ ID NO: 23132 - protein, 56 aa, Artificial Sequence
  Synthetic
VREVKKELEKIVRDNERVVEDSNDKIRRIVTKNTEDVKRSDETLERIVEEIERRAR

SEQ ID NO: 23133 - protein, 57 aa, Artificial Sequence
  Synthetic
KEKEDVERKVEDVKRDVDRVLEENHRSLKEAEERSNKLSDTSRRVAKRVVDDVRRLK

SEQ ID NO: 23134 - protein, 56 aa, Artificial Sequence
  Synthetic
VKEVVDRLEKIVRDIRKEIERSNRDVERLVRTLEEVSKRIIDTLERIIDKIREDTK

SEQ ID NO: 23135 - protein, 59 aa, Artificial Sequence
  Synthetic
SEAEELIEELERIAEEDRKLVEDSIRKLRKILDEDRKIMKRLAEELDRILEDVKRKVDK

SEQ ID NO: 23136 - protein, 55 aa, Artificial Sequence
  Synthetic
KELEEVVRKVKRESDRTLEKSKKVVDEVRRRSEETLEKLRRVVERVRKRVDEASK

SEQ ID NO: 23137 - protein, 60 aa, Artificial Sequence
  Synthetic
DRADELRERLKEIMERDRRIMKELEDELRELVERDERIIRELERRLEEIVKDVERKAKSG

SEQ ID NO: 23138 - protein, 55 aa, Artificial Sequence
  Synthetic
DELRRVVEEVEKDSERTLKELRRVVKEVEERVEKTLRDLEEVLERVKERVKRLKD

SEQ ID NO: 23139 - protein, 59 aa, Artificial Sequence
  Synthetic
KEAEDLMREVEELVRRDEEIIKRLADELEEIVDDNRRKVEDLVRRLEEILRRVEESMRK

SEQ ID NO: 23140 - protein, 55 aa, Artificial Sequence
  Synthetic
KELREVIERARKRVEETLRELERKLEEVRKTSEDLLRRLEEVVKRVKEEVEKLEK

SEQ ID NO: 23141 - protein, 59 aa, Artificial Sequence
  Synthetic
SEMDELRKELEDLARDDKRRVEESIRRLEKIAEDNERLARESIKRLRRLVTELEKLARK

SEQ ID NO: 23142 - protein, 55 aa, Artificial Sequence
  Synthetic
KELKEVVDRVREIVKKTLEESREVVKKVREDSKRLLEESKRVVEEVKKRVEELKK

SEQ ID NO: 23143 - protein, 59 aa, Artificial Sequence
  Synthetic
DEVEEVKEELKRTSRDDERKVEEIRKRLEESTRRLRELAEELKDELRKSSRDLERLRRE

SEQ ID NO: 23144 - protein, 55 aa, Artificial Sequence
  Synthetic
REVERALERSLKRSDETVKEVEELLRRSLEDSKKLLEEVREALERSKKRSDELRR

SEQ ID NO: 23145 - protein, 59 aa, Artificial Sequence
  Synthetic
KEVEDVKEELRRSSKKLRELAERLKKLLEDILDEDRKLAEEIKKRLEDSSRKIEELKRR

SEQ ID NO: 23146 - protein, 55 aa, Artificial Sequence
  Synthetic
DEVERMLKESDKESKRLLEEVDRMLKEVIKASKKSLDDVDRVLRRSERESEKRRK

SEQ ID NO: 23147 - protein, 59 aa, Artificial Sequence
  Synthetic
SEVEKVKEELRESSRALRKLVEKIRRILRETSERDRDTVREIADRLRKSSRRVEELKRN

SEQ ID NO: 23148 - protein, 55 aa, Artificial Sequence
  Synthetic
DEVRRVLEESERRSKKLLDEVEELLRRSERTSRESLKEVKERLRKSLEESERRAR

SEQ ID NO: 23149 - protein, 60 aa, Artificial Sequence
  Synthetic
SLVERLKKVVEDAERELRRLTKETEDVLREAEETIKRLSERLKKANEDTERKIRRLAKEN

SEQ ID NO: 23150 - protein, 59 aa, Artificial Sequence
  Synthetic
EKKIDDAIKRIRDLIERVEEINKEVVDRIKELIERVEEINETVIRDSERLIKEVEDEVR

SEQ ID NO: 23151 - protein, 60 aa, Artificial Sequence
  Synthetic
SLEEDLRRVLEEVKRELKELSKRSKEVNRKTEETARRLSEKSEKVNRETKKRVEDLMREN

SEQ ID NO: 23152 - protein, 59 aa, Artificial Sequence
  Synthetic
EKAIRDAIRRLKELVERVKRTNEEVVKESEELIERVRERNDDAVRKSRRLIERLTEKVK

SEQ ID NO: 23153 - protein, 60 aa, Artificial Sequence
  Synthetic
SLKETLEEVLKEVKRRIEDLSRRLEEVLRRAREELKRLSDDSRRVVEEAEERVRRLMEEN

SEQ ID NO: 23154 - protein, 59 aa, Artificial Sequence
  Synthetic
KEEIKRVIDELRRLIEEVEKRNREVVEEIKRLIKEVADDNRRALERIRRLIRKLEEEVK

SEQ ID NO: 23155 - protein, 60 aa, Artificial Sequence
  Synthetic
SLTERLREVLKKVEDTLRKLSERLRDVLRKAEKTIEEISRRSEEANRETKERAERLMEEN

SEQ ID NO: 23156 - protein, 59 aa, Artificial Sequence
  Synthetic
KDRIEDVIRELDRLLEEVRRINEEVLRRIEELIKRVKEENDRVMETSRRLIETVKEEVK

SEQ ID NO: 23157 - protein, 60 aa, Artificial Sequence
  Synthetic
DKVRKILKEMRDLVRRNKEEIDRSIRKIEELIERNKREIDKSIEELKRLLDEVRKIVKDE

SEQ ID NO: 23158 - protein, 58 aa, Artificial Sequence
  Synthetic
EMVRDVARVVKEVHDDNRRLTEKSERVVREAHRRNEEIVKASEEAVREAKRRLEELRR

SEQ ID NO: 23159 - protein, 60 aa, Artificial Sequence
  Synthetic
DKVREILKRLEDLVRTNKERIDESIEELERLADENRRRIKKSIDDLRRLIEEVERIVKDR

SEQ ID NO: 23160 - protein, 58 aa, Artificial Sequence
  Synthetic
EVVRDVERVLEEVDRANRDLVRRSKEVVDKVHETNKKLVEESKEAVDRVTELLERARK

SEQ ID NO: 23161 - protein, 59 aa, Artificial Sequence
  Synthetic
DEVEELVKKLEKVLREIEEMSERLSDENRKVLEKIKEDSKRLNEELERVLRRIREASRD

SEQ ID NO: 23162 - protein, 59 aa, Artificial Sequence
  Synthetic
SELLERLREVLEDVKRKLDEIHRRNEESLERLEREVKRLNEDNRRSLKTVDDRLRETKR

SEQ ID NO: 23163 - protein, 60 aa, Artificial Sequence
  Synthetic
SEKEKLDAVLREVEEAAKKNIDKNRRSLEEVAEVVRELVKENRKSLEEVKEMIERIIREI

SEQ ID NO: 23164 - protein, 56 aa, Artificial Sequence
  Synthetic
VEKIVEDLKRVLEESHKLSEDVDRLIKRVVEEAKKLSRDVNEDVKRVVKEVKDEAD

SEQ ID NO: 23165 - protein, 60 aa, Artificial Sequence
  Synthetic
SEKEKLDDVLRKVKDTLAENIKNNKESLDRVREEIERNIRRNEESLDRARRTVEKIIEEI

SEQ ID NO: 23166 - protein, 56 aa, Artificial Sequence
  Synthetic
VEKLVEELRRLLKESHELSREVNDRLRRALEESHELSKEVNETLRKLLEDIRREAK

SEQ ID NO: 23167 - protein, 60 aa, Artificial Sequence
  Synthetic
KDEERLKKVIDEVRKRVEENIRTNEDSLRKAEETLKRNIRKNEKSLEDARREIEELIREI

SEQ ID NO: 23168 - protein, 56 aa, Artificial Sequence
  Synthetic
VEKLIKKLRDLLEESHRLSEEVNRTLKRALDESHERSKEVDKRIEEMVERVRRKVK

SEQ ID NO: 23169 - protein, 60 aa, Artificial Sequence
  Synthetic
SEREKLEKVLEEARREIERLAEENRRSLDRARKEVKRLIDNNRKSLDDVRKRVDKLVKDI

SEQ ID NO: 23170 - protein, 56 aa, Artificial Sequence
  Synthetic
VEKLVEELKKVLDDVRKESERVNRTLKKLLEDIERLSREVNKRIKEMVRKATEDVR

SEQ ID NO: 23171 - protein, 60 aa, Artificial Sequence
  Synthetic
SEKEELDKVLKEAEDKIEENIRDNERSLRDVERAVRRIIENNRESLEELDKAVKEIVRRI

SEQ ID NO: 23172 - protein, 57 aa, Artificial Sequence
  Synthetic
DVKTLVEELRRALEESHKLSEDVNRALKKVLEEIADLSRKVNDKLRELLKRLEEEAR

SEQ ID NO: 23173 - protein, 60 aa, Artificial Sequence
  Synthetic
SKEEKLDKKLKEAERTIRENIKENRESLERARKTLEENIRNNEDSLRRVEEEVRRIIEEI

SEQ ID NO: 23174 - protein, 56 aa, Artificial Sequence
  Synthetic
VDDILRRIEEILRRSHRLSKEVNKRIKELLDRSHELSKRVNDELDKVLKEIRREAK

SEQ ID NO: 23175 - protein, 60 aa, Artificial Sequence
  Synthetic
DEDEELKKVLDRAKKRVDELVRNNEESLERVKRAVDRLIEKNERSLERAEDELRKLVKEI

SEQ ID NO: 23176 - protein, 56 aa, Artificial Sequence
  Synthetic
VEKLKKELDDMLRKLEELSRRVNRTLEELLRRIEELSREVDERIKKVLKEIKDRVK

SEQ ID NO: 23177 - protein, 60 aa, Artificial Sequence
  Synthetic
SEKEELDDVLRRVEEKVRRNVRKNEDSLKKVEDEVRRNIRNNEKSLEDAERDVRKLAKDV

SEQ ID NO: 23178 - protein, 56 aa, Artificial Sequence
  Synthetic
VKKLLKELEDLARESHKLSRDVDRKLEDALRRSHRLSREVNRKIEEMVRKLREDTR

SEQ ID NO: 23179 - protein, 60 aa, Artificial Sequence
  Synthetic
KEEERVTDALRRVRETAKKNIEYNRRSVERVERTLKELVKNNTRSLERVRKAVKELVERI

SEQ ID NO: 23180 - protein, 56 aa, Artificial Sequence
  Synthetic
VDKLIERLERVLEKSHRDLRRNSKDNKRILDEIKKESEEVNRRLEEVLRKIKEDVE

SEQ ID NO: 23181 - protein, 61 aa, Artificial Sequence
  Synthetic
DKVRELEKTLRDLLRENHRISEDLNKKLKDMARRNKKHSEDVIEKIKRLLDRLREIVKRDG

SEQ ID NO: 23182 - protein, 59 aa, Artificial Sequence
  Synthetic
DELVRRVREVLREVEERLRDNIKDNRRSLDDHRRVIEETRRESKRAVERAEDEVKKLED

SEQ ID NO: 23183 - protein, 61 aa, Artificial Sequence
  Synthetic
SKVEDLIRRLKTLLDDLRRISREVDEKIKEILKEVERHSKEVIDRIKDILRRVEEIVRRKG

SEQ ID NO: 23184 - protein, 59 aa, Artificial Sequence
  Synthetic
KRLVERVEKVAREVEEAVRKLIEKNKESVERAEETARRLIERSKRAVDEARRKIEELRR

SEQ ID NO: 23185 - protein, 61 aa, Artificial Sequence
  Synthetic
SKVEELIERIERLLEEVRRISDKVDEDLERLIRENEKHSKKIIKELEKLLKELEDIVRREG

SEQ ID NO: 23186 - protein, 59 aa, Artificial Sequence
  Synthetic
KRLVERLRKVVEDAEREIRRLIEKNKRSLERHKRELERTIKESRDVLKKVEDRVRELAR

SEQ ID NO: 23187 - protein, 61 aa, Artificial Sequence
  Synthetic
SKVEDLERRIRKILREVEEISERVNRALKRLLDENRKHSEKIIRELEELLRRLEEEVRTKG

SEQ ID NO: 23188 - protein, 59 aa, Artificial Sequence
  Synthetic
KSLVDRVRKAVEEAEERIRRLIENNERSLRRHEEAIKKTIEESDKVLEDVRRRAEELLK

SEQ ID NO: 23189 - protein, 61 aa, Artificial Sequence
  Synthetic
SKVERLIERLKELLDENHKISERVNKELERLARENDKHSKDLIRDIERILREVEEIVRRDG

SEQ ID NO: 23190 - protein, 59 aa, Artificial Sequence
  Synthetic
RRLVEEVRRVLREVREAAKENIRNNRESLKRHKDALRKTIEDSARVVKRAEERIRELER

SEQ ID NO: 23191 - protein, 61 aa, Artificial Sequence
  Synthetic
SKVDELVERIERLLRELTKHSKEIIDRLKKLLEDNERINRDVIRRIEEILKEVKRIVERDG

SEQ ID NO: 23192 - protein, 59 aa, Artificial Sequence
  Synthetic
EELVRKVREVVDRARERVEELIRRTEDVLKKHREELKKLIEESRRVLEEAKKTADELKK

SEQ ID NO: 23193 - protein, 61 aa, Artificial Sequence
  Synthetic
DEVRKLKEDLRRLLKENKEKVEKVIRENEKLLRENKKMVEDAERDLRRLLKELEDLVRKRG

SEQ ID NO: 23194 - protein, 59 aa, Artificial Sequence
  Synthetic
KELVDEVRRVARRVKEENKRLLDEVRKVSEEVERTNRELVRRVEEVVREVRERIDELLR

SEQ ID NO: 23195 - protein, 61 aa, Artificial Sequence
  Synthetic
SEAEDLERRIEKLLEDNTRLVERVIEENEKLLRDNAEHSKEVEDRLRDLLRRLEEVVRKRG

SEQ ID NO: 23196 - protein, 59 aa, Artificial Sequence
  Synthetic
EELIKRVEEVVRKAKKTNEDLLREVEKVSREVKKANEDLLRRSKEVVDEVEKDIERLKR

SEQ ID NO: 23197 - protein, 61 aa, Artificial Sequence
  Synthetic
DDIERIIEKLKELLERNKRHTEEVIKELERLLRENERHSREVKKRLEELLKRLEDVVRREG

SEQ ID NO: 23198 - protein, 59 aa, Artificial Sequence
  Synthetic
EEVIRRIEEAVREVKEANKDLVRESRRVARRVEEENKRLVEESRRVVEKVEKRIRDLLR

SEQ ID NO: 23199 - protein, 61 aa, Artificial Sequence
  Synthetic
DEIDEARKELEEILRENREKVDEVRKRLEKLLRENEEVVKEIIRRLKELLKELERVMREEG

SEQ ID NO: 23200 - protein, 59 aa, Artificial Sequence
  Synthetic
EKLVREVRKDAERAERELRRSVEDIRRVVERVKRENERLLREVEKVVEEVKEELRKIET

SEQ ID NO: 23201 - protein, 61 aa, Artificial Sequence
  Synthetic
DEIERVIEELKKRLDENRRVLEEIIRRLEELAKRNKRHSEELEKRLREELDKVRKRLEETG

SEQ ID NO: 23202 - protein, 59 aa, Artificial Sequence
  Synthetic
RELIERMREVVEEVERALRKSLKDVEDVVREVEKKNKELLEKSKKVVEDVRRTLEKLRE

SEQ ID NO: 23203 - protein, 61 aa, Artificial Sequence
  Synthetic
SEVEEAIKTLKKLLDDNKRHTEEVIRRIEELLKRNEEHSRKVIEDLERLLRKLEKMVRDRG

SEQ ID NO: 23204 - protein, 59 aa, Artificial Sequence
  Synthetic
EEVVRRMEEAVRRAEETNKDLVRRSREVVRRANETNKKLLEDSKRVVERVEKRLEELLR

SEQ ID NO: 23205 - protein, 61 aa, Artificial Sequence
  Synthetic
SELEEIERELEELLRENKKLVDRVREELKKLLDELRKHSERVIREIERLLEELERVVRKRG

SEQ ID NO: 23206 - protein, 59 aa, Artificial Sequence
  Synthetic
EELIKRLTDVVRKVKEDNKRLVEEARRVVEEVKREIKRLLEESREVVRRAERRLEELRR

SEQ ID NO: 23207 - protein, 61 aa, Artificial Sequence
  Synthetic
SEIEDAERKLKKLLEDNTDMARRLIERLRKILEENKRHSERVKRELEEILKELEDLLRRKG

SEQ ID NO: 23208 - protein, 59 aa, Artificial Sequence
  Synthetic
EELVKRVEDVVRKVDEDNKRLVEEVRRVVEEVRKTLEDSLRESERVVREVKKRLEDLKR

SEQ ID NO: 23209 - protein, 60 aa, Artificial Sequence
  Synthetic
SEREKMEKVVREAKKDLDRSLKRVKEVAEEVKKELDRSLEEVKRVSEENKKEVDRIRKKG

SEQ ID NO: 23210 - protein, 56 aa, Artificial Sequence
  Synthetic
VDTLVRRLEKILEENRRIVKEIEDRLRKLLEDNKRVVDEIIKRNEDSVRDVERRAK

SEQ ID NO: 23211 - protein, 59 aa, Artificial Sequence
  Synthetic
SEREKVEEVVREAKERLDESVKRVEEVSRENKKEIDRLLEEVKKVIEEAKRRLEELRRR

SEQ ID NO: 23212 - protein, 56 aa, Artificial Sequence
  Synthetic
VDEVLKELRRILRDNERMVKEVIERNRKSVEDLERIARRIIEEIERLLKELTDRAR

SEQ ID NO: 23213 - protein, 60 aa, Artificial Sequence
  Synthetic
SEDEEVEEAADRHRRSVEDSSRDLKKVLDEDRRTVAESSRKLKEILREVEREVKRVEDDG

SEQ ID NO: 23214 - protein, 56 aa, Artificial Sequence
  Synthetic
VEELKKRLKELSDESRKSLERVKRKLEETSRRSEESLRRVKKDAERLVREIEKRAK

SEQ ID NO: 23215 - protein, 60 aa, Artificial Sequence
  Synthetic
SEDEKVKKVLDDVRRKAEDSSRRITEVLRRHEETVRRSSEKLKKLLDELREDADRVRRAG

SEQ ID NO: 23216 - protein, 56 aa, Artificial Sequence
  Synthetic
VKDLERKARDIVRKSEESLERVVRELERLSRDSERSLKKVKEDLERVVEEIRRRAD

SEQ ID NO: 23217 - protein, 59 aa, Artificial Sequence
  Synthetic
SEDEEVEKVLREDEESVKRSSDEIRKLLEDHERTVRESSDELKKALDEVRKRLDELKRR

SEQ ID NO: 23218 - protein, 56 aa, Artificial Sequence
  Synthetic
VEDLKREAERTSEESRRSLEEVRRRLEELSERSRESLKRVKDELKRVVEEIEERAR

SEQ ID NO: 23219 - protein, 60 aa, Artificial Sequence
  Synthetic
SEDEEVKRVLDELRKRLKESSDRLREVLKRDKRTLEKSSEDIDRALKKVERALTEVLKEG

SEQ ID NO: 23220 - protein, 56 aa, Artificial Sequence
  Synthetic
VKELLDTLRKLVEESEESLREVVERLDKTSEDSKESLRRVIETLDRLVKDIDEKAK

SEQ ID NO: 23221 - protein, 59 aa, Artificial Sequence
  Synthetic
SELEKLKKEIDDLSRDLDRILKELKKRVEELTRRSEKVLEDLRKTLEDIVKTLEDLARG

SEQ ID NO: 23222 - protein, 59 aa, Artificial Sequence
  Synthetic
SELVKRAADVVEKHRRSLERLLRTVTKIVKDHHERNEEIVDEVRKVVERAKERLEEIRK

SEQ ID NO: 23223 - protein, 59 aa, Artificial Sequence
  Synthetic
SEVDELRRRVKKLSDDSKRVLDELSRRLKELSERLAEIVKEVHRRNEELVDRLRRLKDK

SEQ ID NO: 23224 - protein, 59 aa, Artificial Sequence
  Synthetic
SELVEEVKRVVEKHHEDNKRIVEALAEMVKDHKRTIDELRRRLEESVKDAEKKLRDVSR

SEQ ID NO: 23225 - protein, 59 aa, Artificial Sequence
  Synthetic
SELEELERRLKELSDESRRVLRELLERLKELSKDLERILEDLKEKVKKIEKDLRELKKR

SEQ ID NO: 23226 - protein, 59 aa, Artificial Sequence
  Synthetic
SDLVREVARVVKEHHDENEDIVRRVKEAVDEHRETIERLRRAVERVVKEVERRLKEEAR

SEQ ID NO: 23227 - protein, 60 aa, Artificial Sequence
  Synthetic
SKDEELERVVKEVREVLDDVNREVTKVSDDVKKRLDELLEEVRRVSDEVRKRLDEVLRER

SEQ ID NO: 23228 - protein, 56 aa, Artificial Sequence
  Synthetic
VEEAKRRLEKLVRDIRRLTEEHKKRHEDLVREVEEIVKKLKDDHRRLVEDIERAIR

SEQ ID NO: 23229 - protein, 59 aa, Artificial Sequence
  Synthetic
SVLDELREKAKKNIKESEELLRRNEDHSRRDTERSKKLLEDLERRVKEVVREAERIKKK

SEQ ID NO: 23230 - protein, 59 aa, Artificial Sequence
  Synthetic
KDVVRDLERVVKEVEDSNRKVADDSRRSTEDNKRKNEKVERDARELLKEIEEIVRRLEK

SEQ ID NO: 23231 - protein, 59 aa, Artificial Sequence
  Synthetic
DSLERLREIVERIVREARRLLRENEEHSERDTREVERLLEEVERRLRRVVEEAEKIKKR

SEQ ID NO: 23232 - protein, 59 aa, Artificial Sequence
  Synthetic
EDVVREARRIVDELRKEVKEIVERSRKSTEDNERRNRKVIEDLKRLVKELEDRIREIKK

SEQ ID NO: 23233 - protein, 60 aa, Artificial Sequence
  Synthetic
DFEERLKEVLKDAERVVDENKKENKKVLDKAKKVVDENRDRNRRVLEEVEREIRRLIDEI

SEQ ID NO: 23234 - protein, 58 aa, Artificial Sequence
  Synthetic
KEVEEVLKEIKDILRESSKTSKDLVRRTEEILEESSRDSDRVAKESKKLLEEVKEEVR

SEQ ID NO: 23235 - protein, 60 aa, Artificial Sequence
  Synthetic
SFEEKLDKVVREVEDKIRRLVKRNRDAVKRVADEIRKLKDRNEEVVDRAREKIKRLIDEI

SEQ ID NO: 23236 - protein, 58 aa, Artificial Sequence
  Synthetic
KEVEEVLTRLKEKLKRVEESSEKVVRDSERLLEKIKKLSKDVEDESRKLLERVEREVR

SEQ ID NO: 23237 - protein, 60 aa, Artificial Sequence
  Synthetic
SEVERLLKELKELLEELKKKVDDVLKDLEELLKRLEDHTREVVKRSEDLLRELEEMKRRG

SEQ ID NO: 23238 - protein, 59 aa, Artificial Sequence
  Synthetic
EEVVRELRRVLEEVRRTAERLLEKLDTVLKKVEDKIRELLKESTRVNKDAKREIDRLRK

SEQ ID NO: 23239 - protein, 60 aa, Artificial Sequence
  Synthetic
SEVETILEDLRRLLEELKKHSDEVVKEIKDLLREIEKHTREVVKTSKKLLKELEELRKRG

SEQ ID NO: 23240 - protein, 59 aa, Artificial Sequence
  Synthetic
EELVRKIEKVLKEVRETIKKIAEDSDRVLEEAKEVAKRLKDESDRVNEEVRKRIEELKK

SEQ ID NO: 23241 - protein, 60 aa, Artificial Sequence
  Synthetic
SDVDRVLEEIRKLLEDLKRHSEKVSEENEDLLRKNTELNKRVSEDNERLLEELKRLRERG

SEQ ID NO: 23242 - protein, 59 aa, Artificial Sequence
  Synthetic
EELKKKLDEVLERAKRTIDRLLETSDRSLEKVERDLRRLNEELDRSLERAERTIRELAK

SEQ ID NO: 23243 - protein, 60 aa, Artificial Sequence
  Synthetic
SEVDEVLERIKRLLERLAEHSDKVVRDIEKLLDDNRKENERLLDKLRRELKRLEEMRRRG

SEQ ID NO: 23244 - protein, 59 aa, Artificial Sequence
  Synthetic
EELRRKLEKVLREAEKVIDELLKKTDEVLKRARETIEDLNRKLDKVLKEVRDKLDRLRD

SEQ ID NO: 23245 - protein, 60 aa, Artificial Sequence
  Synthetic
SSIEKVKREVDEVIKTSKKSSEDSEKLVRDVEERLRKLVKDVRDRVKRVIEEMERLVRER

SEQ ID NO: 23246 - protein, 58 aa, Artificial Sequence
  Synthetic
ELVERLKEVLKRLEEVSEESERRNREVVRRLEDTARKLTEELRRVLTELRDVLRRLEK

SEQ ID NO: 23247 - protein, 60 aa, Artificial Sequence
  Synthetic
KDEETLKRLLEKAKEVVDRLKDENEKVTRDNHESVKKAKDANKRSNEKSERVARDAIRRV

SEQ ID NO: 23248 - protein, 56 aa, Artificial Sequence
  Synthetic
VRELAKKVEKAIRELEELSRENREAVKRISDEIKRLSDENAKDSERIIKEIDDRVR

SEQ ID NO: 23249 - protein, 60 aa, Artificial Sequence
  Synthetic
SDDETVTKLLKEAEKVVRELTKRNKELLRKNHESVREAKKRNEDLSRKLEEVVRRLIEEI

SEQ ID NO: 23250 - protein, 56 aa, Artificial Sequence
  Synthetic
VKDLAKKIEDVIREMEELTRRNEKRIEEISDEIRRLSDTNRREIERIREELRRRAK

SEQ ID NO: 23251 - protein, 60 aa, Artificial Sequence
  Synthetic
REDERLEEIARKIKKVVDELVERNKKLTEDNHESVRRAEKRNRELSRELEEVAKRAIERI

SEQ ID NO: 23252 - protein, 56 aa, Artificial Sequence
  Synthetic
VEDIERKVEDIIRRLEDLSRRNEEKVRRISEEIKKLSKDNERTIKEIIKEIEERVK

SEQ ID NO: 23253 - protein, 60 aa, Artificial Sequence
  Synthetic
DELDRLREEIKALIKESRESLKRLEEESRRLAEELRKLIRELKERIERIIEEARRLAKEI

SEQ ID NO: 23254 - protein, 59 aa, Artificial Sequence
  Synthetic
DDVRKKVEDVLEEARRRITDDEDKTKKVHDESRRVVEEVRERVKRLLDKARTVVKEIEK

SEQ ID NO: 23255 - protein, 60 aa, Artificial Sequence
  Synthetic
SEVEDLERKIEELIERAKRLVEELEERSRRLIRELEELSKKNEEDIERLIKEAKKLAEDI

SEQ ID NO: 23256 - protein, 59 aa, Artificial Sequence
  Synthetic
EEMRRRVRELLKKAEEVVRRLEKDSDRVSKESEDMVRELLRRNEEALRKAEEVVREIKR

SEQ ID NO: 23257 - protein, 60 aa, Artificial Sequence
  Synthetic
KDIDELRKRIETLIREAKKLVDDVRKRSEDLIERLKKLSEDNARDIERLLREAEDLARKI

SEQ ID NO: 23258 - protein, 59 aa, Artificial Sequence
  Synthetic
REVKERVRRLLEKAADVVRRLIEESNRVSDDSRRVVKELLDRNKELLDRARKRVEEIRK

SEQ ID NO: 23259 - protein, 60 aa, Artificial Sequence
  Synthetic
DDIERLKREIERLLKEAEKISRDNEERSKELLDRLRKLSEDNKRKIDKLVEELKRLADKI

SEQ ID NO: 23260 - protein, 59 aa, Artificial Sequence
  Synthetic
EKVKRDAREALRKAKKKVDELKRKNDEVHRRSREEVKRLLEENRKLLEDLRRMVREITQ

SEQ ID NO: 23261 - protein, 57 aa, Artificial Sequence
  Synthetic
RKVEEVEKHSRESIKEIERLVEEVRKHSKDSIRRIEKLVEDVERHSRKVIEELERDK

SEQ ID NO: 23262 - protein, 59 aa, Artificial Sequence
  Synthetic
KDMVRRLEKILKEDKEVVKKAEEELRELLKEDREVVKRAEEELERLLKETEDVVRKVET

SEQ ID NO: 23263 - protein, 57 aa, Artificial Sequence
  Synthetic
SALEEVKRHSEESIKAIEELVRRVEKHSRESSKRNEELIREVEDHSRRVIEELKRKK

SEQ ID NO: 23264 - protein, 59 aa, Artificial Sequence
  Synthetic
EDVVRAAEKLLEEDRDAVRRAKEKLDELLKRDRDSSREAIRELERLLKETRDVLREVER

SEQ ID NO: 23265 - protein, 60 aa, Artificial Sequence
  Synthetic
SEIEKILKDVDKKLKDSSRESEESVKESRDLLRESSERSERSVRETRKRVDDLLRLVDER

SEQ ID NO: 23266 - protein, 59 aa, Artificial Sequence
  Synthetic
EDMKREIDKLVEKLKKVLRDNKRLHEKVIRELEEVVTRNEELHRRVIKEAKEVVDRVRK

SEQ ID NO: 23267 - protein, 60 aa, Artificial Sequence
  Synthetic
SEVEEVLRRIEELLREDKRHVEEVVREIRELLKRNKDMVDEVLKRIEDLLREIDEARKRG

SEQ ID NO: 23268 - protein, 59 aa, Artificial Sequence
  Synthetic
EEVIRKLDDILRKVKRVSEDNKRETDKVREEVAEVVKRSKDKLDKVRKDVKRVIERVRT

SEQ ID NO: 23269 - protein, 60 aa, Artificial Sequence
  Synthetic
DEVEKAAEDVERRLREDEDHARKVVKRIRELLEEDTRTVDKVLREIEKLLKDITDLRRRG

SEQ ID NO: 23270 - protein, 59 aa, Artificial Sequence
  Synthetic
KELTEKLDRLLERVEEVSKRNEDATRTVEKEVEEVVRRTKKKLDDILERVERVARELKR

SEQ ID NO: 23271 - protein, 60 aa, Artificial Sequence
  Synthetic
ELIKKARKDVEEVRERSERLVDELRKRNKKLADESRRLIDKLRKDVEKVLREIEDLLRKR

SEQ ID NO: 23272 - protein, 59 aa, Artificial Sequence
  Synthetic
KKLMEEVERLIKRLEDVNEKSERDVREINKESERVNEETEREVEDAIRKLREVLRRAKK

SEQ ID NO: 23273 - protein, 60 aa, Artificial Sequence
  Synthetic
KEVEDLERRVKEILDRMKRLIDENRKKIEKSIRELERLIDENRKEVERVKKELKDLKREG

SEQ ID NO: 23274 - protein, 59 aa, Artificial Sequence
  Synthetic
KEMEKKLEDIVRRVREVVRRAHETNERLVDRSRKAVEKAERTNRRLVEEIRKVAEEVRK

SEQ ID NO: 23275 - protein, 60 aa, Artificial Sequence
  Synthetic
DEIRELEERVRRILDELRRLVERNREVIERSIRELEKLLDRNRRKVEEILRRIDDLTRRG

SEQ ID NO: 23276 - protein, 59 aa, Artificial Sequence
  Synthetic
ERVKEAIKELVKDVDRVMREVDRANRELTKTSKKVLEDVDRTNRRLVKEVRDVVERARK

SEQ ID NO: 23277 - protein, 60 aa, Artificial Sequence
  Synthetic
KEVEDLERTVRTILKRMRELITRNEEEIRRSIEELKKLLKENKDTVRRILEEMKELKKEG

SEQ ID NO: 23278 - protein, 59 aa, Artificial Sequence
  Synthetic
EDAKRKLDELTKRVEKVVREADERNKRLTKRSKEVLDEVHRANEEALKEVEEVVRRVTK

SEQ ID NO: 23279 - protein, 60 aa, Artificial Sequence
  Synthetic
DEIEELRKKAEEIIRRMEDLVRRNTETIKRSIETLKKLIDENRRRVRKIIETMKELKRRG

SEQ ID NO: 23280 - protein, 59 aa, Artificial Sequence
  Synthetic
EEVKEAIERLVRRVEEVVRKVREENKRLNEESEEVVRRADRTNREILKRVRDAVREVRR

SEQ ID NO: 23281 - protein, 59 aa, Artificial Sequence
  Synthetic
DAEDTLRDITRKVRKVLEEHRETIERTIRKNRESLERVKRAIEELIERSRRALEEVTRS

SEQ ID NO: 23282 - protein, 59 aa, Artificial Sequence
  Synthetic
DEMLKRVEDIVKKLIEDLREMAKRNRDISKEVDDRLKKILDEVRKHSEEVIKRLKDEER

SEQ ID NO: 23283 - protein, 59 aa, Artificial Sequence
  Synthetic
SAEETLERLAREVRKVLEEHARKIKKTIDDSRRVLEEHRKTIKRTIDESRKVIKDVRDD

SEQ ID NO: 23284 - protein, 59 aa, Artificial Sequence
  Synthetic
EEVLRRVTEEVKELIERIERLLKENRKHSKKIIDRLRELLEENRRHSEELRKRLEDERR

SEQ ID NO: 23285 - protein, 56 aa, Artificial Sequence
  Synthetic
SSLDEIRRKVREAIERLERLLEENRRKVEEVKRRNERLLDRNREVVDEVIKRLEEM

SEQ ID NO: 23286 - protein, 59 aa, Artificial Sequence
  Synthetic
REVDEELKRLVEEVKKVVDDVRRENKRLLEEVERVSEEVKKTNEKLLERVKRVVEEAER

SEQ ID NO: 23287 - protein, 55 aa, Artificial Sequence
  Synthetic
SSLDTAREHTRDVIKKIDDILRRNEKLVDDVIRELERLLRENAEVVERVIDRLRR

SEQ ID NO: 23288 - protein, 59 aa, Artificial Sequence
  Synthetic
REVVEELKELRKRSEEVVDRAEKALRRSVRKAEKVVEEVERANKRLLERVKKVVDDMRR

SEQ ID NO: 23289 - protein, 61 aa, Artificial Sequence
  Synthetic
EVRERVKEVIERSEKSVRELERIVEELARRLRESVEDLERKIRELSKELRRVVEELVRTRG

SEQ ID NO: 23290 - protein, 59 aa, Artificial Sequence
  Synthetic
EEVVRRIEELLKEVHKENKRVADELKKLVEDLHDRNRRVKEEVKRRVDEVRRKAEEVAR

SEQ ID NO: 23291 - protein, 61 aa, Artificial Sequence
  Synthetic
EVDERIRRLVEESRKSVEDLARIVDELVERLRRSVRDLEEKSKRNKEELEKVLRDLARTRG

SEQ ID NO: 23292 - protein, 59 aa, Artificial Sequence
  Synthetic
EEVVERVERLIEKVHRDNRRVAEKLREDVRRVHEDNKDVARKSHKLVKEVRDTVREVRR

SEQ ID NO: 23293 - protein, 56 aa, Artificial Sequence
  Synthetic
DVLKEVEEDSRRNHERNRRVAEKVTDDSRRNVKRLEEVAEEIKDDSRKNKERLDKL

SEQ ID NO: 23294 - protein, 59 aa, Artificial Sequence
  Synthetic
KEIEKILRDVLKENEDSLRELKEILERLLEENRKAVEKLKRILEELLRRNDEMLKRVRT

SEQ ID NO: 23295 - protein, 56 aa, Artificial Sequence
  Synthetic
SVDEEVRRDSKKNKEDLDRVAEKVKRDSEENMRRLEEVARKVTEDVKRNKKTLEDL

SEQ ID NO: 23296 - protein, 59 aa, Artificial Sequence
  Synthetic
EEIRRILKELLERNERALEELKKRLRKVLEENKTVLEELRRRLEELLRRNKRMVDEARR

SEQ ID NO: 23297 - protein, 59 aa, Artificial Sequence
  Synthetic
DEVEKLVEDVARVNKKSLDEVRRLLEELEKVSRDHRREVERSLREAEKVLEDLKREAEK

SEQ ID NO: 23298 - protein, 55 aa, Artificial Sequence
  Synthetic
DEIRKVKKHNEDVLRKVRKILKDAERISKRALDENERILKEVEKRVRDVIRELER

SEQ ID NO: 23299 - protein, 59 aa, Artificial Sequence
  Synthetic
DEVDDVVRRLEEENRKSEERAKDTLRKAKKVLDELKKRVKESEDRVKEVLDDVEERVRR

SEQ ID NO: 23300 - protein, 55 aa, Artificial Sequence
  Synthetic
KRVRDALRHNEDVLRRNDEIVDELRKRVEDVLKKNEDDVRRVAEEVRRVIEELRK

SEQ ID NO: 23301 - protein, 59 aa, Artificial Sequence
  Synthetic
DRVEEVVKRAKDENRKSEEEVKKSLKDLEDLSREHEKRIRDLLKEVKEILDRIREEVEK

SEQ ID NO: 23302 - protein, 55 aa, Artificial Sequence
  Synthetic
DEIRKLERHNEEVLKKNETIARDLEKRSREVVKRLEDILRKVEREVEKALEEVRT

SEQ ID NO: 23303 - protein, 56 aa, Artificial Sequence
  Synthetic
SVEEELRKLKEEIDRVLEENKKIIDDIRKELDDVNRENKKIIDDIRKEIDDVLERV

SEQ ID NO: 23304 - protein, 59 aa, Artificial Sequence
  Synthetic
EKDLKKLLEEVRELLERSRRASEELLREVKRLLDESRKESKRLADDVRRLLEELERRTK

SEQ ID NO: 23305 - protein, 56 aa, Artificial Sequence
  Synthetic
SVEDIIRKIEKELDDVNRENEEIIRRIKKELDDVNRRNEKIARDSKKRVDDVLRKV

SEQ ID NO: 23306 - protein, 59 aa, Artificial Sequence
  Synthetic
EEVVKKIREEVRKLLEESKRRSDELAKEVRELLKRSEDKSRRNLEEVEKLLKEVEDRTR

SEQ ID NO: 23307 - protein, 60 aa, Artificial Sequence
  Synthetic
KDLEDVLDKVRKDLERSKKHSDDVVKTIRELLKESEKHSEELVKRVEKLLEELRRMTTRG

SEQ ID NO: 23308 - protein, 56 aa, Artificial Sequence
  Synthetic
ESILRELERRVKKVVEENDEITRRVEREVEKVDKKNKDITDTLRTRVKKAVDEARK

SEQ ID NO: 23309 - protein, 60 aa, Artificial Sequence
  Synthetic
SDIERLLREVEKVIRDSEEETRKLLEEVEKALKDSRDSSEDVKRKVDDILRKLRELRRRN

SEQ ID NO: 23310 - protein, 60 aa, Artificial Sequence
  Synthetic
MERIERLLREVRKRVEEAAKRNKDVIKEIEERVRTVHDENRRLLEEIAKRVRDVLEEVRT

SEQ ID NO: 23311 - protein, 57 aa, Artificial Sequence
  Synthetic
KVEEELEKEVRRALEESKRLLDRLTEHSKRVLDELRELLERVERDVRRVLEELKRER

SEQ ID NO: 23312 - protein, 56 aa, Artificial Sequence
  Synthetic
KDVVDRLEKELKKVNDEARKRIEELLRESDRVLEEVKKKMRELERELKKVLKEVRD

SEQ ID NO: 23313 - protein, 57 aa, Artificial Sequence
  Synthetic
DEVEDADRKVRTVLEDLRRRLEELKKHSDDVSRRNEKLLRELKEHSDRLVEEIKRDK

SEQ ID NO: 23314 - protein, 56 aa, Artificial Sequence
  Synthetic
KRVVDELLKKLRDVLEEVRRTVDELVKRSEESLRRAREVIRRLLEKTREVLEEVRT

SEQ ID NO: 23315 - protein, 55 aa, Artificial Sequence
  Synthetic
STEDVLRKIKEDVKRVIDDNRRILDEVRRTSKRVLDDLRRNLKHIAEEVERVLRE

SEQ ID NO: 23316 - protein, 56 aa, Artificial Sequence
  Synthetic
SKELLEKAKRVVDEIKRLAEESLKRLEDLSRDHKRRAKELNDEIRKVVDELRKRAT

SEQ ID NO: 23317 - protein, 55 aa, Artificial Sequence
  Synthetic
SLEEVLDEIRKLVERALRDLERNLRHVTRTSEEVLRRNEEILRRIEEKVDRVVRN

SEQ ID NO: 23318 - protein, 56 aa, Artificial Sequence
  Synthetic
SKELLDEIRRVLEEVKRRVEELNKELKDLSDKHKEKAKRTDETITDVLRKAEERER

SEQ ID NO: 23319 - protein, 60 aa, Artificial Sequence
  Synthetic
SVEELLREVAELVKRVDEDLRRLLEEVRRSNEEVIRRLEEILKRIEEENRKVVEELRRRG

SEQ ID NO: 23320 - protein, 59 aa, Artificial Sequence
  Synthetic
EETVKRLLDELRELLERLKRTIEELLKRNRDLLRDAEEKARRLLEENRKLLKKARDTAT

SEQ ID NO: 23321 - protein, 60 aa, Artificial Sequence
  Synthetic
SLEELVRDVERLVKESIEELERVVEDVRRLNTELKEKLERVAREIKKRNDDLVRELRTAG

SEQ ID NO: 23322 - protein, 59 aa, Artificial Sequence
  Synthetic
EEVIDRLRKELEDIIRESRKNLEDLLRENKRLVEEVERTLRELLRTNKELLERIREEVR

SEQ ID NO: 23323 - protein, 60 aa, Artificial Sequence
  Synthetic
SVEEMLEKIRRRATESVKRLRKILKEIKERNEKAIRDDRRLLEEIERRIREVVKRLRDAG

SEQ ID NO: 23324 - protein, 59 aa, Artificial Sequence
  Synthetic
EETVKRLEEEVEKIVRDSERNAREMLERNRRLIEESKKRTKDLLKEVEDEVRKLEEEVR

SEQ ID NO: 23325 - protein, 60 aa, Artificial Sequence
  Synthetic
SVEEIVRRIREELKKVEEDSERIVRTVEDVLRKVLETVERIVRESEKRSRDAVRRIREKL

SEQ ID NO: 23326 - protein, 59 aa, Artificial Sequence
  Synthetic
DEVATRLLKEVKEELDRLREENERLLRELKETVEKLKRDAEKVVEDDERLVRELEKRVD

SEQ ID NO: 23327 - protein, 60 aa, Artificial Sequence
  Synthetic
DIEELLEEIRRRAEEAHRRNEDLLRKIKELVKKARKDNEKVVRDIERRLREVLERVRKKI

SEQ ID NO: 23328 - protein, 59 aa, Artificial Sequence
  Synthetic
REEVKEVLKRVEDLLRTSEEETKELLKRVEDELRRSKEDSEDVLRKVEELLERIDRRVT

SEQ ID NO: 23329 - protein, 60 aa, Artificial Sequence
  Synthetic
KEIEEILEEVKRLLDKLKEDSDRILERVRELLERSKEKSREILKRVEDLLRELEKLVRDD

SEQ ID NO: 23330 - protein, 59 aa, Artificial Sequence
  Synthetic
EELRRVLEEIRRLLEEVRRKIEEASRRLKEDADRVHRKNEEILKRIEELIEEVKRRVEK

SEQ ID NO: 23331 - protein, 60 aa, Artificial Sequence
  Synthetic
KEVEDILREVDKLLKESKRKSEEALKRVKRLLDELKKTSKRILREVEKLLERLRRLKKDD

SEQ ID NO: 23332 - protein, 59 aa, Artificial Sequence
  Synthetic
KDLKKIVDDIRRKIDKVDKDNERLIKELEDRVRKAREDIRDISRRIRELVKRVVDEVEK

SEQ ID NO: 23333 - protein, 60 aa, Artificial Sequence
  Synthetic
DEVETILRDVKRLLEESRRESERVLEEVRRLIEELKKRSRDIMEEVKKLLEELREIVRRD

SEQ ID NO: 23334 - protein, 59 aa, Artificial Sequence
  Synthetic
EEARRLLEEADRLVREVDKENEDILRRIEESVREVEERIRRISRAIEESIRRVKEEVER

SEQ ID NO: 23335 - protein, 60 aa, Artificial Sequence
  Synthetic
KEVEDLLREIERLLKESRERTKKVEEDVKRLLDESRKTSEDVLREVERLIRELEKIVRED

SEQ ID NO: 23336 - protein, 59 aa, Artificial Sequence
  Synthetic
DKARKLVEEAKRRLDTVNEENKDVVRKIKEDLERVDEENRDVLRRIKRIVERVEEEVRR

SEQ ID NO: 23337 - protein, 58 aa, Artificial Sequence
  Synthetic
DEAERLLRRIEEILKRSKDVSDKLLEDNEKLVRDVKRRLDEHLRKNREALKKLREELK

SEQ ID NO: 23338 - protein, 56 aa, Artificial Sequence
  Synthetic
DEVVRRIEELVKKLEEDNKRVVEEIKKLNDDLRREVKRVLDEARKLNKEIVDELRK

SEQ ID NO: 23339 - protein, 59 aa, Artificial Sequence
  Synthetic
SEVDELRRRVEEVERRSEENSRKHLEDNEKMVDDLRKNLERHLKENKELVERVRRVVED

SEQ ID NO: 23340 - protein, 56 aa, Artificial Sequence
  Synthetic
DRVVEDLKRRADELVRRNERAAEEVRRLNEEVVEDLKRVVKEVKDLNDELVKEVRR

SEQ ID NO: 23341 - protein, 60 aa, Artificial Sequence
  Synthetic
SVEEVLKEIEKEHRRSEEEVKDVLRKARKINEEVERRVKEVVDRIRETIARVRKEVKDRN

SEQ ID NO: 23342 - protein, 59 aa, Artificial Sequence
  Synthetic
KDVLKKLLDRSRRLVEKVRDDLRKAEEKNRRVAEEIKETLKRMEDRVREELKEIKKKAK

SEQ ID NO: 23343 - protein, 60 aa, Artificial Sequence
  Synthetic
SVEEVLKEIEDLHKKSIDEVREVLKEAEDLNRRAVKEVEDALRESEELNRRVTKEVRDEN

SEQ ID NO: 23344 - protein, 59 aa, Artificial Sequence
  Synthetic
KEVLDRLLEKSEKLARDVRKRLKEVLDKNRKVVEEIRKVLEELLRHSERKLERIRERLK

SEQ ID NO: 23345 - protein, 61 aa, Artificial Sequence
  Synthetic
DVEDVVRELKKLLDEITRRSEEVVKRLHDRNEEAKEEVRRVVKEVRERLKKVVDDVRRELK

SEQ ID NO: 23346 - protein, 59 aa, Artificial Sequence
  Synthetic
REVLRKLKKEIKDLLDRIEELNKKVLDESEKLIKEIREDLRRVKEEIKEELKRIREEVR

SEQ ID NO: 23347 - protein, 61 aa, Artificial Sequence
  Synthetic
SVEEVVRRIKEKLETVVDESRRVVKDLHDKNKEIVEESRKVLRESEKVDEDVVEEVRRRLG

SEQ ID NO: 23348 - protein, 59 aa, Artificial Sequence
  Synthetic
DEELEKLLREIEDLLRKIRKLNKEVLDRSRKLLEDIRRLNKRALERNRKIAKEIRDEVK

SEQ ID NO: 23349 - protein, 56 aa, Artificial Sequence
  Synthetic
DSAEKLERDVRRALERIRKRLEENDRRVEEILERIRRRLREDLETSREVLERLRKE

SEQ ID NO: 23350 - protein, 56 aa, Artificial Sequence
  Synthetic
ESVIEKLERLLDELLEEVKRVVETSEKKLDELLEEVKRVVEESKKALDDLLREVEK

SEQ ID NO: 23351 - protein, 61 aa, Artificial Sequence
  Synthetic
DKVDEVLRRVRELLERLRKLLEDNKKTTDELLEELRRILKEDEDRTRKLLKRLRDVKREEI

SEQ ID NO: 23352 - protein, 56 aa, Artificial Sequence
  Synthetic
DRMMKRLKEELERIRKKVREVLERSSRAVERIEREVDEVVKRSSDTVKRILDEVRK

SEQ ID NO: 23353 - protein, 61 aa, Artificial Sequence
  Synthetic
SEAERVRRRVEELLRELREHSRRVLEEVKRLLEKLREDNERSLRRIKKLLDELRRVRERDL

SEQ ID NO: 23354 - protein, 56 aa, Artificial Sequence
  Synthetic
EEVLRDIERRVREIEKEVREVTRAIEESVKKIEKESRDVLRAIAETIRKIEEEVKK

SEQ ID NO: 23355 - protein, 61 aa, Artificial Sequence
  Synthetic
DEAEEVLKTVKKLLDDLRRRNEDSLRRIEELLKRLRDHSKRVLEEVRRLLEELRRVKERDL

SEQ ID NO: 23356 - protein, 56 aa, Artificial Sequence
  Synthetic
EEVLRKIKKDVEKIVRDSERVIKTIEEKIDRIKKEVKRVTDEIRKRVEEIAEEVRR

SEQ ID NO: 23357 - protein, 60 aa, Artificial Sequence
  Synthetic
SELEDVLRRSRDLLRRLKELLERLLETVRKLIEEAKELLKKILEDSRKLIREVEEMVRRG

SEQ ID NO: 23358 - protein, 58 aa, Artificial Sequence
  Synthetic
EEIRRVIKESKDLSRALEETVRRVERKIEDLLRRIKEEAERVIKESEKLIEDAERATK

SEQ ID NO: 23359 - protein, 59 aa, Artificial Sequence
  Synthetic
DEDEEVERELKKIKDKSKKVLDKSRKTIDELRKEVERTLRRWTKRSKDLLDKVEAAKRR

SEQ ID NO: 23360 - protein, 55 aa, Artificial Sequence
  Synthetic
EEVLRKVDTILKEIKRRNEKVLKELRDIIDDLAKKLDEVLRRDEELAKKVTEELK

SEQ ID NO: 23361 - protein, 59 aa, Artificial Sequence
  Synthetic
SEDEDARRTLREMLEESRKHLKEWEDTSRELEKKSREVLKETRKTIAKLADRVRKAKEN

SEQ ID NO: 23362 - protein, 55 aa, Artificial Sequence
  Synthetic
EEVLEDIRRKVEKLEEDNRRVMKKDEDAVRRVEEENRKVLKELKERIDRLAEELK

SEQ ID NO: 23363 - protein, 60 aa, Artificial Sequence
  Synthetic
DEDREAEETIKRLLDRSRKTLEESRKTSEDLRRKSEKVLRETRKSLEDSLRKVREMKKRN

SEQ ID NO: 23364 - protein, 55 aa, Artificial Sequence
  Synthetic
EKVLRDLEEIVRRAAKANKDVLDEDRRVMEEAREENKRVIDEYRKILKEATDELR

SEQ ID NO: 23365 - protein, 60 aa, Artificial Sequence
  Synthetic
SEDEEAKKTLDELLKKAEELVKKIKETSERLLRKSDKLLEETKKTIKELDDEVKEVKKRN

SEQ ID NO: 23366 - protein, 55 aa, Artificial Sequence
  Synthetic
EEVLRRIEEIIRRVTELLKKVLKEDREVVEEARKKNEEVLDRLKKIIEEAEERLR

SEQ ID NO: 23367 - protein, 59 aa, Artificial Sequence
  Synthetic
DEDEKAKRMLEEAEKKSKKHVDEVRETSKRLLEESKKLLEETDRSLRKSLERVDRVKKN

SEQ ID NO: 23368 - protein, 55 aa, Artificial Sequence
  Synthetic
KRVLDDIKTKVERLEERNKKVLDDDREMVTRAEEENRRVIKKYRDILEEARKRLK

SEQ ID NO: 23369 - protein, 59 aa, Artificial Sequence
  Synthetic
SEDEDLDRVAEKLKREHKKSVEEIKRVLKRADEESKKLVRDTERVIEEIKREVEEARRR

SEQ ID NO: 23370 - protein, 55 aa, Artificial Sequence
  Synthetic
EEVLKKLREIVRRVKEENRKVNEEVEKRLRELEEENKKVIEDLKKTVEELVERLR

SEQ ID NO: 23371 - protein, 59 aa, Artificial Sequence
  Synthetic
DDLEDIKRRLDEMREEVKRHVKRLKEVAKEIEDEHKETVRRNKEVAKKLAREIDDARRR

SEQ ID NO: 23372 - protein, 59 aa, Artificial Sequence
  Synthetic
KDKVDKVLREVTEEVKRLEEEIKKVDKEIEEIVRRVERENEEVVRDIARIVEELERKLR

SEQ ID NO: 23373 - protein, 60 aa, Artificial Sequence
  Synthetic
RELEEVIKRIEKTVTDNERANKESVDRIREIVDRLKKEIEESVRRMRDSVKKLEEEIRRR

SEQ ID NO: 23374 - protein, 59 aa, Artificial Sequence
  Synthetic
EELIRRLEKVLKEHHKRVEEIVKENEDVARDLDRRIKEIVERNRKVLEDLRRRIKELKK

SEQ ID NO: 23375 - protein, 60 aa, Artificial Sequence
  Synthetic
SEIEDALRRAERVSRESAKKLEDALRKYEKVSRDLKRRLDEVLKRYEDTSRKIAKDLRDN

SEQ ID NO: 23376 - protein, 56 aa, Artificial Sequence
  Synthetic
EETIERLIEKNKREVDKLLKKIEEVIKRNKDEVDKLLKKIEEVIDRNRRAMEEIAR

SEQ ID NO: 23377 - protein, 60 aa, Artificial Sequence
  Synthetic
SIEDELRKIVEDIEREIKKLEDDLRRVSKDHRDEVRRILEKLKEHIERLEEDADRLKKAK

SEQ ID NO: 23378 - protein, 58 aa, Artificial Sequence
  Synthetic
ETVREMIKRLEELVRRVKRRIEDVIRRNREVVDESRRRIEKAIEDNERVLKKIEEEVK

SEQ ID NO: 23379 - protein, 59 aa, Artificial Sequence
  Synthetic
SIEEEIKKVVKELEDEARKLLKKIEEHSEDLKRKLEDLLRKVEDHIRRLREEIERIKRE

SEQ ID NO: 23380 - protein, 58 aa, Artificial Sequence
  Synthetic
ETVKKAIKELRDLVDKIEEDLKRVLDENERVLREIARKIDEIIEKNERELRRVLEEIR

SEQ ID NO: 23381 - protein, 57 aa, Artificial Sequence
  Synthetic
DEAEELERRLREEVKRVETDLRRTTRELEREVEEVRRRLEKTSRENNDRSEKAERED

SEQ ID NO: 23382 - protein, 56 aa, Artificial Sequence
  Synthetic
KEVVDRLREIITDLVRKLEENVKRLEEIIKRLEEELKRNVDRLRENSKRLAERLRT

SEQ ID NO: 23383 - protein, 57 aa, Artificial Sequence
  Synthetic
SEAEKVLEEVRRLIEEIRRRLKETTDDVRRLVRELKEEAKRLLEEDKRLVDDLRRRN

SEQ ID NO: 23384 - protein, 56 aa, Artificial Sequence
  Synthetic
KEVVDKIRKVAEELKKELKDNADRVRRIAERLKEELKRVAEKSDRIIRTLEEELKR

SEQ ID NO: 23385 - protein, 57 aa, Artificial Sequence
  Synthetic
SEVERLVREVEKDLERERRRLEKTVRDSERLVRELKETLDRLLKRDKDVVDDARRKN

SEQ ID NO: 23386 - protein, 56 aa, Artificial Sequence
  Synthetic
KSVVDRLREIVKELKDRNRKVVKELEDIHRDSDRELDDVVRRSDEIIRELVERLKT

SEQ ID NO: 23387 - protein, 59 aa, Artificial Sequence
  Synthetic
DLEEIIKTIREINERLNRRVREVEERLRRTSRELEERIRDVVRKLREINDRLRKEVEAR

SEQ ID NO: 23388 - protein, 55 aa, Artificial Sequence
  Synthetic
ERLVRENEEAVKRLTKELDDLLRKNEELIRRLEEEAKRVLERNEKIARDVREELK

SEQ ID NO: 23389 - protein, 59 aa, Artificial Sequence
  Synthetic
DLEEIIRKIREINRELNETVKKVVRELEEDTRRVKRRIEEIVKELERTTRELDKRVKDS

SEQ ID NO: 23390 - protein, 55 aa, Artificial Sequence
  Synthetic
EKLVEDNRKEVRDLEEEARKLLRENHELTKRLIEEAERILKKNEELIRKIEEEER

SEQ ID NO: 23391 - protein, 59 aa, Artificial Sequence
  Synthetic
SLEELLEELERILREVEERIKEVVRRLEEDTRRVEEEIRRIVEELKRINRELEELVRRT

SEQ ID NO: 23392 - protein, 55 aa, Artificial Sequence
  Synthetic
ERLVKEVRDTVKELEDELKELLDRNHELTRRLEEEAKRLLEENKKRADDVKEELR

SEQ ID NO: 23393 - protein, 59 aa, Artificial Sequence
  Synthetic
RLDEVIRRVEEVIRDVERRVAEVVKRLRDSSKTVKEKIETVIRRNKEINKRLEDLIRES

SEQ ID NO: 23394 - protein, 59 aa, Artificial Sequence
  Synthetic
EDDLRRTLEEVKRTIDKLKEDAERLLEENKDLIRRLEEELKESSKRNDTLVKKLKKELK

SEQ ID NO: 23395 - protein, 60 aa, Artificial Sequence
  Synthetic
REMEEALKRNNELSERLRRELKRVLEENHRLSRDLEKKLRDLLERVRELVERLDRMKEEG

SEQ ID NO: 23396 - protein, 59 aa, Artificial Sequence
  Synthetic
EEVRRVLEEIRRDTEELEKDARRVLTELRRNLERLRRKVEKVLEEIRRILEELERRVRK

SEQ ID NO: 23397 - protein, 60 aa, Artificial Sequence
  Synthetic
DKLEKLEEKLEKDVRRWDDELRRDLEDSKRLVDTIRKRLEKLLRDHRELVRRIRELLRDG

SEQ ID NO: 23398 - protein, 55 aa, Artificial Sequence
  Synthetic
EVVRRLEEEVRRLEEKVKEVLRRNEEEVRRLEKDIERVLRESTKIVEDLKDEVRK

SEQ ID NO: 23399 - protein, 60 aa, Artificial Sequence
  Synthetic
SVEEVVEELERIHREVKREIDEVVDRLREINEEVRREIKEVLDKIREDLERLKEEIDRDL

SEQ ID NO: 23400 - protein, 59 aa, Artificial Sequence
  Synthetic
DDILREMLRKSEELVRESREDLKRLLEEHRKLVEESRRELERLKKEVKDAVEEVRRRLK

SEQ ID NO: 23401 - protein, 60 aa, Artificial Sequence
  Synthetic
SVEEVVEELKKIHEDVKRKIDEVLKRLKRINDELRKRIREVLERLRREAEKLMEAIRRDA

SEQ ID NO: 23402 - protein, 59 aa, Artificial Sequence
  Synthetic
DDILREMLKESKELVKRSEKTLRELEKRHRDLVREVEETLKELEREVERKVREVERRVR

SEQ ID NO: 23403 - protein, 60 aa, Artificial Sequence
  Synthetic
SVKEVLDEIRKINDDARRRLEEVLKDLKRINDELKERVDRVHDRNRRLLEELKKEIRTKL

SEQ ID NO: 23404 - protein, 59 aa, Artificial Sequence
  Synthetic
DDILREMLERNKELVKESKKVLEELEREHRELVREVKKRLDDSTEKIKTEVDKVKKELD

SEQ ID NO: 23405 - protein, 60 aa, Artificial Sequence
  Synthetic
SVEEVIKEIEKIIRDLKEELKKVLTELEKRNEELKRRVEEVHEESRRLLDTIRKEIERKL

SEQ ID NO: 23406 - protein, 59 aa, Artificial Sequence
  Synthetic
DEVLEELLRRVKKTVKEVREDLDRLRKEHEELVDRVREELERSLREIKERLERIKRRLD

SEQ ID NO: 23407 - protein, 59 aa, Artificial Sequence
  Synthetic
KEAEELLEKVRKLVKEIEDRLRKSSEENRELVKRVEDELRETTKKNKKLVDEIKERREK

SEQ ID NO: 23408 - protein, 56 aa, Artificial Sequence
  Synthetic
EDVLRRIEEILERVERAVREVLRRNKEINDRLRERVEDVVRKNEDILRRVLDEVRK

SEQ ID NO: 23409 - protein, 59 aa, Artificial Sequence
  Synthetic
DEVERLIEEVDKLVKTIEEELRRSSEKNKDAVRRVKRRLEKSNEDNREVVRRVDKERRD

SEQ ID NO: 23410 - protein, 56 aa, Artificial Sequence
  Synthetic
EDVLRTIKEILRELRERVEEVAKRNKEINDRLNEDVERVVRENKELNDRLRERVDR

SEQ ID NO: 23411 - protein, 60 aa, Artificial Sequence
  Synthetic
DEAEKLIEEVKRLVEDLERKLDESSRRNEETVKRIDKELKDSNKKNRDTVKKVTDTAKDS

SEQ ID NO: 23412 - protein, 56 aa, Artificial Sequence
  Synthetic
EDVLRTIKKILDDLERRVEEVVRRNREILKDLERKVRRVFEENEKLNRELEERVKT

SEQ ID NO: 23413 - protein, 60 aa, Artificial Sequence
  Synthetic
SKADEVEKDVDRKLKEVKKRLDETRESVRRKLEEVRRELEESEKSVETVLREVKKTKDRG

SEQ ID NO: 23414 - protein, 56 aa, Artificial Sequence
  Synthetic
EEVLKKLKDIATELRERLDRNNKELTDIHRELKERLDRNNTKLSEIHKRLEEELDK

SEQ ID NO: 23415 - protein, 60 aa, Artificial Sequence
  Synthetic
SEVDEARKRVRDVLEEVRKALEETEKSVRRTLEEVEKRLKESEDSVRKVLEDVRRELERG

SEQ ID NO: 23416 - protein, 56 aa, Artificial Sequence
  Synthetic
EEALRELEEIARRLERELEKNNKDLTDIHETLRRRLEDNNRKLSKIHEDLARELRK

SEQ ID NO: 23417 - protein, 58 aa, Artificial Sequence
  Synthetic
KEAEDMLREVKRLIDRIKKVLEDVLKAIEELIRRLEDIHRKVNEDSERLTEDLKRTIG

SEQ ID NO: 23418 - protein, 59 aa, Artificial Sequence
  Synthetic
KEKIEELLRRVEELIRRIEEEVRKLLEDVERKIRESVKEAEELLRRSKKEIERVKREDT

SEQ ID NO: 23419 - protein, 58 aa, Artificial Sequence
  Synthetic
SEAERVIRESERLTDELRKELEKALRRSKKLSDELRKIHEDANREVRKLIEDLKRTIG

SEQ ID NO: 23420 - protein, 59 aa, Artificial Sequence
  Synthetic
EEILKKLLDESRDTVRRVEDTVRKLVRRSEEFVRKSKERVKRLLDDVRRKIEDVKRKTK

SEQ ID NO: 23421 - protein, 59 aa, Artificial Sequence
  Synthetic
DEEERLLREAEEMHERNKRLIDKLRREVEESLKEVEREIRRLLTDIARLVRRVEELKKN

SEQ ID NO: 23422 - protein, 55 aa, Artificial Sequence
  Synthetic
EEVLREIRKLVEESRKILEKVIRDWRRITEELKDRLRRVLEELKKLVDELRKTLT

SEQ ID NO: 23423 - protein, 59 aa, Artificial Sequence
  Synthetic
SDRERLLEEIKDLNRRNKEILERILRRSEELLKKAEDLLDKIKRDSDRAARKVEELKRR

SEQ ID NO: 23424 - protein, 55 aa, Artificial Sequence
  Synthetic
EEVLRRLEKIVRDSERELRRVREEDKKVADEIREKLKRVHDESERIVRELKETLR

SEQ ID NO: 23425 - protein, 60 aa, Artificial Sequence
  Synthetic
KELEDVKKRVDDLLRENERVVRELLESSKRLNEENEEAVRRLDESSKELAKRVKEIKDRG

SEQ ID NO: 23426 - protein, 58 aa, Artificial Sequence
  Synthetic
RDVRRVLEFVKEVIKEIERIHKKVNDDNRKLIEESIRRLKKVLDDNKRVIDELRKTLK

SEQ ID NO: 23427 - protein, 60 aa, Artificial Sequence
  Synthetic
DEEEEVKKRVEELLDELRKSIKKSVDDSKRVLDEARKSVERSREELEKLLRALEDILRKG

SEQ ID NO: 23428 - protein, 56 aa, Artificial Sequence
  Synthetic
LRRLEEEAKRLVEEVRRRDEEHLKRSEELLKEVEERDRELLKRARDLFEDVRRKIE

SEQ ID NO: 23429 - protein, 60 aa, Artificial Sequence
  Synthetic
SEKEEVAKRLEEALKRLEDTIRKVSEENERVLRTLEDRARKSAEKVERLLEELRKRLEDS

SEQ ID NO: 23430 - protein, 56 aa, Artificial Sequence
  Synthetic
LEELKKRVEELTREVEEEIRRLKETSKRLEEEVKRLIEDHDRRVRELKDEVERRIR

SEQ ID NO: 23431 - protein, 57 aa, Artificial Sequence
  Synthetic
DEAREVIKTLRKLLRDSAEILTRVTEEDREVLRELAEIIKKVTDEDRRVLEEARREL

SEQ ID NO: 23432 - protein, 59 aa, Artificial Sequence
  Synthetic
DRILEELLERIKRLHEENKKAVDRWREESKKLKEEVKKKVKEWKDTSEELLRRVKERAR

SEQ ID NO: 23433 - protein, 57 aa, Artificial Sequence
  Synthetic
KEVEEVIKTLRRLSEKLAREHKKVIDELRDLLRRSEEELKRVAKADEDLLDEIRRKV

SEQ ID NO: 23434 - protein, 59 aa, Artificial Sequence
  Synthetic
EEILEEVKERIDRLVKENKEIVDRSRELAKELHDRNREMLTKWLEDSKRLVEEAEKKAR

SEQ ID NO: 23435 - protein, 59 aa, Artificial Sequence
  Synthetic
DKEKEVTDELRKAKRDNDEVVKEIEKESRRLLEEVKETVKRDKKVLRELEEEVKEAKKK

SEQ ID NO: 23436 - protein, 55 aa, Artificial Sequence
  Synthetic
KKVLDEIRKVLTEAKKMHDDVLRRDREVLETARKLSEDSKKENEDVLRKVAEELR

SEQ ID NO: 23437 - protein, 58 aa, Artificial Sequence
  Synthetic
DEERDLERKLEEVIRRAKETSERLNRELERVIEEVRRRHEEAKRRAEEVIRRILKRLG

SEQ ID NO: 23438 - protein, 56 aa, Artificial Sequence
  Synthetic
KDEVDELVERLKRDIDRWAEDVKKLIEDLRRMVERNLREIDKLLKDLKRVVDETKK

SEQ ID NO: 23439 - protein, 60 aa, Artificial Sequence
  Synthetic
SEADKLLDEVRKRVEDMERRLEELVREDRKLVEDHHRDNKRLLDRVKKLAEDMERLIDRG

SEQ ID NO: 23440 - protein, 59 aa, Artificial Sequence
  Synthetic
SEKAEDVRRRLKELAERVRRVVRRVEEESKRTLKELEKSSKELAKKLRDLVETVERRLR

SEQ ID NO: 23441 - protein, 60 aa, Artificial Sequence
  Synthetic
SRVDDLLREAERLAEEHHRLNKKLVDEDRELVRRHHETNRRVLEEVKRLVEEAEKLIRRG

SEQ ID NO: 23442 - protein, 59 aa, Artificial Sequence
  Synthetic
SEEAKRVAERVRRLLERLRESSKRVKETSKETLERLRRSSEKVEEDLRKLIEDVERAAR

SEQ ID NO: 23443 - protein, 60 aa, Artificial Sequence
  Synthetic
RELEELVKRDREEVRKHHELNKELLDRARKLVRDHHERNKRLVREDEELVREAKELIERG

SEQ ID NO: 23444 - protein, 59 aa, Artificial Sequence
  Synthetic
SDEARKAKRESERTLKELEESSREVEKELRRLLKELRESSKKVEDDSRKSLERVERALR

SEQ ID NO: 23445 - protein, 60 aa, Artificial Sequence
  Synthetic
SKADELVKKDREKVEEMERRLRKILREVEELVKEHHERNKRVLDEVKKRVDDAKELIKRG

SEQ ID NO: 23446 - protein, 59 aa, Artificial Sequence
  Synthetic
SRKAEEVEKDSRRTLERVKDVLRKVEETLRELLDRLRESSERVTEALKRLMEEVREALR

SEQ ID NO: 23447 - protein, 61 aa, Artificial Sequence
  Synthetic
SKLEALVKEVEELVKKAKKDLDRLVEEDKKLAEEHHDRNRKLVDTVRELVERAKEDIDRRG

SEQ ID NO: 23448 - protein, 58 aa, Artificial Sequence
  Synthetic
KELEEVVKELRRLLKELEEVVRRVARESEKSLEEVRRSSEEVKKALDKLLKELEDAVR

SEQ ID NO: 23449 - protein, 59 aa, Artificial Sequence
  Synthetic
SELERIVEEVKKLVEDHKKKLKDIVEEVEELVRRHEKKLEDILRRNEKRVRELKEEVRR

SEQ ID NO: 23450 - protein, 59 aa, Artificial Sequence
  Synthetic
RKKAEEVKRRLEELLKEANKASEEVKRTLDKLLEDVNRESERVERASDELLKRLRDDAR

SEQ ID NO: 23451 - protein, 61 aa, Artificial Sequence
  Synthetic
SELEELVKTVKKLVEDHKRRLKELLERARRSTEDLKRKLEKLVRDVRKLVEDAKDAIRKSG

SEQ ID NO: 23452 - protein, 59 aa, Artificial Sequence
  Synthetic
KDELKKVEDALRRLLEELNEVSEEVERALRELHREVEEAIRRVEKELDRLLKEVEDAAR

SEQ ID NO: 23453 - protein, 59 aa, Artificial Sequence
  Synthetic
RELEEILKESEKSVEDIKRELEKIKKKSKTDLEKWKDDLRKIRKEIADLVRKVTREVED

SEQ ID NO: 23454 - protein, 58 aa, Artificial Sequence
  Synthetic
EKVKRVLDELKRSLEEVRRALEEVREVLRESLKRLRDLAEDLKRELRELLKELEERAR

SEQ ID NO: 23455 - protein, 60 aa, Artificial Sequence
  Synthetic
SEKEDVERRIRRLIERLRRMIEELRRRNTDILRKVRELVEEVKKADERSIREVEKLLRDV

SEQ ID NO: 23456 - protein, 56 aa, Artificial Sequence
  Synthetic
LDELIERAERLVREIERKLRKAIEDSKDLLRRIEERLRRLIEKSEKLLRDIKREVD

SEQ ID NO: 23457 - protein, 61 aa, Artificial Sequence
  Synthetic
SEIEKLVKEIEDHLRRLKEEIEKSSRELKKHLDELERRADKIVRDLRRLVEEIKDTIRREG

SEQ ID NO: 23458 - protein, 59 aa, Artificial Sequence
  Synthetic
REAVERLRKALKESKERLKKALEDNRRTLKKSEEDLKKVMEEVKETLDRVKKEVERALD

SEQ ID NO: 23459 - protein, 61 aa, Artificial Sequence
  Synthetic
SEIEKLARDAEEHLRRLLEELRKSSDDLRRHLEELKKKLKEIVDRLKELVDRIKDTIRREG

SEQ ID NO: 23460 - protein, 59 aa, Artificial Sequence
  Synthetic
KKVIDDLRRILEESARRLKRAAERNDETLKESADRLRRAIDRLREVAEKLSRDVRRAAK

SEQ ID NO: 23461 - protein, 61 aa, Artificial Sequence
  Synthetic
SEIEDIARRLREHLEDLKKKIKDSSDELRKHLEEVKRRIERTSEKLTDDVRKIEEKIRKDG

SEQ ID NO: 23462 - protein, 59 aa, Artificial Sequence
  Synthetic
EERIRDLEKILEDSERELRDMARKNRETAERSERELRKVLRENDRTAKKLTDDVRRTAK

SEQ ID NO: 23463 - protein, 61 aa, Artificial Sequence
  Synthetic
DEIDKLVEDVERHLEKLLREIERSSEELKKHVEDLREKLRDLVRRLKEVVDEIRKTVRDKG

SEQ ID NO: 23464 - protein, 59 aa, Artificial Sequence
  Synthetic
KEDVDRLREMLERSRRRLKRAADENRRTAEKSRKELKEVAERVRRALERMRREVEEELR

SEQ ID NO: 23465 - protein, 61 aa, Artificial Sequence
  Synthetic
SEIEEIAKKLEEHVKRVVEEIRKSSEEAKRHVEDVKRKIEELVRELARLVKEIKEAIRRDG

SEQ ID NO: 23466 - protein, 59 aa, Artificial Sequence
  Synthetic
KERIDELREIAKRSRDKLKKVADENRRTLEKSLRDLARAVEELRRRAKRLEEEVRRERT

SEQ ID NO: 23467 - protein, 61 aa, Artificial Sequence
  Synthetic
SDIERLVEEVEKHLKELEDEIRKSSEELKRLAEEISRDIRRTSEELKKLIEDIKDTIRRDG

SEQ ID NO: 23468 - protein, 59 aa, Artificial Sequence
  Synthetic
KEKIDRLRKILEESEKRLEELARENERTVKEVKKEIDDMVRENEETAKRLLDEVRETLR

SEQ ID NO: 23469 - protein, 56 aa, Artificial Sequence
  Synthetic
DELEKLLEDLRRKIRKIKEDLRKTSKENRDELRKSKKRLEDLVREVRRLVEEIRKL

SEQ ID NO: 23470 - protein, 55 aa, Artificial Sequence
  Synthetic
EEVEKTLRELIKEIEKVLEDDERTVRELIERNKELLDRLAKEVDRLIEEIKREAD

SEQ ID NO: 23471 - protein, 57 aa, Artificial Sequence
  Synthetic
SEADKVRKELDDVRRRVKKALDDIRRELEKLVKEVEDALRDHERSNEELVREVREKL

SEQ ID NO: 23472 - protein, 55 aa, Artificial Sequence
  Synthetic
DRVVEEIRDMMRKLKRELERIVEEAKKVVEDLKRRLEEVSRRSADLVRRLKERAR

SEQ ID NO: 23473 - protein, 55 aa, Artificial Sequence
  Synthetic
SDLERVKKDLEDVVRRVEEVLREHKRTNDEIIREIERLIEELRKENERLAREVRD

SEQ ID NO: 23474 - protein, 55 aa, Artificial Sequence
  Synthetic
ERVVDEIRKVVKELEERLRRLSEESRKLVKDIKEKLDKLAEDSRRLVEKLERDAK

SEQ ID NO: 23475 - protein, 61 aa, Artificial Sequence
  Synthetic
REFEELVERVKRVVEELTRRLRETSEETKTVLEKLRKELEEASRRIEDVLRRLTEKIRKDG

SEQ ID NO: 23476 - protein, 55 aa, Artificial Sequence
  Synthetic
EELEETLERLVEAIRDALRKDEETMRRVAEAIRRLLEDHRRSLEEVLEKIRDALR

SEQ ID NO: 23477 - protein, 61 aa, Artificial Sequence
  Synthetic
SEAEKIVEDIRRVIRELKEKLKKTSEDTEDTVRKLSRRLRELAKRSAELVERVTREIRKDG

SEQ ID NO: 23478 - protein, 55 aa, Artificial Sequence
  Synthetic
EELEETLRRVAEEIRRLLEEDRETLRRVERKIREMLKELEEINRRLIKEVDEEVK

SEQ ID NO: 23479 - protein, 61 aa, Artificial Sequence
  Synthetic
DEVEEIVRRIEEVLKDLRRRLETLARESRDLVRKIKEELRRHSDESRRLLERIKERIRRDG

SEQ ID NO: 23480 - protein, 55 aa, Artificial Sequence
  Synthetic
DELKKEADRVKKEIRDMLRKLKKINDDLIREIEEALKDNERTNREIIRRIEEELR

SEQ ID NO: 23481 - protein, 61 aa, Artificial Sequence
  Synthetic
DEAEKIVRDIEETVRRLARELEKHSEDSRRLVERIKEELTRHSKKVADVVRELKKRIKRDG

SEQ ID NO: 23482 - protein, 55 aa, Artificial Sequence
  Synthetic
EELEKRMRRLVKEIERMLEENKRTNEELVREIEEALKKNEETLRRLKREIEEALR

SEQ ID NO: 23483 - protein, 56 aa, Artificial Sequence
  Synthetic
SEAEELVKDAERVVEELERRLRKVSEDIDREVKKIKRELDEHSKRVKETVDDVRRR

SEQ ID NO: 23484 - protein, 55 aa, Artificial Sequence
  Synthetic
EELKKRVEDLIRTIKELIKRHDDSVKEVEKRIREMLERNRKSVEEVIEELKRTSK

SEQ ID NO: 23485 - protein, 61 aa, Artificial Sequence
  Synthetic
SELEELVKEVKELVDRSKEELKKLSEELKKLLDDLIKRIEDLSRRSKRLVEELRRRVEERG

SEQ ID NO: 23486 - protein, 58 aa, Artificial Sequence
  Synthetic
EEMKRVEEELKRLREEDREAVERHDESIRKLREDLRRAVETHKKSNRDLLREVEETVR

SEQ ID NO: 23487 - protein, 59 aa, Artificial Sequence
  Synthetic
DEVEELIRKIEDLLRRIEEKVTKAIRKSERLLEEIKKKIKEMIDKSERLVEEVERRTRN

SEQ ID NO: 23488 - protein, 55 aa, Artificial Sequence
  Synthetic
EDVKRVLKKVADDVERLLRDLERRNRKVREDVKRVLEELRKSNERSIRRIDETLR

SEQ ID NO: 23489 - protein, 59 aa, Artificial Sequence
  Synthetic
REIEEIIKRARELLEEVEEEWRRLIEKSRRLLEELKKRWDKLIEKSKDLLRKIEKTTKD

SEQ ID NO: 23490 - protein, 55 aa, Artificial Sequence
  Synthetic
DELRKILKRVEDENRRLVEEVERSNRRSMEENERLAEEVRRSNKDVIDKIRERLR

SEQ ID NO: 23491 - protein, 60 aa, Artificial Sequence
  Synthetic
DELERLSESVKKAERRIERLNEELNERVKEVTKAIDDLNKRLNDESKRVKEELRKVLARS

SEQ ID NO: 23492 - protein, 59 aa, Artificial Sequence
  Synthetic
EEVIKRVLDDVERAVDEVRKLIEDVLKEHEDILREVKKELDKAIERHKEILKRVREDIK

SEQ ID NO: 23493 - protein, 60 aa, Artificial Sequence
  Synthetic
SVLEDLARKVERVIREAKKVNEELNRRSEEVRRRADEVVADLNRESKKVDDELKKVLARS

SEQ ID NO: 23494 - protein, 59 aa, Artificial Sequence
  Synthetic
EEVARRVVEELKKVLKEIEDEIRRVIERHKEALDEVRRLVKELKDRHDKILREVREKIR

SEQ ID NO: 23495 - protein, 60 aa, Artificial Sequence
  Synthetic
SSEDRLRETVEDVIRRARDANRELNKASRDVEEESKKLNKELNDRSRKVERDLEEVLRRS

SEQ ID NO: 23496 - protein, 59 aa, Artificial Sequence
  Synthetic
EEVIERLIRDLRRVLEEIKREIEEALRDHERVLKENEDMVREILRRHEEILKRMTDEIR

SEQ ID NO: 23497 - protein, 60 aa, Artificial Sequence
  Synthetic
SVLERVADELRKVEEAIDRLNKELNDAVERVERESRRVNKELNDASERVERELDEVLKRT

SEQ ID NO: 23498 - protein, 59 aa, Artificial Sequence
  Synthetic
EEVAKELIDRIRKLLDDIRRKLEEVLKRHEEVLKRNEDTIRKVLKRHEEILEKVKRDIK

SEQ ID NO: 23499 - protein, 60 aa, Artificial Sequence
  Synthetic
SSKERLREAVERVERESDKVNKELNDKSRRVTEELRKLAEELNRRSKEVEEELDKLLARS

SEQ ID NO: 23500 - protein, 59 aa, Artificial Sequence
  Synthetic
EEVIRRLIEELDRLLEENDRRIKKAIEDHKRILEKAEREVREILRRHEKILEDVREEIR

SEQ ID NO: 23501 - protein, 57 aa, Artificial Sequence
  Synthetic
DEEEDLRRAIERVIETVRRLVERVEEESKRVADELRKLTKRLEEVVRKVDEDARKEV

SEQ ID NO: 23502 - protein, 54 aa, Artificial Sequence
  Synthetic
DVKRRLEELLKRAKEVLDELIKRHRDLLRRHEEKVRRLIKRIEDLLRELSKKAK

SEQ ID NO: 23503 - protein, 57 aa, Artificial Sequence
  Synthetic
SKEEELEKIVRKIREDLRRAVKEVEDESKRVLESTKKALDTIRRVSEKVIEDLRREL

SEQ ID NO: 23504 - protein, 56 aa, Artificial Sequence
  Synthetic
VDELVRRLEELLKELRKRLEDLIRRHEDINRRNHELIRRAIEEHRRLLREAREREK

SEQ ID NO: 23505 - protein, 57 aa, Artificial Sequence
  Synthetic
DEIEELIKKLREDLDRSRREVEKNSEDLKELIKRSEERIEKLIEDLERMVDDARRKN

SEQ ID NO: 23506 - protein, 59 aa, Artificial Sequence
  Synthetic
EKLLKKLEDVIDDVRRRDEDVVRKNEESLKRIEKRDEELIRKIEEVIRRAERKVDEVMR

SEQ ID NO: 23507 - protein, 57 aa, Artificial Sequence
  Synthetic
SKIEELIKELEKLSRTNEELVKRVLEELTRLVEESAKRIEDIIRRLKEVVDKARREN

SEQ ID NO: 23508 - protein, 59 aa, Artificial Sequence
  Synthetic
KKLLDKIKKAIEDLERENERALKELEKRLRELLRTDRELIRKIEEEIKKLRREVEEVLR

SEQ ID NO: 23509 - protein, 60 aa, Artificial Sequence
  Synthetic
SIKERLTEVLKRLAEEIRKVIEENKRTVDRAREEVERVIRKNREVLKRIKERADEVIKRI

SEQ ID NO: 23510 - protein, 59 aa, Artificial Sequence
  Synthetic
ERVVEELIREAKKIVEDIVRRVKRHSREVERIVEEIRRRAEEHIERLKRSLEEVEKKVD

SEQ ID NO: 23511 - protein, 60 aa, Artificial Sequence
  Synthetic
RIMEKLEEVLKELRKKIKKLNKDNEETVRRIKKEVDKVIKKNRDVNERIRKRLEEVISRI

SEQ ID NO: 23512 - protein, 59 aa, Artificial Sequence
  Synthetic
EEVVEKLIEDMERVVAESAKENKKHSDDVKRILDEIRRKAEDHIRKTEELLRRIEERTR

SEQ ID NO: 23513 - protein, 60 aa, Artificial Sequence
  Synthetic
SIKEKLTEELERLAKRIREANEDNKRTVEEVEKRIREVIKKNRDSNKEIKDDVERVLSRI

SEQ ID NO: 23514 - protein, 59 aa, Artificial Sequence
  Synthetic
EEVVERLLKKMREAVKKSEDENREHSERVKRIIEKIAREAEEHSKRTKELLDRIREEVR

SEQ ID NO: 23515 - protein, 60 aa, Artificial Sequence
  Synthetic
RVDEDLKRVLDELKKRVEDLNEENKKTVEDISRRVREVIKRNEDMLREVKKRAREAISRI

SEQ ID NO: 23516 - protein, 59 aa, Artificial Sequence
  Synthetic
EEVVRELIKKMRDVVRKSEKDNKDHSERVKRILKRIEERAREHTRRLEEVLRKVEEDVR

SEQ ID NO: 23517 - protein, 61 aa, Artificial Sequence
  Synthetic
RVKEKLREVLERLEREIRKILKDNKETVKRIEEEARRAVEKNKEALKRLEDRVRELLEDKD

SEQ ID NO: 23518 - protein, 59 aa, Artificial Sequence
  Synthetic
EEKVERLAEELRKIVRKIIEDVRKHSEDVRKILEDVKKEVDDHVREMEEIVKRLEDEIR

SEQ ID NO: 23519 - protein, 60 aa, Artificial Sequence
  Synthetic
SELEEIVKEIKRILDEHEKKVRRNSEEMKRIVDRHAERVEKLIREIEELLRRLDELVKRG

SEQ ID NO: 23520 - protein, 56 aa, Artificial Sequence
  Synthetic
EEDLERMAREIKDRLDKIDEENKKSSEELKRELDRLDEKLRDVARRIMEAIDERTR

SEQ ID NO: 23521 - protein, 60 aa, Artificial Sequence
  Synthetic
DELREIVRRIEKILEDHARTIEEVIERIRDILRKHEKLVEEVLRRIEKLLKELEEMVRRG

SEQ ID NO: 23522 - protein, 56 aa, Artificial Sequence
  Synthetic
TEDLERMAERVKRELERLNKKAEDALREVKRALDDLDRDLKRVLEEIKERIRRATT

SEQ ID NO: 23523 - protein, 60 aa, Artificial Sequence
  Synthetic
SELERILTEIEKRIEEHERRIKENSKRMKEIVDDHERKVEEVLRRIRKLLRDLEEMVKRG

SEQ ID NO: 23524 - protein, 56 aa, Artificial Sequence
  Synthetic
REDLEKVARDVEKRLEDANRENEKSSRELKRRLDELDKKLEEEARRIKKAIDDKTR

SEQ ID NO: 23525 - protein, 60 aa, Artificial Sequence
  Synthetic
SEVDEVAKEIRRILEEHEEEIRRNSEEAKRILDEHREKLKRNSDDMRRIVKEIEDMRRRG

SEQ ID NO: 23526 - protein, 56 aa, Artificial Sequence
  Synthetic
EEDLREVAERVKKDLDRLNRENDESSKEIEKDLKRLDDRNRDVSEKLKKEIDELTK

SEQ ID NO: 23527 - protein, 60 aa, Artificial Sequence
  Synthetic
DRLREIVKRIRDILKEHEDRIRENSKRARDILREHKRKIEEVLRRIEKLVEDLERLKRRG

SEQ ID NO: 23528 - protein, 56 aa, Artificial Sequence
  Synthetic
EEDLRRAAEEVKKKLDELNEENERSSEDVKRTLKKLNDELREKVRRVMERIDEAVR

SEQ ID NO: 23529 - protein, 60 aa, Artificial Sequence
  Synthetic
DEVEDVLRKIEKILDDHRKRIEKNSRDMARIIDEHRRKVEENSREMKKLVDDLKKAVDRG

SEQ ID NO: 23530 - protein, 56 aa, Artificial Sequence
  Synthetic
EEELKEVADRVKEKLDRLNRENEKSSEELKRELDKINDENRETSERLKREIDETTR

SEQ ID NO: 23531 - protein, 60 aa, Artificial Sequence
  Synthetic
DELREVVKTIEEILRDHERKVRDNSRRMKEIIKRVKEELERVIKEAKELVERLKEAVRRG

SEQ ID NO: 23532 - protein, 56 aa, Artificial Sequence
  Synthetic
EEDLRKMAEDVKRALDKINRDNEESSRRLKKELDDVLRKVEEVIRRLEEEIDRLTT

SEQ ID NO: 23533 - protein, 59 aa, Artificial Sequence
  Synthetic
SELEKIEEDIRRILKEHKDTVRKNSEDIDRSVKEVKERIDKILKEIDDLLKELRELVER

SEQ ID NO: 23534 - protein, 56 aa, Artificial Sequence
  Synthetic
REDLERVVREVKKELDDINRENRKSSEEAKKKNDDVLAELEKRIREIKRRIDEDAT

SEQ ID NO: 23535 - protein, 60 aa, Artificial Sequence
  Synthetic
SDLEKLVEEIKRLLKELKERVTKNSEDMKREVERHKELVKKLKKRIEDLLRELEDAVRKG

SEQ ID NO: 23536 - protein, 56 aa, Artificial Sequence
  Synthetic
REDLERVVEEVKKEIDKIVEENRDSSRKLKERLDEANEELERRVEEIERRIDEKAR

SEQ ID NO: 23537 - protein, 60 aa, Artificial Sequence
  Synthetic
DELREIVTRADETLKRVADKIEENSRRMEEIVREHERKVRELLKRIEKLVRDLSAMVRRG

SEQ ID NO: 23538 - protein, 56 aa, Artificial Sequence
  Synthetic
EEDLRRVVKRVKETNRRLLEKNKDSSRKLKKRLDEANKTLADALEEVKRRIDERRK

SEQ ID NO: 23539 - protein, 60 aa, Artificial Sequence
  Synthetic
DELDEIVKRAKETVEKVKREVDANSKDIERILREHRKKVDKNSKDMEDLVRKLEELVRRG

SEQ ID NO: 23540 - protein, 56 aa, Artificial Sequence
  Synthetic
EDELREAVERLERENRKVLEENRRSSEKVKRDLDRVNRENEEVSERLKKRIDEAAT

SEQ ID NO: 23541 - protein, 60 aa, Artificial Sequence
  Synthetic
SEIEKIIKELDDLVKEDEDTIRRLEEELRELLKEIDREAKKSDEELEKTLEELAKIARDG

SEQ ID NO: 23542 - protein, 55 aa, Artificial Sequence
  Synthetic
EELRRVLERVAEDSKRTLDRLERVLKEVERRVDEALKRNKTVLDKVREDVKRLKD

SEQ ID NO: 23543 - protein, 59 aa, Artificial Sequence
  Synthetic
REIEEMIKRNEKLLEDDKRKVKRIIEKLDKVLEDDRKRAEDLIRKLEKVAEEIARLRDK

SEQ ID NO: 23544 - protein, 59 aa, Artificial Sequence
  Synthetic
EELLDTLRKVNERVARESEKTIRELEKVLERVNRESKKTIEEVEKALKEVADRVTEVRR

SEQ ID NO: 23545 - protein, 59 aa, Artificial Sequence
  Synthetic
SEIEKLIKENKDLLEEDKRRVEEVIEKLERVIEEDKRRVDEAIKRLDDVAREIERLRKD

SEQ ID NO: 23546 - protein, 59 aa, Artificial Sequence
  Synthetic
EDLLRRLERVNEEVARRSEDTIRRLREVLKKIEDDSRRTIDELREVLKRVKTRVTEVRR

SEQ ID NO: 23547 - protein, 59 aa, Artificial Sequence
  Synthetic
DDIERLIKRNKDLLDRIREEARKLIERLKKVLEDDRRKVERAIERLEEVVDEVRKLKKD

SEQ ID NO: 23548 - protein, 59 aa, Artificial Sequence
  Synthetic
EEVLRKLKKANEDVEREVRKMIEEVRRVLRKVEEDSKRTIKKLKDVLKKVAEEMEKVRR

SEQ ID NO: 23549 - protein, 59 aa, Artificial Sequence
  Synthetic
DEVEEAIKELEDALRKDREAVERMIRDLERLADEDRREVEDHVKKIEELIAAVERMSRD

SEQ ID NO: 23550 - protein, 59 aa, Artificial Sequence
  Synthetic
REVLEKLKEVLKRVEKASRKTNEDVKRVLDEVRRISEETNRRNERVVEEAKERVERVAK

SEQ ID NO: 23551 - protein, 60 aa, Artificial Sequence
  Synthetic
SEVDEVIKRLEELVERHRRKVEEVIRRLEKLAEDHERKVRELEKRLRELIKRIEELARRD

SEQ ID NO: 23552 - protein, 59 aa, Artificial Sequence
  Synthetic
SRDFDRLEDVARRVKEDLERTDEEVRRVAEEVRKRVEKTTRDVERVVREVERAIEERRR

SEQ ID NO: 23553 - protein, 61 aa, Artificial Sequence
  Synthetic
DEAREVIKTLEKLLEEHERRVREVIKRLEELIKRHEDRVREVIETLKRLLEEAEKIVRRDG

SEQ ID NO: 23554 - protein, 59 aa, Artificial Sequence
  Synthetic
SEDMRRLEEVIRKVKEALKRTNDRLREVVDEVKKRLDKTDEDATRVVEEVKKRIDEAAK

SEQ ID NO: 23555 - protein, 61 aa, Artificial Sequence
  Synthetic
DEVETVIRRLEELIREHKEKVDRIIKELEKLLRKHEEKVKKVIEELRRLAKEAADIVRRDG

SEQ ID NO: 23556 - protein, 59 aa, Artificial Sequence
  Synthetic
SRDMERLERVIRKVEEDLDRTNREVEEVIRRVEEEVERLDREAEEVVRDVKEKIDRLKK

SEQ ID NO: 23557 - protein, 61 aa, Artificial Sequence
  Synthetic
SEAEKVIKELRDIVKRNDEVVKEIIRRLEELVKEHKRLVEEIIKRLRELLKRIEEVVRRDG

SEQ ID NO: 23558 - protein, 59 aa, Artificial Sequence
  Synthetic
SEDLKRLKDVLDEVIKKTDELLREVERKAREVTKRLRDLDRRVKEVADEVRRRIREATK

SEQ ID NO: 23559 - protein, 63 aa, Artificial Sequence
  Synthetic
EEEERVKEFLDRVDTEDKKLVEELRKVVERVKRENEKLIKESEDMSKKVEDDARRLIAELRRE

SEQ ID NO: 23560 - protein, 55 aa, Artificial Sequence
  Synthetic
KEVVRKLEEYLRRSRKLVDELKKKLRELLERSREKVERSKEELKRILEEVRKKAK

SEQ ID NO: 23561 - protein, 61 aa, Artificial Sequence
  Synthetic
SVSERLRRVLERVAREVKRLIDEDRKVNEEAEREVRKLIKKDEDALKRVAEEVERLIREAS

SEQ ID NO: 23562 - protein, 59 aa, Artificial Sequence
  Synthetic
EEIIEELIRRLEEIVKRLEEKHRTTVKKIEDIIRELKKTHDKTIEDLRRIIEEIEERVR

SEQ ID NO: 23563 - protein, 59 aa, Artificial Sequence
  Synthetic
RVREELRKVLKRAAEAVERVLRKNEEVLRRAEERIRRLLEENEKSLEKVERDVTRILEG

SEQ ID NO: 23564 - protein, 59 aa, Artificial Sequence
  Synthetic
EEKVKKLIREIEEVIDRLRRESEKHIEEIKEIITRLDKEVKDHDERLKREVDKLEERAR

SEQ ID NO: 23565 - protein, 60 aa, Artificial Sequence
  Synthetic
SVEERLRKVLEEVRRLLEKIIKDNREVLKRAEEKVRELIKRDKDVLDRIAEEVERLKEKG

SEQ ID NO: 23566 - protein, 59 aa, Artificial Sequence
  Synthetic
EEKVDRLIEELKKLIDDAREKNERHIEEIERIIDDLRRKHEETARRLKEAIDRLREEAQ

SEQ ID NO: 23567 - protein, 59 aa, Artificial Sequence
  Synthetic
DKEERIERVLKRVEEELKKLKERIEEVLKKVEDMVRKNLEEIRKVSEDHERTVREIRKR

SEQ ID NO: 23568 - protein, 59 aa, Artificial Sequence
  Synthetic
EKVVEEIIKELERLLEDLKRRADELIKRLEKLVEEHHRKVEELVRRLEESLDKVRRDAK

SEQ ID NO: 23569 - protein, 60 aa, Artificial Sequence
  Synthetic
SEDEKVKRVVEKVKEESDRLNEELKRVVDEVRKELERLIEKIKRSVERMDRTVRELLKRI

SEQ ID NO: 23570 - protein, 55 aa, Artificial Sequence
  Synthetic
DRVVEKLKKALDESRKTHKKLIDDLRRALEELEKRVEDLNRENERLLDEIKKRVD

SEQ ID NO: 23571 - protein, 59 aa, Artificial Sequence
  Synthetic
DVERKIEEVVRDVKRELDRLLEENRRSVERVERALDKLLEDSRRVVEEVKKALDDLRRR

SEQ ID NO: 23572 - protein, 59 aa, Artificial Sequence
  Synthetic
ETDVKKIIEDLRRLVREVEEHSRRTNRRLEELVKDLARHAKRSIDRLKELVDRARERAR

SEQ ID NO: 23573 - protein, 59 aa, Artificial Sequence
  Synthetic
DVEKDIERVVEDVKRELRRLLKEDRDVSKKVKDDLDKLLKESEEVVRRVKKELDRLREE

SEQ ID NO: 23574 - protein, 59 aa, Artificial Sequence
  Synthetic
KSAVDEIIRRLKELVKEMKRHVDKSIKDLEELVRRLEEHIRRSIERLKKLVEEAREDAR

SEQ ID NO: 23575 - protein, 59 aa, Artificial Sequence
  Synthetic
SVEEEVDKVVKKLEEDLDRLLEESKEVVERVEKALDDLLKRDEDVSEEVRRELERLKEE

SEQ ID NO: 23576 - protein, 59 aa, Artificial Sequence
  Synthetic
ESMVKKLLDELRKLVEDAREHVERSIRELEKLVKEADDHVRKSIEDLKRLVEEVRETAR

SEQ ID NO: 23577 - protein, 59 aa, Artificial Sequence
  Synthetic
DVEKEIKDVVDKAKRELDRLLREDREVSREVKEALDKLLEDNRRSVERVERELDDLRRR

SEQ ID NO: 23578 - protein, 59 aa, Artificial Sequence
  Synthetic
ESVVKEILKRLEKLVEDAKRHVEDSIRKLKKLVDDMRKHSERSNRDLERLVREAREKAR

SEQ ID NO: 23579 - protein, 59 aa, Artificial Sequence
  Synthetic
SVEEEIRKVVEEVKRELDRLLEKNDRSVKEAKKELDRLLEENRRAVEEVKKALDELEKN

SEQ ID NO: 23580 - protein, 59 aa, Artificial Sequence
  Synthetic
ESEAKRLIDRLRELVKRVAEHSERSDRELKKLVDDLREHSKRSNDDLRRLVEEAEREVR

SEQ ID NO: 23581 - protein, 59 aa, Artificial Sequence
  Synthetic
SVEDKVREAVRRAKEALKKLVEDDRRVVKEVEEMLDTLLDKNRDSVRRAKEKLEDLKRK

SEQ ID NO: 23582 - protein, 59 aa, Artificial Sequence
  Synthetic
ESDAERLIETLERLVKELEDHVRRSIRKLRELVEEMRDHSRRSDEELKKRLKEVEDRVR

SEQ ID NO: 23583 - protein, 59 aa, Artificial Sequence
  Synthetic
DVEEEIKRVVKKVEEELDKLLEDDERVVREVEEMLDRLLKKNEKVVRDAKRKLDDLRRK

SEQ ID NO: 23584 - protein, 59 aa, Artificial Sequence
  Synthetic
KDVVDKIIETLRRLVKEVAKEVKRSIDELKKTVEEVRKHSEETDRRIEKLAKEAEEEVR

SEQ ID NO: 23585 - protein, 59 aa, Artificial Sequence
  Synthetic
SVEEKIREVVERVRRMLEKLLEDNDRSVKEASKALDDLLRESRRVVEEVKKALDDLRRK

SEQ ID NO: 23586 - protein, 59 aa, Artificial Sequence
  Synthetic
ESEVRRIIRELEELVKRATDHVRRSDKRLRELVDELRKHIRKSIEDLKRLVDEARRRKD

SEQ ID NO: 23587 - protein, 61 aa, Artificial Sequence
  Synthetic
DEVEEIRKELEKLLEEVRRKLEKIIKDIRDLLREDKRKSERIDRELEKLLRRLEEIVRDRG

SEQ ID NO: 23588 - protein, 59 aa, Artificial Sequence
  Synthetic
EEMLREVKRVLEEVRRDIERLLEEIRKVVEEWRKRLEDLKKKNEDSAREVKRRIDELRK

SEQ ID NO: 23589 - protein, 61 aa, Artificial Sequence
  Synthetic
SEVEDIIRRLRELLERHREVSKRINDELRKLLREVEEDSRRLDKEIEDLLRRIREKVTRDG

SEQ ID NO: 23590 - protein, 59 aa, Artificial Sequence
  Synthetic
EDARRRVERVLREVEDTLRKLDKENEDSARRVKEALDRLLKKNEESIRRAEREIDELRR

SEQ ID NO: 23591 - protein, 61 aa, Artificial Sequence
  Synthetic
DDVEELKKEIKKLLDDHKKLSKELNEDIERLLREHRKLSEEIDRRLEKLLKELEELVRREG

SEQ ID NO: 23592 - protein, 59 aa, Artificial Sequence
  Synthetic
KELLDEVERVVREAKKTLDRVDEENKKSIEDAERELERMDRKNEKSVEDVRRTAKELLR

SEQ ID NO: 23593 - protein, 61 aa, Artificial Sequence
  Synthetic
SEAEEIIRRLEELLKKLKKDSDRLDEEIKRLLDENRRNSKDINRRLKKLLDDLRRLVRERG

SEQ ID NO: 23594 - protein, 59 aa, Artificial Sequence
  Synthetic
EDVLRRVEEALRRAEEDLKRLKEKNDRSLKEWRDTIRELKRENEESLRRVKEEADRLSK

SEQ ID NO: 23595 - protein, 61 aa, Artificial Sequence
  Synthetic
SDVERIIEELERLLEDLERRSKRIDEELKRAADRNRRNVEEIIRRLEDLLRRLEELVRRDG

SEQ ID NO: 23596 - protein, 59 aa, Artificial Sequence
  Synthetic
KDVLREVRRVAEKVRRSIKELKERNEKSLRDWKREVDKLLKDIKKVLDEVRKAADDLRK

SEQ ID NO: 23597 - protein, 61 aa, Artificial Sequence
  Synthetic
REVDEIRRRLEKEVERNRRNSKRIDDELKEMADRNRENVKRSIEEIKELLKRLKELVDRDG

SEQ ID NO: 23598 - protein, 59 aa, Artificial Sequence
  Synthetic
EDVRREVERVLKEWEDDVRRLLRKNEDSLREWREKLKKLVREHREVTKKAEEVLRELLR

SEQ ID NO: 23599 - protein, 61 aa, Artificial Sequence
  Synthetic
KDAEDIIRKLDELLDELAKAAREIIERLRDAARENEENSREINRRLEELLKRLEDAVRRDG

SEQ ID NO: 23600 - protein, 59 aa, Artificial Sequence
  Synthetic
EDVKRKVEEVARRVRKAIDDLLRDIKRVLDDWKRKVDKLLEDNRKSLEDVKREAERLRK

SEQ ID NO: 23601 - protein, 60 aa, Artificial Sequence
  Synthetic
SEVERLIKELEDVSRDIKREVTELKRDLKRLAEESKRLVEELEETIRKIVKDIEDTKRRG

SEQ ID NO: 23602 - protein, 59 aa, Artificial Sequence
  Synthetic
KELVDRVEEALRDHERTLRKVVKEVDKALKDLERDNTELVKRVKKVLDELRRDVEEKAK

SEQ ID NO: 23603 - protein, 60 aa, Artificial Sequence
  Synthetic
DMERKLDTVLEEVRRVVTRAKEANDRVLKDAKRVVEELSDRNRRVLEDAKRVVDELKEKR

SEQ ID NO: 23604 - protein, 59 aa, Artificial Sequence
  Synthetic
DEVVDKLLKKLKETLRRMEKESEELLRETEKILRELEKEVEDHLRTVEKTLEDLRREVE

SEQ ID NO: 23605 - protein, 57 aa, Artificial Sequence
  Synthetic
SEVDKILEDSKRKLEEVEEMVRRLLKKSRDLLEKLERDVERLIRDSERRLEEVARAK

SEQ ID NO: 23606 - protein, 59 aa, Artificial Sequence
  Synthetic
KDLRRKLKEVHDRSRRVIEKLREELEKVHDEARKVVEKITEKIERAHDKSRRLLEEIKR

SEQ ID NO: 23607 - protein, 56 aa, Artificial Sequence
  Synthetic
SEVDEFVKRSEDLLKKLEEDVRRIVRESERLLEEVERRVRKILRDLEKKLEDAERE

SEQ ID NO: 23608 - protein, 59 aa, Artificial Sequence
  Synthetic
KELRDKLEEAHRKVKEKVERLMEDLKRAHDESEKKIRDLKRKLREVLERLRKRVEEIKK

SEQ ID NO: 23609 - protein, 60 aa, Artificial Sequence
  Synthetic
DLEKRLEEAIRENRDTIRRLAKELERVIEDNKRRLEELKKEIKKVIEELERELRRVRKDG

SEQ ID NO: 23610 - protein, 59 aa, Artificial Sequence
  Synthetic
REIVDELVRRLKKHSDEARKTVEDLRRKSKKSLREAEETVKRLVEEIERLLEEIKETMR

SEQ ID NO: 23611 - protein, 60 aa, Artificial Sequence
  Synthetic
SEVDELVKKIEDSERRIEEKVKRIEDELKESEERIRTKVRELHKENEKLLEEIRRKKKDS

SEQ ID NO: 23612 - protein, 59 aa, Artificial Sequence
  Synthetic
DELRKTLKDALKRHEEVLKRVEERIRRVLKRHEEVLREAEERIRRSLEKLKRDADRVAK

SEQ ID NO: 23613 - protein, 59 aa, Artificial Sequence
  Synthetic
DEVEELVKELRDSLKRIREVAKELHDRNKELLDRIKRLVDELLKEIEKVLKEIEETKKD

SEQ ID NO: 23614 - protein, 59 aa, Artificial Sequence
  Synthetic
EEVRRKLEEAVREHERELERMAREIRKSLEDLKRVLEEVAERIKEVLRRLEKRVKEVED

SEQ ID NO: 23615 - protein, 60 aa, Artificial Sequence
  Synthetic
DEVEELVERLRRSLEKIRDRVRRLLERIKRLAEKIKRDIERLHKKNEDLAREMRKSERKS

SEQ ID NO: 23616 - protein, 59 aa, Artificial Sequence
  Synthetic
EELRKKLRKVVEDHKRVLEEVKDRLTKVLRELEEVLEKVKRDIKKSLEDLEKVLRELEK

SEQ ID NO: 23617 - protein, 59 aa, Artificial Sequence
  Synthetic
SDVERLLTKLKEVAKDLARIVKRLDEENEKLSEKAEREIRKLDRDNERLLEELEERKRR

SEQ ID NO: 23618 - protein, 59 aa, Artificial Sequence
  Synthetic
DRLRKKLKEVLDDLRRVLEELKDHIRRSLDKNRRSLEELEEHIRRSLTELRRRLEELAK

SEQ ID NO: 23619 - protein, 60 aa, Artificial Sequence
  Synthetic
DEVRELLERIEDEIRRIREEIKKLDEDNKKLAEDIRRKIEELDKENKELLKRIEDKKRES

SEQ ID NO: 23620 - protein, 59 aa, Artificial Sequence
  Synthetic
DEVRDRLRTILKKLREMLKEVKDRIDDSLRRLREVLDEVAKHIERSLKELKDRVREVEK

SEQ ID NO: 23621 - protein, 60 aa, Artificial Sequence
  Synthetic
SDKEEIKKVVDDVRRDIRRLEKELRDLNERFRKRVEELKKRLEEVNDRARREVERLKSRI

SEQ ID NO: 23622 - protein, 56 aa, Artificial Sequence
  Synthetic
VDTLKRRLEDVLRKAREEVEKWKEDLERLLREAERRVREYEEDTRRLLKELEDETR

SEQ ID NO: 23623 - protein, 56 aa, Artificial Sequence
  Synthetic
NVEDEVRRVVTELEKTLREVLKRSKEALDRLRETLERLLKELEDVHREANEDLTRL

SEQ ID NO: 23624 - protein, 59 aa, Artificial Sequence
  Synthetic
ESVVKRLVRELERLLREVEKHLEDSKRELEDLLRRLRERLEELKKRHEDLLREAREETR

SEQ ID NO: 23625 - protein, 57 aa, Artificial Sequence
  Synthetic
SLEETIEEVVRRNKETLDRARKKSEDVLRELERVLRELKRRTDEVARKLKEELDKLD

SEQ ID NO: 23626 - protein, 59 aa, Artificial Sequence
  Synthetic
EDVVRRLLEELERLSRDLERHVKRSEEEARDLLRKAREHVERSVKEIEDLLEDLKREAT

SEQ ID NO: 23627 - protein, 57 aa, Artificial Sequence
  Synthetic
SLEETVRKAVRRNRETLRRLKRESEEAVKEAKEVLDRLREETERVLRKLEKRLRELR

SEQ ID NO: 23628 - protein, 59 aa, Artificial Sequence
  Synthetic
KSMVDELLRTLEKLSDEIRRHVEKSKEDLERLLRELKKHVKRSVEEIEKLLEKLDKEAN

SEQ ID NO: 23629 - protein, 61 aa, Artificial Sequence
  Synthetic
SEVDEILKRIKEVLKRNKENVERIKKRIKEELDRNRKNVERILRTIEKLLKELEDIARREG

SEQ ID NO: 23630 - protein, 59 aa, Artificial Sequence
  Synthetic
EELRKKVKEVMDRWRETLDRLREEVERVLEDWRRKLEELRRRVEKVLRDAERVIKKVEE

SEQ ID NO: 23631 - protein, 57 aa, Artificial Sequence
  Synthetic
SEREEIERVLDENRRSLEELEREVEDALRTWEEELKKVEEAVRKVLEDVRRELEKDL

SEQ ID NO: 23632 - protein, 56 aa, Artificial Sequence
  Synthetic
VEKIKTEVDDLSRKLRETVERLKTELKKVIDRNRKTLEDLERRARKLIKEARDAAK

SEQ ID NO: 23633 - protein, 57 aa, Artificial Sequence
  Synthetic
REREKIEDLLRRNEKSLRDVARAVERILEEWRKVVEDLTERNKELLKEVEKVVRELL

SEQ ID NO: 23634 - protein, 56 aa, Artificial Sequence
  Synthetic
VDEIAKELKRLSDKLREMLKRLTDKAKRLIERNEKTSRDNERELRKLIKEAEDAAT

SEQ ID NO: 23635 - protein, 60 aa, Artificial Sequence
  Synthetic
SKEERLERLIEENKKSLDELSKRVEEVIKENKDVLKRLKEKIERLIEKNRRELERLKKDV

SEQ ID NO: 23636 - protein, 55 aa, Artificial Sequence
  Synthetic
EELERELRDHSRRLKEIVERIERKVREHIRELEKIVKEVEREVEEHIEKLERTVR

SEQ ID NO: 23637 - protein, 59 aa, Artificial Sequence
  Synthetic
SDEDRLRELLKKNRESLKRLSDEIRRLIEENRDALRRVKETIKELLRKLKEVVERVRKD

SEQ ID NO: 23638 - protein, 55 aa, Artificial Sequence
  Synthetic
EEVRKTLEEHSRDLRRKVEELAREVKRHIRELEKILKEVKDEIEEVIRRIEETAR

SEQ ID NO: 23639 - protein, 59 aa, Artificial Sequence
  Synthetic
SEIEDAAEKVRRNSEEAKRILDEHRERVKRVLEEIERLVKRAEERIEELIRTIERLRKD

SEQ ID NO: 23640 - protein, 59 aa, Artificial Sequence
  Synthetic
EEVRKKLEDILRKNEETSREIKKRLDRIDDDLRRVLEKAAKRLRDLLEKLREAVRRVET

SEQ ID NO: 23641 - protein, 59 aa, Artificial Sequence
  Synthetic
SEIEKVKKEVEENSREAKRIVDEHKRLVEENSKEMEKLLKEAEDTIRKLLKEIKELKDR

SEQ ID NO: 23642 - protein, 59 aa, Artificial Sequence
  Synthetic
ERMREKLRRALEENRRTSERLKRKLDDIDRDNERTSREVKEKLKRILEELKRTLEEVER

SEQ ID NO: 23643 - protein, 59 aa, Artificial Sequence
  Synthetic
SEIDKARDEVRKNSDEMRKIIERHREKVEDNSRRMKETVRRVEEEIERIIREIEELKKR

SEQ ID NO: 23644 - protein, 59 aa, Artificial Sequence
  Synthetic
RRLREELRRIAEENKKTSDDLKKRLDRIDKENERTSEELKEENDRLLEKLRRAADRVKR

SEQ ID NO: 23645 - protein, 59 aa, Artificial Sequence
  Synthetic
REIEEFEKDVRRNSEDMERIAREHEKLVRDLLRELKRLVDDLKRRLEELAEEIKSLREQ

SEQ ID NO: 23646 - protein, 59 aa, Artificial Sequence
  Synthetic
ERLRERLKRILDKNKETSDRIKKRLEDLNRELERVARELKKTIDELLRELEEVVERVRK

SEQ ID NO: 23647 - protein, 60 aa, Artificial Sequence
  Synthetic
SLEEEVKKLLEELKKVADKLTKEVREADKKLEEVLRRVKRRLDEVDRRLEEEIKKVKSRI

SEQ ID NO: 23648 - protein, 59 aa, Artificial Sequence
  Synthetic
EELLERLKRRIDRLIEEARRLVEKWRDELKKLIDEVRKLVEDHERKVRDIEKKVRDESR

SEQ ID NO: 23649 - protein, 59 aa, Artificial Sequence
  Synthetic
DAEEKARRVLEELDEALKRLAKKIKESIDKLKDVLRKLAEIIKRSLDELDEVLKRLASK

SEQ ID NO: 23650 - protein, 55 aa, Artificial Sequence
  Synthetic
EEILEELRRALEELKREVDELDRRNEEALERLKERVKRLNEDNRRTLERLEREVD

SEQ ID NO: 23651 - protein, 60 aa, Artificial Sequence
  Synthetic
DVEELLRRLLEELRRVVKEVEDINRRSLEEARRVLKRLEDDHRRVLKELEDVLERLRRQG

SEQ ID NO: 23652 - protein, 59 aa, Artificial Sequence
  Synthetic
RETIEELLRKVDRDLKRIRTTSEDLVRKNEELLEKLERESRRVVEESRKRLKEAEERTR

SEQ ID NO: 23653 - protein, 59 aa, Artificial Sequence
  Synthetic
SVEEKLKDLEKENKDSLDEIRKLNEDSLEEAKRVLKKLEDTHRTVLRKLEKVLDELRKR

SEQ ID NO: 23654 - protein, 59 aa, Artificial Sequence
  Synthetic
DDAIRKLRKKVEDTSRDLKRTSDDLVRRNRKLLKELEEESRKVVKESDEILRKMKEEVR

SEQ ID NO: 23655 - protein, 60 aa, Artificial Sequence
  Synthetic
SVEEKLDELEKRIKEVLERIERINEESLRRAEEVLRDLEETNRRALERVRDVLRRLEERG

SEQ ID NO: 23656 - protein, 59 aa, Artificial Sequence
  Synthetic
DDAIRKLLETVDRRLKELTETSKRLVEENRDLLRRAKEESKRLVDESEKVLEEMDRETR

SEQ ID NO: 23657 - protein, 59 aa, Artificial Sequence
  Synthetic
SADETLEELEKELRRVVDEVRRTNEEANKRLREVLRKLEKKNDDVLRDLERVLKELEDR

SEQ ID NO: 23658 - protein, 59 aa, Artificial Sequence
  Synthetic
EETIKKLREDVKRELDRIKTSSKKLVDDIERRLRRMEEESRKLAEDSRRILEEMRKEVT

SEQ ID NO: 23659 - protein, 56 aa, Artificial Sequence
  Synthetic
SEVEKLVDEIKKELKRLRETSKKLLDEIRELLERLKRSSKKLVDDIKRILEELKRR

SEQ ID NO: 23660 - protein, 56 aa, Artificial Sequence
  Synthetic
KDKLEKALRDARKVVEDIERTNREILKRVRDMVERIREDNDTVLEEVERMAEEVRK

SEQ ID NO: 23661 - protein, 61 aa, Artificial Sequence
  Synthetic
REIEELKKKVEKVLRELRKSSEEMKRRVEDLIRRLKKSSKDLERKVKDLLKKAEEKVRRDG

SEQ ID NO: 23662 - protein, 59 aa, Artificial Sequence
  Synthetic
EEARRRLEEVVRRLRKVLDDVRKINKEVVDRLKKALDEVKRTNEDVVRDLRKVLEELKT

SEQ ID NO: 23663 - protein, 59 aa, Artificial Sequence
  Synthetic
SEIEKLKEEIRRLLEEIKRHAEENKRRVETALRDIERHVEENTRRVAKVEEEIKKLKDR

SEQ ID NO: 23664 - protein, 56 aa, Artificial Sequence
  Synthetic
KDELDKVEEEAKRVAEEVKEIHDRVLEEVRRVVDRVLKAHDEVLRRLERVVREVKR

SEQ ID NO: 23665 - protein, 60 aa, Artificial Sequence
  Synthetic
EEEKRLRELEKRNEDVIRKAAEDVREILRKNEEVLKEAEDRIKRLIDEDRRVLEEVKRDD

SEQ ID NO: 23666 - protein, 55 aa, Artificial Sequence
  Synthetic
EELEREVRKHDKEVKEVIDRLREKSERHIREIERIVDELRKKHEATVRKLKKDVK

SEQ ID NO: 23667 - protein, 60 aa, Artificial Sequence
  Synthetic
DEDETLRELEKKNDKALDDARRTIEEVIRRNEEVLKRAAEEIEKLERKNKRVLEEVKRRD

SEQ ID NO: 23668 - protein, 55 aa, Artificial Sequence
  Synthetic
EELAEEVKRHDDRVRKEIEKLKREVEKHDREVKETIDRLAKKVDDHLKELRDTTR

SEQ ID NO: 23669 - protein, 59 aa, Artificial Sequence
  Synthetic
DEIKEIEETVERLVEELKRIVEEWREESKRNVDELEKRIRDIKRRIDEAIKTLEELKRR

SEQ ID NO: 23670 - protein, 60 aa, Artificial Sequence
  Synthetic
VEELRRALDELLEKARKVVEEVEKMIKEVNDRNKKVVDELKRTLDKILKDLEEVAREVDR

SEQ ID NO: 23671 - protein, 59 aa, Artificial Sequence
  Synthetic
SEIEKMKRDSDENIKRMEEIARKWEKESRDNIREIEKRVEDLKRRIEKVIREIEKLRRD

SEQ ID NO: 23672 - protein, 60 aa, Artificial Sequence
  Synthetic
LEEAKRKLEEVLDKNRRVVEKVERRIDRINDRNREVLERAEKELDDILRKLEEVVRRAEK

SEQ ID NO: 23673 - protein, 61 aa, Artificial Sequence
  Synthetic
DEIREAKKRLDDIVTELRDHIRRSKERHERLVKELERHIRELEKKVRELIKRLDDAVRRDG

SEQ ID NO: 23674 - protein, 59 aa, Artificial Sequence
  Synthetic
EEVKREITRLLEDLKRVSREHREEIRKLLETTREVSKRHREKVEDLLRKLEEVLERVRT

SEQ ID NO: 23675 - protein, 56 aa, Artificial Sequence
  Synthetic
SELEEIARLAEEIERKLRESLRESDKMHKKLNKENEDLLEKIRKEVEDIIKKLRDL

SEQ ID NO: 23676 - protein, 59 aa, Artificial Sequence
  Synthetic
ERVEEAVRRVVEKIKDVVEKHSDASRRLNEELKESVDRLRREVEKLVEKIRKVVEDLRK

SEQ ID NO: 23677 - protein, 60 aa, Artificial Sequence
  Synthetic
SDLERVEKESRDHIDTLRRIVERVEEHVRRSIKTLDELVDRARRSVERLIEELEEMKRKD

SEQ ID NO: 23678 - protein, 59 aa, Artificial Sequence
  Synthetic
RRVEEELRRLLEENRRVVEEVEKELDRLLKESEDAVRRVEEALDRLLKELERVAKEVKD

SEQ ID NO: 23679 - protein, 60 aa, Artificial Sequence
  Synthetic
SDLEKVKKDSDDHIRELERLVRRAEEHVRDSVRRLREIVEELDRDVRRLIEELKDLKRKI

SEQ ID NO: 23680 - protein, 59 aa, Artificial Sequence
  Synthetic
EDVKKKLDDLLRENREAVKRVERALDKLLTDDRRVVEEVERALDELLKRIEKVAREVEK

SEQ ID NO: 23681 - protein, 60 aa, Artificial Sequence
  Synthetic
RDVDELRKESEDHIRELRKLVEDVRRHVKRTNDDLERLVKEVDDTLKELIKEVKELKRRV

SEQ ID NO: 23682 - protein, 59 aa, Artificial Sequence
  Synthetic
EDVKKKIKDLLDTNREVVERVLRTLRDLLRRNKEVIDRILETLDELLERVKREIEKDAK

SEQ ID NO: 23683 - protein, 60 aa, Artificial Sequence
  Synthetic
DDAERAKEESERHIKRLKDLVEELRKHSERTDEEIKELLRRLEKTVRDLIRELERLKEEI

SEQ ID NO: 23684 - protein, 59 aa, Artificial Sequence
  Synthetic
EDVKRKLDKLLKENEDVVREVDRALKELLRKNAEMLERAKERLDRLLEEVKKVADEVRR

SEQ ID NO: 23685 - protein, 60 aa, Artificial Sequence
  Synthetic
SIEEELERLLRKNEDSLRRVRDEIRRLEEEIRRVLKKWRDEARKLLREIERVLKEVAERK

SEQ ID NO: 23686 - protein, 59 aa, Artificial Sequence
  Synthetic
ETLLRDLERKSKEVDERLEELLRRAKERVEELIREIEALLDRNRRNVERLIRELERRTD

SEQ ID NO: 23687 - protein, 61 aa, Artificial Sequence
  Synthetic
EELERLLEDVKRTLKELRDRAKEVLDRVRKTLEELKRELKRVLDEVTELLERLRRIVKREG

SEQ ID NO: 23688 - protein, 56 aa, Artificial Sequence
  Synthetic
KRIIKEARERVETVNRETKKILEEIARTVEKVDEESRRILEKVKRDAERVLREIKK

SEQ ID NO: 23689 - protein, 60 aa, Artificial Sequence
  Synthetic
DELEEVEKEVKRILEESRRLLEELEREVRELLERSKRILEELEEEVRRLLEKLKRVRTRG

SEQ ID NO: 23690 - protein, 55 aa, Artificial Sequence
  Synthetic
EELERLKRELDKVHEEVREKVERAKRELERVHKRSEEEARRLKEEVDKVLDELRK

SEQ ID NO: 23691 - protein, 59 aa, Artificial Sequence
  Synthetic
SELDELRKRVEEIVEENDRVLRELEKRVRELSERNKKTLKELTKRVREILERLKELKDR

SEQ ID NO: 23692 - protein, 59 aa, Artificial Sequence
  Synthetic
EEVKEVVRRLEEKVKESLDRAEKVLRRLEREARESNRRHEEEVRRLKEEIDRVVTELRR

SEQ ID NO: 23693 - protein, 58 aa, Artificial Sequence
  Synthetic
SLEDVLREVEERIRKSLEEHRKVTDEAEKELRRIVEDHKRVLEEVKKEIEDVIKELKK

SEQ ID NO: 23694 - protein, 60 aa, Artificial Sequence
  Synthetic
KEKVAREIRETVKKLHEDNRRMSEEIKKTVERLLDKLRRSLERIRREAKDLVRKIEDLRR

SEQ ID NO: 23695 - protein, 58 aa, Artificial Sequence
  Synthetic
KLEEVLRKVAEDIKRSLEDLKRVLKEVADHIRRSLEELRRVLERVKKEIEDVLRELEN

SEQ ID NO: 23696 - protein, 60 aa, Artificial Sequence
  Synthetic
ADKVAEDIRRDVRRLDEENRELAERIKRAIEELDRKNKDLARRIEDAVRRLLEKIKEAVR

SEQ ID NO: 23697 - protein, 58 aa, Artificial Sequence
  Synthetic
DLEEVLKEVEKRIRDSLKDLKRVLDEVLDHIRRSLKENRDSLRKLEEDLRRVLEELRR

SEQ ID NO: 23698 - protein, 60 aa, Artificial Sequence
  Synthetic
EKKVAEKIRKEVKELDEKNKELARRIRDVAKKLDERNKDVSRRLAEEVERLLRKIKEKVR

SEQ ID NO: 23699 - protein, 58 aa, Artificial Sequence
  Synthetic
DLERVLEKVARDIEESLRRNKESLKRLKEHVEESLKENRKSLEDLRKKLKDVLDELKK

SEQ ID NO: 23700 - protein, 60 aa, Artificial Sequence
  Synthetic
KKKVADKIREEAKRLDKENREASDRARDVVRRLDEKNKKLSEEMKRTVERLLETLDRKMR

SEQ ID NO: 23701 - protein, 58 aa, Artificial Sequence
  Synthetic
DLERFLEEVARKIEKSLEELRRVLEEVRDRIRRSLEENTKSLERLTEEVRRVLERLKD

SEQ ID NO: 23702 - protein, 60 aa, Artificial Sequence
  Synthetic
EDKVAKEIEDEVRRLDEKNRKLAKEIRDEIRKLDKENKDLSKELRDRVEELLRKIEETVR

SEQ ID NO: 23703 - protein, 59 aa, Artificial Sequence
  Synthetic
KAAEEIRKKVEDYKRESEKILEEVEDHSRRSKETLKRLLDDLRRAVEELKRRLEELKRR

SEQ ID NO: 23704 - protein, 56 aa, Artificial Sequence
  Synthetic
REVADELKKRLKRANEESERVLRELAERNKTALEEAERVLRRLKEEIEKVLRKLKK

SEQ ID NO: 23705 - protein, 59 aa, Artificial Sequence
  Synthetic
SEVEDLRRRVEEIKRRVEEILRENKEVSEKSIRELERLLEELKRLVDELLKRLEELKRE

SEQ ID NO: 23706 - protein, 59 aa, Artificial Sequence
  Synthetic
DDLRRALKDVVDEVKKVVDELREENDRLRKENKRAVDEVRKELERLLRDVERVIRRAEK

SEQ ID NO: 23707 - protein, 59 aa, Artificial Sequence
  Synthetic
EELDRLRRHADESRKRAEEILKRNEEEIRRLVEELKRILKTNEDVLRDLEKKLEDLKRR

SEQ ID NO: 23708 - protein, 59 aa, Artificial Sequence
  Synthetic
DKLRTTIDEVRRRSKKVLDDLRDRNRRLLEEVDRAIKEVRETNEELLRRLKRVIDEVRR

SEQ ID NO: 23709 - protein, 59 aa, Artificial Sequence
  Synthetic
SAEELLRTIEKRIEDNHRRLEEILEEIARLIEDMLRTDERIVREIKELLKEVLDRVRRA

SEQ ID NO: 23710 - protein, 59 aa, Artificial Sequence
  Synthetic
EEVVKKLVEDVERELERSLREAEDLLRRVEEVIRTSKKESKDVLEKIERLLRDLERRTR

SEQ ID NO: 23711 - protein, 59 aa, Artificial Sequence
  Synthetic
SVAEELKKEVDDLLRDLKKKLDDVRRDHERLLRELEEHLERSRERVERLLRTLEDVARK

SEQ ID NO: 23712 - protein, 56 aa, Artificial Sequence
  Synthetic
RKVIEKIERDIRKILKEVEEVLRTLKKKSDEILERAKRVTEKIERDVTEILERIKK

SEQ ID NO: 23713 - protein, 59 aa, Artificial Sequence
  Synthetic
SVADELRKTAEELLKRLREHLDTSRRRVEDLLRRNEKKLRDVLREVKKLLDELRELKER

SEQ ID NO: 23714 - protein, 56 aa, Artificial Sequence
  Synthetic
EDVIREIKDRVRRILDEARRVSEKLRRDVEKINRESREVLERIKELIKRILKEAKD

SEQ ID NO: 23715 - protein, 57 aa, Artificial Sequence
  Synthetic
SELEELLREVDDSLKKLETEAKKLLDEVRDSLRKLEETLRRVLREVEEELKELEKEN

SEQ ID NO: 23716 - protein, 59 aa, Artificial Sequence
  Synthetic
KRVEDVLREIRRRAREINERLKKILKEAKEVAEKVNEETRRVLKEIKELIERVLRELRK

SEQ ID NO: 23717 - protein, 60 aa, Artificial Sequence
  Synthetic
REAEEAKEEVEELNRRNKKELDDARRRVDELDKRNKDRLKESSDRVKRLVEELERVKEEG

SEQ ID NO: 23718 - protein, 56 aa, Artificial Sequence
  Synthetic
KDVLKRLAELIKESIRELERVLEELAEKIDRSLKELDDVLRKNETDLKRVIEDLKR

SEQ ID NO: 23719 - protein, 60 aa, Artificial Sequence
  Synthetic
DEAEKAKRDSEKVVEDNRKMLEDSTRRAERLNEENKKELKKSTEEAEKILREIDETKRRG

SEQ ID NO: 23720 - protein, 56 aa, Artificial Sequence
  Synthetic
DEVLKRLKEEHRRLIEELEEVLRRNEEIIRRSIEDLERVLDRNRRELEDVIRRLKE

SEQ ID NO: 23721 - protein, 60 aa, Artificial Sequence
  Synthetic
REAEEVERKVEELNRRNRKVLDDARKESEEVVRRNREFLRRLEERVRTILRELDKRKRDG

SEQ ID NO: 23722 - protein, 56 aa, Artificial Sequence
  Synthetic
DEVLRRLAEDIERSIRELEKVLRELERIHRELIKELKEVLKRLEKDAKEVIERLRT

SEQ ID NO: 23723 - protein, 61 aa, Artificial Sequence
  Synthetic
SLAEEIDKTIRELAKRHEKTVEDIKKIITELEKKHRDTAEELERIVREIEKKIRELKKRLK

SEQ ID NO: 23724 - protein, 59 aa, Artificial Sequence
  Synthetic
EELERVLREAEETLRRLIEKDEKVNREADEKSERLIREDEKVLEDVAREVERLLRELDK

SEQ ID NO: 23725 - protein, 61 aa, Artificial Sequence
  Synthetic
DEDREARELVERLREEHRRTAEEIKKIIEDLERKHRETMERLKRIIEKIERDIRRLKRDLK

SEQ ID NO: 23726 - protein, 59 aa, Artificial Sequence
  Synthetic
KELERVLEKVARDLKKLVDDDRRVNETANRRSRKLIEDDKRVLEEAAKEVKRLLDELDK

SEQ ID NO: 23727 - protein, 56 aa, Artificial Sequence
  Synthetic
DTERTVKEKIRKWKEDVERVERRLEELVDRARKLSKENVDRMRELVRRLEDRVRKD

SEQ ID NO: 23728 - protein, 56 aa, Artificial Sequence
  Synthetic
REVLEDARRKIDELNERVERVAETVRRKLDKILEDNKRVVERVKEEIRRVLEELER

SEQ ID NO: 23729 - protein, 59 aa, Artificial Sequence
  Synthetic
SEEEVLREAAKTVEKLLDEIRRSLEKVSKRVEDSNRELKESLDRVRERVRELLEELRKN

SEQ ID NO: 23730 - protein, 56 aa, Artificial Sequence
  Synthetic
KDDVERTLREIAKLVDEVDKENKRALRENEERVKTLNRENEEMLKRIEEEVRRATK

SEQ ID NO: 23731 - protein, 59 aa, Artificial Sequence
  Synthetic
DLEEVAKEVKKALDELLKRNEDSARRVKEAIRELLKRINDVTREVEETLDRLLKEVEDG

SEQ ID NO: 23732 - protein, 60 aa, Artificial Sequence
  Synthetic
AERVVKRLEELLREAAEHSKRSNDELERLLDRLRREVERYERELEKRKKEAKELADKLRK

SEQ ID NO: 23733 - protein, 59 aa, Artificial Sequence
  Synthetic
DLERRLDELLKRIEDRVRELVRTLEESLRELERRVREIIRRLEEHLRRIEKMVRDLKRA

SEQ ID NO: 23734 - protein, 56 aa, Artificial Sequence
  Synthetic
ERVIKKAEEDVRRLLREIEEVSERHKREVDRLEREIEEVSREHKERVEKLLREIER

SEQ ID NO: 23735 - protein, 59 aa, Artificial Sequence
  Synthetic
KLEEDLKRILDELRRMAKEIIDRLEDHLRKIKKDVDKLSKENKDHLKEIEDTVRELKRN

SEQ ID NO: 23736 - protein, 56 aa, Artificial Sequence
  Synthetic
ERVIKRVDEEVKKLAEEIRKVSEEHEKRVKKLLKEIEKSSEDHRRRVEELLREIDR

SEQ ID NO: 23737 - protein, 59 aa, Artificial Sequence
  Synthetic
SEEEEVEEELERHHRDVEEYVKRLKELLDKLRRKNETTVRDIARLAKKHHDDVDELKKR

SEQ ID NO: 23738 - protein, 55 aa, Artificial Sequence
  Synthetic
REVLKRFKDKVKENRDESERVHREIKERLEELKRKNEDVLRKVKKILDDNEERLR

SEQ ID NO: 23739 - protein, 57 aa, Artificial Sequence
  Synthetic
KDLEKLVEDIRRLLEELKKTVEDNKREIKELLDRLREKVKENLKRHKELNKRLRDTG

SEQ ID NO: 23740 - protein, 59 aa, Artificial Sequence
  Synthetic
KEVKDRIEEVLRELREAVRRHHEKVKEVLRELKEALDKHHKDVTDSLRDVERLVEEARR

SEQ ID NO: 23741 - protein, 58 aa, Artificial Sequence
  Synthetic
SEKEILDEIRDRIRKLLEEIKDYLEKSKKKIRDLLEKIKKVLEDNKERVDRLLDVIRK

SEQ ID NO: 23742 - protein, 55 aa, Artificial Sequence
  Synthetic
DDVRREAKRLLEEVAEAVRRIHETSKRLLERVDEEMKRVEETIRKTNKEVEDAKR

SEQ ID NO: 23743 - protein, 57 aa, Artificial Sequence
  Synthetic
SDVEKLIRDAEKKMDDFRKDSERLVRELEEKLKRHEERVRDLLRELKELLEEVRRKD

SEQ ID NO: 23744 - protein, 55 aa, Artificial Sequence
  Synthetic
EKIKEAVDRIKKALRDSHKELAEVVERIKRKLDETNRELKDEARKIKEELRRVEK

SEQ ID NO: 23745 - protein, 60 aa, Artificial Sequence
  Synthetic
SEVETVKKRLEDSTKESEDTVRKVKRELERLIERSEDTLRRIKKRLDDLIRTIEDLKRRG

SEQ ID NO: 23746 - protein, 59 aa, Artificial Sequence
  Synthetic
KELLDTLRRLLEENKRRHKETVDEIERLIKEVERANREILTRIKKALDDVRRAVEEIKR

SEQ ID NO: 23747 - protein, 60 aa, Artificial Sequence
  Synthetic
REVEEVLRKVREDSKRNKDELKRLLDEARKESEDNKRDLEKLLKEVREEVRRVEEILRKT

SEQ ID NO: 23748 - protein, 55 aa, Artificial Sequence
  Synthetic
EDVLREIETLLDKNHKDNKKVLDDIRELLKENADRNRRVLEEIKKLVEDVERKVK

SEQ ID NO: 23749 - protein, 58 aa, Artificial Sequence
  Synthetic
DEDEKALREIKKLIEDNERLNREVNERIERLIDRARRLMERVNREIERLIKEVRERLG

SEQ ID NO: 23750 - protein, 58 aa, Artificial Sequence
  Synthetic
EELEKTLRDIRKRSKEDADKVKKSLEEVEEEIRRIEKRLRESLKKVEDDIERIRREAT

SEQ ID NO: 23751 - protein, 56 aa, Artificial Sequence
  Synthetic
SEIEKLTKEIRDLIRTSREEIKKLMEELERNVREAEESIKRLLEKAEELIRRIAEE

SEQ ID NO: 23752 - protein, 56 aa, Artificial Sequence
  Synthetic
KEDVKRELERIKKSSDDVRKKVEDESRKHREEVERLERELDRKLEDIRRKVEETKT

SEQ ID NO: 23753 - protein, 61 aa, Artificial Sequence
  Synthetic
SEIEKLAEDVERIAKKIEDVVRELRKANEDIIKEVRDINKELRDKVEEILRRIEKIVRDRL

SEQ ID NO: 23754 - protein, 59 aa, Artificial Sequence
  Synthetic
KEILDRIRKKLRETLERVRDRLRKYLEDLERRLEELRREHRKTLEELKEKLKRLADRVK

SEQ ID NO: 23755 - protein, 57 aa, Artificial Sequence
  Synthetic
SEVEDLERRAREVNKRIKDLIDRLRERVRKIEEDIRRLNKELKEEVDKIIEEIRKDG

SEQ ID NO: 23756 - protein, 58 aa, Artificial Sequence
  Synthetic
KLIEELLREHEKMLKEIEDRIRKIERELDELLKTLEDKHREILDELEKELRKAKERRR

SEQ ID NO: 23757 - protein, 60 aa, Artificial Sequence
  Synthetic
SDIERILEENEKTNRENRKRIEDIRRELEERLDRNRRRIEEILRRAEKMLEEIEDIFRRS

SEQ ID NO: 23758 - protein, 59 aa, Artificial Sequence
  Synthetic
EDKLRDLKKKLRDSLRTLEELHRKLKKDLDEILRRLEELHRKLKEDLDRILKAVRDTAK

SEQ ID NO: 23759 - protein, 60 aa, Artificial Sequence
  Synthetic
SEIEDIKRRNEENNRRNKKRIDDILEELKRRVEENRRRLEDIERKLREDKERLKDIFRRS

SEQ ID NO: 23760 - protein, 59 aa, Artificial Sequence
  Synthetic
EDKLRKLEEDLRRSLETLREIHRKLKEELDRILEELKRLHERLKRRLDEIADEVARTAR

SEQ ID NO: 23761 - protein, 60 aa, Artificial Sequence
  Synthetic
SDIEEIERRNRENNERNKRRIEEIEKRNREENKENEKDIERILRRAEELLKRAKEILRES

SEQ ID NO: 23762 - protein, 59 aa, Artificial Sequence
  Synthetic
EKKLRELKKKLDDSLRTLEELHRELMKRLDESLKTLKELHDELKERLDRILKEIRDDAK

SEQ ID NO: 23763 - protein, 60 aa, Artificial Sequence
  Synthetic
SELEKTLEDLKRHSEENKKKLEEDLRDMERNLKENKDRLKKILEEAEKTLKDLERRFREG

SEQ ID NO: 23764 - protein, 59 aa, Artificial Sequence
  Synthetic
KDKAEELERRLDELVKENREIHERVKKALDDIVKELEELHERLKRRLEEILRRIAETVR

SEQ ID NO: 23765 - protein, 57 aa, Artificial Sequence
  Synthetic
SSVERFEKAVKESIENIRRLLEELEREIRESMKHLRELVKELKEALDRIVERLRRTV

SEQ ID NO: 23766 - protein, 55 aa, Artificial Sequence
  Synthetic
EEDLKRLDKENKDIEKKIRDLVKEARDENRKLKRDIERTLRELEERLKEVEDRET

SEQ ID NO: 23767 - protein, 57 aa, Artificial Sequence
  Synthetic
SDIEKRLEENERHNERSEERIRELLKELEDHLRRTKREIEKKLEDLKRLLDRLREED

SEQ ID NO: 23768 - protein, 58 aa, Artificial Sequence
  Synthetic
EELKRVKDELDKSLKHSRELIERAKERLEEIKKRSKELVDRAEKRLDEILKEVKDDFD

SEQ ID NO: 23769 - protein, 57 aa, Artificial Sequence
  Synthetic
DEIKEREDDVKRHLDRTREEIEKLLKEMEEHTERSRRKIKKVAEDAEERLRKVEEEN

SEQ ID NO: 23770 - protein, 58 aa, Artificial Sequence
  Synthetic
KELEEVKRKLDRILEESEKLVREAEKRLDELLKDNKRLVEELEKELDRILEELRKRVD

SEQ ID NO: 23771 - protein, 57 aa, Artificial Sequence
  Synthetic
DSIEDLERRAKESDDHLEKLIRELRDELRRSLETVRRNIEDLRRTLEEVLRRLEEDG

SEQ ID NO: 23772 - protein, 59 aa, Artificial Sequence
  Synthetic
EEMLREIKKELEETNKRAEDDVRKIREELREHNERHKERSKRIKEELKRTLDELKKKRK

SEQ ID NO: 23773 - protein, 60 aa, Artificial Sequence
  Synthetic
SRIETLVRRMKELLKEVEDKSEKSKRRWEDRLKKVAEDSKRRVEEMDRELDEVRRKRERG

SEQ ID NO: 23774 - protein, 59 aa, Artificial Sequence
  Synthetic
ERLLRELKRIVDEVKKELDRLDTEHNKAIEDVKRELRKLDEEVRRIVERVKRELDRLEK

SEQ ID NO: 23775 - protein, 60 aa, Artificial Sequence
  Synthetic
SEIEDLIRRIRETLKRVEEDSRRSKEEAKRKLDKVKEDSERLVEKMRRDLEKVKRETDKG

SEQ ID NO: 23776 - protein, 59 aa, Artificial Sequence
  Synthetic
EELLKRLKEVVEDVIRKLDRLDKEHTEIVEEVERRLDKLDKDVERIVEEVKKALDETEK

SEQ ID NO: 23777 - protein, 60 aa, Artificial Sequence
  Synthetic
SEIEKLIEDIRRRLKKLEDESRKSVKDARDMLRRVEERSRDSVRKMREELERVEDESRRG

SEQ ID NO: 23778 - protein, 59 aa, Artificial Sequence
  Synthetic
DELLKRLEDVVRDVKRKLDELDERHTRIVEDVKRRLDDLDREHRKIVEEVKKELDKLLK

SEQ ID NO: 23779 - protein, 60 aa, Artificial Sequence
  Synthetic
SEIEKLIEELRRELEKVKDELERSIEEMDRELDDVRRDSKRLVDEIKRELREVTERTKRG

SEQ ID NO: 23780 - protein, 59 aa, Artificial Sequence
  Synthetic
EELLKRLEEVAEDVKRALEELLKKHTRVVERVEKALDELDKELERIVREAEKELDRREK

SEQ ID NO: 23781 - protein, 60 aa, Artificial Sequence
  Synthetic
SEVEEEEKTAEKILEEVAEEIKESIKRIREEVKKNEDDSERSVREMERRLREVEERIRRG

SEQ ID NO: 23782 - protein, 59 aa, Artificial Sequence
  Synthetic
EELLRRLKRVVERVKERLDRLLEEHTRVVEEAKERHRELDERHEKIVRDVVRELDRRVK

SEQ ID NO: 23783 - protein, 60 aa, Artificial Sequence
  Synthetic
SEVEKVVKELEDELRRVAEDSERSIREMEKRLDDFRKRVRETAEKMKEDLRRVEERARRG

SEQ ID NO: 23784 - protein, 59 aa, Artificial Sequence
  Synthetic
ERILKRVEDIVRRVEEELDKLDEKHTRVVKKVSDALDRIVEELEKIVREVAKRLEDLRK

SEQ ID NO: 23785 - protein, 60 aa, Artificial Sequence
  Synthetic
SEVEKKIEEMRRTLDEARRRSEESKREIKKELDEARKRVEESLKRLRETLKKVEDERRRG

SEQ ID NO: 23786 - protein, 59 aa, Artificial Sequence
  Synthetic
ERLLRRVAKVVEDVKRELDRLDEDHTRAVEEVERALDDLLKKHEDVVREVKTELEKLLK

SEQ ID NO: 23787 - protein, 57 aa, Artificial Sequence
  Synthetic
SELEELIRDIERKLEKVKRDSERSMREIEEDLKRVRKKTEESERRIRDLLDKVRKRK

SEQ ID NO: 23788 - protein, 56 aa, Artificial Sequence
  Synthetic
TEDLRRVAKRVEEELDRSNEEHSKIVDKAKRDLDKSNKEHSKVVEDAERTLDRVED

SEQ ID NO: 23789 - protein, 57 aa, Artificial Sequence
  Synthetic
SELEELEERIERLLEKVRRESEKLLRELEKKLKDVERKIEDSIRKIRDDLRKVRERK

SEQ ID NO: 23790 - protein, 56 aa, Artificial Sequence
  Synthetic
TEDLRRVLDRVKKDLDRSNEEVRREADRIMKELDKLLKKHSDVVKEVLEALDDTDR

SEQ ID NO: 23791 - protein, 60 aa, Artificial Sequence
  Synthetic
SEIEEIKRRLEETNKRVREKNKRSVDRIKEHLERSRRRVEEIIRRIEKLLEELEEKARRT

SEQ ID NO: 23792 - protein, 59 aa, Artificial Sequence
  Synthetic
EKLLRDLEKALRDSIRTLKRSVEENDRINKEANEDSERLLRELKKVLEKAKKDVDELRR

SEQ ID NO: 23793 - protein, 60 aa, Artificial Sequence
  Synthetic
SLEEELRELARRLKEEVRKLEETLEKVLEDSARNIKRLIDDLKRVNDELRKRVDDLIREV

SEQ ID NO: 23794 - protein, 59 aa, Artificial Sequence
  Synthetic
KEALDRVRKKLEDALKKLRDEVREMKKKNDKTNKEVKDKADELRKKHEDTLEELKKRVK

SEQ ID NO: 23795 - protein, 57 aa, Artificial Sequence
  Synthetic
SEVDEIIKRIEDLLKEVRDESKRNEDRIREKLKRLKKKSEDNAEKIKDELKKIRDRK

SEQ ID NO: 23796 - protein, 59 aa, Artificial Sequence
  Synthetic
KEVLDTLRDAIRRVKEELDRNLEKNTELIKRVKETLDDLLRRNKELIRKAEETLDEERR

SEQ ID NO: 23797 - protein, 61 aa, Artificial Sequence
  Synthetic
DELEKIRKELEDLSRENKEKLERIARELKRLSEENTETLEKLKEEIRRLLEKLKRIVEKDG

SEQ ID NO: 23798 - protein, 59 aa, Artificial Sequence
  Synthetic
KEMLDRIKELLDTHRRILEDIKREIDKLLEDHRRRLEELLRDLKRALDRVREEVDRLRR

SEQ ID NO: 23799 - protein, 57 aa, Artificial Sequence
  Synthetic
DDVRRIEEEIRRTLRELRETLKRVERRNREENEDLKDKMRRMKKENEDTNERVKKEG

SEQ ID NO: 23800 - protein, 56 aa, Artificial Sequence
  Synthetic
KERLDKLLEDLAKEARKVIEDLKEILRRTKESIDEVEKTLREILKKSKETADRVET

SEQ ID NO: 23801 - protein, 57 aa, Artificial Sequence
  Synthetic
SDLERLKKRNDDANRKLKETLDRVEKENRDVNRKLEKELKEVEEKNRRENKKVRDRG

SEQ ID NO: 23802 - protein, 56 aa, Artificial Sequence
  Synthetic
KEELDKILTRSEEVARRIIEELKKILEETRKSAERVIRRLEEILKESEREVREVET

SEQ ID NO: 23803 - protein, 57 aa, Artificial Sequence
  Synthetic
SEVEETIKRVRDTLKKHNEESEKAIRELEEELKRLDDKNREAVEDVKRTLDELRRTK

SEQ ID NO: 23804 - protein, 59 aa, Artificial Sequence
  Synthetic
KDLRKRLEELLREVEEDLKRNIEKLDKALKEAKEVIERSIEHLRRVLEEVERVLRELAR

SEQ ID NO: 23805 - protein, 60 aa, Artificial Sequence
  Synthetic
RKEDEMRKLLDEIEKDLKRNDERVRRVLKRSKENLRRLEERAEKLLETVEREIKRLEEEG

SEQ ID NO: 23806 - protein, 59 aa, Artificial Sequence
  Synthetic
EREVKRTIDELKDELRKHNDKTEKLIRRARETDKELNDRVAKREEEARRELEEVDRRVR

SEQ ID NO: 23807 - protein, 60 aa, Artificial Sequence
  Synthetic
SLEEAVEKLLRDSEENLKKNEEDVRRLLKKSKENADRLRDEVRKLLETAEREIKRLEDEG

SEQ ID NO: 23808 - protein, 59 aa, Artificial Sequence
  Synthetic
ERLIRETEKDVKRRDEEHNTRTEREIREAKKEDEKLNKEVRDTEKRLRDELRRVEERVR

SEQ ID NO: 23809 - protein, 60 aa, Artificial Sequence
  Synthetic
SKEDKVRELLRRSKENLDRVREEVRKLLKKSRDTLEELRERAKRLLEEVEEVIKRLEEEG

SEQ ID NO: 23810 - protein, 59 aa, Artificial Sequence
  Synthetic
EKEIEETIRRVEDMDRRLNERLRKKIEDAERMDEALRERVERLIRRVRKELEDVERRVR

SEQ ID NO: 23811 - protein, 56 aa, Artificial Sequence
  Synthetic
SELEEVARRIEKMIRDLEKDLRELERKVRESDERLKRDLERNEKEHRDTIEAMRRR

SEQ ID NO: 23812 - protein, 59 aa, Artificial Sequence
  Synthetic
KDVRDALKKLLDELKKAVEDVRREIERLIREHKRVTEEVERADKELNDRTRKAADELRR

SEQ ID NO: 23813 - protein, 57 aa, Artificial Sequence
  Synthetic
EEVERLEEEVRRRKKEWEDRLEEVKRRNEKAKRESERENEKIAREVREVVKELRERG

SEQ ID NO: 23814 - protein, 56 aa, Artificial Sequence
  Synthetic
KRRLEELLRDHSRMIRRVEAELDKSLEDHKRALDENEKRIDEWLERLRKIVEEVEK

SEQ ID NO: 23815 - protein, 56 aa, Artificial Sequence
  Synthetic
SKIEEIERRVRELEETWRRKLEEVEKDSRRSVKKMEEDLERAARETEEIKRRLREE

SEQ ID NO: 23816 - protein, 56 aa, Artificial Sequence
  Synthetic
ERKLEELLRKHNEVIKRVKEELKRLDKEHTDIVEEVKKELDKLDEDLKRVADEKRK

SEQ ID NO: 23817 - protein, 57 aa, Artificial Sequence
  Synthetic
DEDEDLERLLRKLKRVLDEIRKRIRENIEENREVVERAAREVKKSIDENRKVVDDVQ

SEQ ID NO: 23818 - protein, 56 aa, Artificial Sequence
  Synthetic
GEEVRKKIEDLERELRRTLEEIHKENEKSKRKIEKALRDIREENKKHIREIEETKR

SEQ ID NO: 23819 - protein, 60 aa, Artificial Sequence
  Synthetic
SDIETLTRDVERSIKELEDHLKKHHEEVKERIRRLEEHADELRRRAEKLKEELKRMKDRG

SEQ ID NO: 23820 - protein, 58 aa, Artificial Sequence
  Synthetic
KVEEDVKRLVKKLDEVNERHRREIERNRKELEDVSRRHKEKVDRILEDIKEALDRVRK

SEQ ID NO: 23821 - protein, 57 aa, Artificial Sequence
  Synthetic
SESETVKKENEDHIRKLEDDLRKLEEDNKRHVDDIERRLRDLKRENERFAEEVKKRG

SEQ ID NO: 23822 - protein, 59 aa, Artificial Sequence
  Synthetic
EEVKKTLETLVRTNRRAIREVERRLKESLDHNREVLKRAEEDLRRSIRHLREVVREADR

SEQ ID NO: 23823 - protein, 60 aa, Artificial Sequence
  Synthetic
SIEDELRELKERLERVVEELRRLHEKTIEDLKRVVEKSEKTLRDIRRELERVVEEVRRRR

SEQ ID NO: 23824 - protein, 59 aa, Artificial Sequence
  Synthetic
KEVLDRLRKKVEDTIRKMKDEAKKLDDEHKKAVRRLEERNEETARRVRKAVEDIERETK

SEQ ID NO: 23825 - protein, 60 aa, Artificial Sequence
  Synthetic
SIEDILRKLTKDLEDVIRRSRKTSEDLKEELKRVLDKHKEKLDRILEDVERVVREVEERR

SEQ ID NO: 23826 - protein, 59 aa, Artificial Sequence
  Synthetic
KEILDRLEEEVRRLIEELDKENDEARKEHREVAKRNEEEIKKLEEEAKDSIRRLREESR

SEQ ID NO: 23827 - protein, 57 aa, Artificial Sequence
  Synthetic
RESEELDKRLKEIAKDIRDKLDEIRRENEKTAKEIEDTIREIERDNERIDREMERRG

SEQ ID NO: 23828 - protein, 59 aa, Artificial Sequence
  Synthetic
KRFKDVIRRLEEELKKLLKRAEEEIRDSKRHLRELLKKVEKVIRESKANLDRTLKKLRD

SEQ ID NO: 23829 - protein, 60 aa, Artificial Sequence
  Synthetic
SEEEDLRRKVEELEERVERYKEELKKEIERIETENKRHVEELERRLRKIAREVDDAKRRQ

SEQ ID NO: 23830 - protein, 59 aa, Artificial Sequence
  Synthetic
EDLDRLLDEMRREAERLLDELRKVTERIAREVKRSNEENKKVLDEIRKAIKDLLDKLRK

SEQ ID NO: 23831 - protein, 59 aa, Artificial Sequence
  Synthetic
STEEKVEEDLRRLEEKNRRHVREIEERLERMKEENRDHVRKLEEKLRRLDEEVRKVKEG

SEQ ID NO: 23832 - protein, 56 aa, Artificial Sequence
  Synthetic
RETLKRAERKLRESLRHNREVLERARRELKKSLDHNDKALEDAERRIREIREELEK

SEQ ID NO: 23833 - protein, 59 aa, Artificial Sequence
  Synthetic
DLKEVLDKLRELVREVTERIKRTIEEIERLLRKVEREMRETIRTDEELLKTVVDELRRK

SEQ ID NO: 23834 - protein, 59 aa, Artificial Sequence
  Synthetic
RRKIKKVLDDLRKIIEDIERESRESLERLREIIERLKRRSDKTLKDSKKVIDDIRRRTK

SEQ ID NO: 23835 - protein, 59 aa, Artificial Sequence
  Synthetic
DLEEVLEDLRRLMEEVKRRIERTIEEDKRLLDEVERRIRETIRRDRELLKEAERDLREK

SEQ ID NO: 23836 - protein, 59 aa, Artificial Sequence
  Synthetic
RDKIRKVRKELREIIDRIRRESERSLEESRRVIEKIDEKSKRTLEESRRVIEEIKEKAR

SEQ ID NO: 23837 - protein, 56 aa, Artificial Sequence
  Synthetic
SSEEMLRTVEELIKEARKRLDESLEEVRKRIEDAKRRHEESNDENRRLVEDAKRRV

SEQ ID NO: 23838 - protein, 55 aa, Artificial Sequence
  Synthetic
KDVLEELREIIDRLRRESEDSLRRLEKIIKDSEDRSRESSEELKEIIKRLLEEDK

SEQ ID NO: 23839 - protein, 56 aa, Artificial Sequence
  Synthetic
SKDEVLEEVERRIRTAERDLERMVRRNEELIRDAKREHERSNRENERLVTEAKREI

SEQ ID NO: 23840 - protein, 55 aa, Artificial Sequence
  Synthetic
KDVLDELRDIIRRLREELKKSSDDLERIIRRSVKESRDSSEELRKIIEDLKREAT

SEQ ID NO: 23841 - protein, 56 aa, Artificial Sequence
  Synthetic
SEKEVLDEVKELIERAKERLRRMLERNERLVRDAERKLKRLLDEDRESIERVKKRL

SEQ ID NO: 23842 - protein, 55 aa, Artificial Sequence
  Synthetic
ERVLEELKKEIRRLEEEVKKSSEELERIIEKLLEELKRSLEESEDIIRRLEEETR

SEQ ID NO: 23843 - protein, 56 aa, Artificial Sequence
  Synthetic
RKDELLRRVEEEIKKVKKRLKEMLDTDRKLIEDAERKLEEAERRDSDLIRRAKERV

SEQ ID NO: 23844 - protein, 55 aa, Artificial Sequence
  Synthetic
DRVLEELERIIEELKREIEKSLRETEKIIKELEDELRKSLEETERIIRKLEEESK

SEQ ID NO: 23845 - protein, 56 aa, Artificial Sequence
  Synthetic
RSEEVLREVEKAIRRAKEELKRAVETDRRRNTEAARALEEILDTDRRLIEEAKRRL

SEQ ID NO: 23846 - protein, 55 aa, Artificial Sequence
  Synthetic
EKVLRDLKKIIDDLRRRIEESLRDSERIIEKLRRDLEASLEESRRIIERLKEKAD

SEQ ID NO: 23847 - protein, 56 aa, Artificial Sequence
  Synthetic
REKELLDKVKELVERAKRELERLVREDDKLNEDLKRRLTKILKEDSDRIKEVKERL

SEQ ID NO: 23848 - protein, 55 aa, Artificial Sequence
  Synthetic
DKVLEDLRKIIEDLLREIEESLRESREIIKKLEKRAKDSLKETEEIIEELERRDT

SEQ ID NO: 23849 - protein, 60 aa, Artificial Sequence
  Synthetic
SEVEELLDRVKKVADESRREAKRLLDESKRVIDKSLDEVRRLLKESREVIEEVKKRVDEK

SEQ ID NO: 23850 - protein, 56 aa, Artificial Sequence
  Synthetic
DEVLKRLEDLLRKVAEEHRRITREDEELLKRAEEEHERFSKEDEDLLRKAEKEVED

SEQ ID NO: 23851 - protein, 60 aa, Artificial Sequence
  Synthetic
SRVDELVKRVRDVAREVKRINDELLKRVEEVIKESRDRVRELLKKVEDVIRRAAEEIDRI

SEQ ID NO: 23852 - protein, 56 aa, Artificial Sequence
  Synthetic
KEVVREIEKLLEDVRRTSEDTVRKIRELVAEVDDDHRRASETIRRLLKEAEDRARK

SEQ ID NO: 23853 - protein, 60 aa, Artificial Sequence
  Synthetic
SEVEELLKDVERVIKRSEDEVRRLEREVEKSSEDVERINRKLLRDSREVIKKVIEDVRRV

SEQ ID NO: 23854 - protein, 56 aa, Artificial Sequence
  Synthetic
KEVLDRIRELLETARRRHKEATKKIKRILEESEKKSRRSIEEDKRLLDEAKEEVRR

SEQ ID NO: 23855 - protein, 57 aa, Artificial Sequence
  Synthetic
SVEEVVRDNERRLEEDAERTRRVARRIEKLLDELRKKVEDVIREAKERLERLLEEIG

SEQ ID NO: 23856 - protein, 60 aa, Artificial Sequence
  Synthetic
AEDLLREVNKRNEEVIRRNKELLDEVEKRIREVIKRLEELLEKVKRELERVADELRKAKK

SEQ ID NO: 23857 - protein, 57 aa, Artificial Sequence
  Synthetic
DVERVLKENKETLDEDRKRTKEVIDRNKKKLEDLAREVRKVIEEIKKRLKELLDKTG

SEQ ID NO: 23858 - protein, 62 aa, Artificial Sequence
  Synthetic
EEAEELLRRVNKDNEKVVRENEKLLKEVLDDSERVIKELRDLLEEVRRRIEKVIRDLEERRR

SEQ ID NO: 23859 - protein, 59 aa, Artificial Sequence
  Synthetic
STDEFIERLKKILRENEEKVKEVLKRNEDLLKEDEDRTRKAIKELEDKLRRVKERVERQ

SEQ ID NO: 23860 - protein, 56 aa, Artificial Sequence
  Synthetic
VKEIEKELRRVSEESERELRKHDENTKRVSEENKERIDRLRKTLDEVIERAEERAK

SEQ ID NO: 23861 - protein, 60 aa, Artificial Sequence
  Synthetic
SLDEVIRRLEETLRKDEEDTRDVIRKVRRILEENRKEVKRVIDELRRRLEEVKKRVEDSK

SEQ ID NO: 23862 - protein, 56 aa, Artificial Sequence
  Synthetic
ADTIREELRKVLEDNKRILRRLLEELKRVSEESRDRLRRLKEELERVIEEVERRAK

SEQ ID NO: 23863 - protein, 60 aa, Artificial Sequence
  Synthetic
SIARKVLTDLRKIVEDLERDVERSDRDSERVVREVLERNEEVLKRLRDIVEEIKKVIREV

SEQ ID NO: 23864 - protein, 59 aa, Artificial Sequence
  Synthetic
RDDVERIKRDLERILKEVARKATESVKRNERILEEVKRHAEKSTEDVERLLRELEDTVR

SEQ ID NO: 23865 - protein, 60 aa, Artificial Sequence
  Synthetic
DEIEDALREARRVTEEVRREIEKSDKESEDVVREVLRRNEEVLRRLREIVKEILDELRKR

SEQ ID NO: 23866 - protein, 59 aa, Artificial Sequence
  Synthetic
EKRVREVLRDLERLHEESKRTVERSVERNKTILKEVRKHAETSKRELERILEDVKRATK

SEQ ID NO: 23867 - protein, 60 aa, Artificial Sequence
  Synthetic
SEIDKVKKDLEKITRDVERAIKKSDDDSRKNSKEVLETNERVLEELRRIVKEVLDEIRRV

SEQ ID NO: 23868 - protein, 59 aa, Artificial Sequence
  Synthetic
RDRARDVDKKIKDLHKKSEDEVRKSVKRNRDLLEESKRHAEESREDIRRLLDEVREEAK

SEQ ID NO: 23869 - protein, 60 aa, Artificial Sequence
  Synthetic
SSAETVLTELRKIVRDILEKSKKSNDDLRKIVEEILKDNEDVLRELREILRRIKEKIDER

SEQ ID NO: 23870 - protein, 59 aa, Artificial Sequence
  Synthetic
KEKVDRIRDDIRRLLKKLRDDVERSVRDVRRILKEVKEHAERSEEEVKRLLKELRDRAK

SEQ ID NO: 23871 - protein, 60 aa, Artificial Sequence
  Synthetic
DEMDKVLKDAEDVTRRVKEELRKVDEESRRVVKRILDENRRVLKELEDRVRDLRRLIREI

SEQ ID NO: 23872 - protein, 59 aa, Artificial Sequence
  Synthetic
EEDVRKIKEDLERLHRESKRDVERSARDNERILEEVKRHADESRREVKRLLDEAKEEVD

SEQ ID NO: 23873 - protein, 60 aa, Artificial Sequence
  Synthetic
DDLERVLRELERLVDEIRKEIEKVDRESEELDRRVKETIKELDERSKRLVEEVEDMIRRN

SEQ ID NO: 23874 - protein, 55 aa, Artificial Sequence
  Synthetic
EEVVRRVEKIVRELRKTVEDSIRRNEKSVEETRREAEKSEKRNRELVKRLEEKAK

SEQ ID NO: 23875 - protein, 60 aa, Artificial Sequence
  Synthetic
SEAEKVLKELEDLVRRIEEDIRRTNEEVRKLDEDVLEDIKRVDEESKKLVREIEERIRSR

SEQ ID NO: 23876 - protein, 54 aa, Artificial Sequence
  Synthetic
EFVRRLEELVKRLADKVKESVDTSRTSVKRTEDEARKSVRRNEDLVRRLEEDAK

SEQ ID NO: 23877 - protein, 60 aa, Artificial Sequence
  Synthetic
SELEKVLEELERLVKRIEEEIKRTNKEVRDLDEEIRKAIERSNRETERLAREVLERIREE

SEQ ID NO: 23878 - protein, 55 aa, Artificial Sequence
  Synthetic
EEVVRRLEDLVRRLEESVERSVRTSRKSVKETEDRIREVERHDERLVEELERAAK

SEQ ID NO: 23879 - protein, 60 aa, Artificial Sequence
  Synthetic
SDLEDVLRKVEDLDRKIAEDIRRTNEDVKRLDEEIEEKIRRSNEKLRELVRRVLKAIRDR

SEQ ID NO: 23880 - protein, 55 aa, Artificial Sequence
  Synthetic
EEVVRRLEESVRRTKERIDRSLKTSRDSVRETERKIKESKDTSEKLVKDLRDAAK

SEQ ID NO: 23881 - protein, 61 aa, Artificial Sequence
  Synthetic
SEVDDILRRLREIDEKLLRENEESLKRLKDEVDRLKRKNEKSLDDLRKLVEKLIDDLRKRK

SEQ ID NO: 23882 - protein, 55 aa, Artificial Sequence
  Synthetic
EKVLEEVKRSVDRTRDHLRKSEEDVRRLLDELRRHLEDSERRVRELLRKLREKVR

SEQ ID NO: 23883 - protein, 61 aa, Artificial Sequence
  Synthetic
SKVDEILRELKRLVDELLRRIEKTLKELEDLVRELLKENTRSLEELRELVERLLEELRRRK

SEQ ID NO: 23884 - protein, 55 aa, Artificial Sequence
  Synthetic
REFVERVRELLKRLEDELRKSNRTIEKLLRDLARHLEDSIRRVEELLRELEEKAT

SEQ ID NO: 23885 - protein, 60 aa, Artificial Sequence
  Synthetic
KEVEDILRELEKIAKDLRDEIRESDDESRRLVEELLKRSEDTLKELRDLVKKLLDRLRER

SEQ ID NO: 23886 - protein, 55 aa, Artificial Sequence
  Synthetic
EEVVKRVEELIRRVEEEVRRSTRRNEKLLEDLRRELERSDRELEKLMDDLRRKLK

SEQ ID NO: 23887 - protein, 60 aa, Artificial Sequence
  Synthetic
DDVEKILEDLKRIDTELTKRTRDSNKELEDEVRRLMERSRRTLKELEDEVRKLLDRLRKR

SEQ ID NO: 23888 - protein, 55 aa, Artificial Sequence
  Synthetic
RKVLEDVRRSLERTERELRESDKSVKKLLDELKEELDRSDREVERLLEELRDAVR

SEQ ID NO: 23889 - protein, 60 aa, Artificial Sequence
  Synthetic
SEVDEILRKLRELVKELIRRTEESNEKLRKLVEDLRDESRKSLEELRELVERLADELRKR

SEQ ID NO: 23890 - protein, 55 aa, Artificial Sequence
  Synthetic
ERVVREVEELLKELKRRLEESDKSVAELLRRLEKDLRESDRRVEELLKRLEDEVK

SEQ ID NO: 23891 - protein, 60 aa, Artificial Sequence
  Synthetic
SEAEKILTELEEIDRRLVKRTEDSNRKLRDTVRKLEEESKKSLEELRELVDRLLKRLDER

SEQ ID NO: 23892 - protein, 55 aa, Artificial Sequence
  Synthetic
REILERVRESLERTDKRLRESDESVKKLLEDLKRKLEESDRRAERLLEELRKRAT

SEQ ID NO: 23893 - protein, 58 aa, Artificial Sequence
  Synthetic
SELEEVLKRVEETVRRLTKRLEESLEETRRIVDKLREDLRRSLERTERIVRELTEKLG

SEQ ID NO: 23894 - protein, 59 aa, Artificial Sequence
  Synthetic
EEELREVEKKAEKLVRELEERLKRVIEDSERLVTDLKEKLERVLETSKKLLADLEERAR

SEQ ID NO: 23895 - protein, 57 aa, Artificial Sequence
  Synthetic
KELDEVLEKVKRIVDELERKLERSLRETKRIVDELREELKKSLKETEDIVRELERDL

SEQ ID NO: 23896 - protein, 59 aa, Artificial Sequence
  Synthetic
DERLTEVEERAKRLVDTLAEKLKEVERRSEELVKTLEEELRRVLDTSRRLVEELREKAR

SEQ ID NO: 23897 - protein, 58 aa, Artificial Sequence
  Synthetic
SELEEVLKEVEEIVRRLEEELRKSLKETREIVTKLLKKLKESLEDSERIVRELSRKLG

SEQ ID NO: 23898 - protein, 59 aa, Artificial Sequence
  Synthetic
DEEARKVLETAKKLVDDLKRKLERVKEESAKLVDELRKELRRVNERSKELVEKLEREAK

SEQ ID NO: 23899 - protein, 57 aa, Artificial Sequence
  Synthetic
SELEKVLREVEEEVRRLKKKLKESLDRTKEIVDRLKKDLKRSLDETKKIVDELREKL

SEQ ID NO: 23900 - protein, 59 aa, Artificial Sequence
  Synthetic
DKDLKDVERKAEKLVEDLDRELKEVEKTSRKLVKELEAELREVDKTSKKLVDDLRKDAK

SEQ ID NO: 23901 - protein, 61 aa, Artificial Sequence
  Synthetic
REVEELLKEVEESTRTSKKIIEDLLRRVKESSDKSKKDIRRLLEEVRRIVDTVRKILERRG

SEQ ID NO: 23902 - protein, 62 aa, Artificial Sequence
  Synthetic
EELEKRVREVEETLKRLVDENRETLERVARKAKRLVEDDKRDLEEVVRELEELLKRLKEELD

SEQ ID NO: 23903 - protein, 61 aa, Artificial Sequence
  Synthetic
SSVDRLLERVKRTTDESKERVERLLERVKESSERSEREIKRLLEEVERIVREVKKEVERRG

SEQ ID NO: 23904 - protein, 62 aa, Artificial Sequence
  Synthetic
EEVEKRVREVERTVEELVKEDREAVKRVEETIRRLLKKNEDTVKKVEDDLRKLLEDLKRDVK

SEQ ID NO: 23905 - protein, 60 aa, Artificial Sequence
  Synthetic
SEIEELLRRVKKVNDESRERIKELDKRSREVNERSRRKNEELLKRVEEVVREVEERIDRT

SEQ ID NO: 23906 - protein, 62 aa, Artificial Sequence
  Synthetic
KELEDRVRDAVRRLERSLKENEDRVRESIERNKDSVRRNEEHVDESIKRLEKEVDRVRKRAE

SEQ ID NO: 23907 - protein, 60 aa, Artificial Sequence
  Synthetic
SEIEKLLEDVRKVAEEVKRAIDRLNEENKRVNEKSKERIDRLLEEVRKVVEEVLRRVKTS

SEQ ID NO: 23908 - protein, 62 aa, Artificial Sequence
  Synthetic
EEVEKRVRRVVEKLREIVKEVEEKVRRALDENRRSLEENRRRVKRVIEELEKILKEVEDEVR

SEQ ID NO: 23909 - protein, 57 aa, Artificial Sequence
  Synthetic
DEVEEMEKELKKLLDDSKRRSDELIEEMRKLNEESKKRSRELEKRLRDINKEIRDRL

SEQ ID NO: 23910 - protein, 59 aa, Artificial Sequence
  Synthetic
SKLLDDLRKTIEKVIRESRELLEELRKENERVIEESEKLLRDLLRENEKVAEEVRRTAT

SEQ ID NO: 23911 - protein, 57 aa, Artificial Sequence
  Synthetic
SEVEELIRRLEKLLREVEKRARRLIEEAKRLNDESNKESRRLIEELERLVEDVAREA

SEQ ID NO: 23912 - protein, 59 aa, Artificial Sequence
  Synthetic
EKLLRDLERAIRDVVRKLEELLRRLREENERVIKESEELLERVRKEIEDVLREAREAAR

SEQ ID NO: 23913 - protein, 57 aa, Artificial Sequence
  Synthetic
SKVEKLITELEKLLKDSNKKTEDVERELERLNKKSNDDSRRIIEEHKKIVEEIARRV

SEQ ID NO: 23914 - protein, 59 aa, Artificial Sequence
  Synthetic
EELLKRLKDRIKKVVEESEKLLRDLVKENREVIKESEEILRRLAENLKRVKEEVDRRTT

SEQ ID NO: 23915 - protein, 57 aa, Artificial Sequence
  Synthetic
EEVERLIKELDDLLRRSNARTRDLIRKADEELRRSNEESRRIVERMEEINKRIADEV

SEQ ID NO: 23916 - protein, 59 aa, Artificial Sequence
  Synthetic
KKLLDDLKRKIETVIKESEDILRKLEEDLKRVIEESKELLDRLLEENKRVMEEARRRTK

SEQ ID NO: 23917 - protein, 57 aa, Artificial Sequence
  Synthetic
DEVEEIKKEAKRIVEDLKRRNEELKRRLERLVEEVKKRNEESKKRLEDIVRKIKEDI

SEQ ID NO: 23918 - protein, 56 aa, Artificial Sequence
  Synthetic
LKEVRKTLEKARKENEDVIRKIEEDAKEVLRRDEESNRDINRKVDEVRKRVEERRK

SEQ ID NO: 23919 - protein, 57 aa, Artificial Sequence
  Synthetic
REVEEVKKDLERIVEEVKKRNEELKRRLEELLKENKRRNEKSDEDLKRIVDRIDERV

SEQ ID NO: 23920 - protein, 56 aa, Artificial Sequence
  Synthetic
LKDVKRVVEKVRRENEKVLREILTDAEKVSRDDETSNRDLNRKLEEARERVERKAK

SEQ ID NO: 23921 - protein, 57 aa, Artificial Sequence
  Synthetic
SEVEEIKERLKRLVEEVERRNRKVIRESEETVKENEKENRKSKKRLKEILDEIVERI

SEQ ID NO: 23922 - protein, 56 aa, Artificial Sequence
  Synthetic
LKDVKRDVERVLKENKEVLDRLRKEDEEVSRRDKKSNEDINRVVEDVKRKLEEKAK

SEQ ID NO: 23923 - protein, 57 aa, Artificial Sequence
  Synthetic
SEVEKVKEDLKKLVKEVEDRNRESKRRSEETVKENTKKNEDSKRRLKEIVDRIREEV

SEQ ID NO: 23924 - protein, 56 aa, Artificial Sequence
  Synthetic
LKDVRREVKRVLDEDKDTNDKLNDRDRKASEEDERSNRELNKTIARAEEEVKEARR

SEQ ID NO: 23925 - protein, 57 aa, Artificial Sequence
  Synthetic
KEVEDVKEKLKELVERNRDENRKTKEELRRLVEKNRKENEESKKRLKEIVEEIRERV

SEQ ID NO: 23926 - protein, 56 aa, Artificial Sequence
  Synthetic
LREVEKTAEKVSKEDKETNDRIRKDLKKVSDEDKRSNEEVNKRVDKVRKEIEEERK

SEQ ID NO: 23927 - protein, 57 aa, Artificial Sequence
  Synthetic
EESERLDELIKEVVERVKKLNEEARELIKDVLRRNEEVNTRLEELNRKVEKEVREEK

SEQ ID NO: 23928 - protein, 55 aa, Artificial Sequence
  Synthetic
RKVLEKIRRALEKVHEDNRRSIRDVERMLEKVEDDNRKTIERSRRLVKRVEEELR

SEQ ID NO: 23929 - protein, 60 aa, Artificial Sequence
  Synthetic
RSLEELKKEVERVARAVRKVSEDNKRLLDRVREEVKRVSKENRDLVREVERRVEEVKRRV

SEQ ID NO: 23930 - protein, 58 aa, Artificial Sequence
  Synthetic
ERVDRLKEEIEEILRDLERKVRENKERSKKIAEDLRKHAEDNAREVKKALRDLEEKVR

SEQ ID NO: 23931 - protein, 60 aa, Artificial Sequence
  Synthetic
SELERVLREIREVSRETRERSERSLEEIRRVVEDVRRKNKESLDRNREVLEEIRKALEKG

SEQ ID NO: 23932 - protein, 59 aa, Artificial Sequence
  Synthetic
EDRVERVKRELERLVEENERIVRESRKTLEKLVRDVDRTSKRVKDENRKLLRRVEEEAR

SEQ ID NO: 23933 - protein, 60 aa, Artificial Sequence
  Synthetic
SEVEDLLRRIRKVVEEVERRSRDSLRRNEEVVKEVEERSEKSLRDDKKVIDDVKRRLREG

SEQ ID NO: 23934 - protein, 59 aa, Artificial Sequence
  Synthetic
KDEVRKAEEELRKLVRKAEEVVKKSKEDLERTTRKVEKVVRKSEEDSRRLLREVAEEAR

SEQ ID NO: 23935 - protein, 60 aa, Artificial Sequence
  Synthetic
SKLDKILEELRRIVEEVKRRSEESLEEIERVVEEVKRRSRRSNEELKRIVDKIKKDLRDG

SEQ ID NO: 23936 - protein, 59 aa, Artificial Sequence
  Synthetic
EDDVDRVRREADKIVEDVRRVVERSKRRLDELRRDAEKVVRDSERRIDRIVDDVRRTAK

SEQ ID NO: 23937 - protein, 60 aa, Artificial Sequence
  Synthetic
SDLEEVLKKLEDILRKIKETNDKALREIEEVLRRVKERSRRSNKEAEKVLREVEKMLEKG

SEQ ID NO: 23938 - protein, 59 aa, Artificial Sequence
  Synthetic
EDEVRRIKERLERLLRTAERVSREIKKRLEELVDDVRREVKRSKDRLKRLVDEVAERVR

SEQ ID NO: 23939 - protein, 60 aa, Artificial Sequence
  Synthetic
SKVDEILKDIERVVREVEKKSRKSNEELKRISEESKRRNEDALRRLKEIADRVRERLDKG

SEQ ID NO: 23940 - protein, 59 aa, Artificial Sequence
  Synthetic
EDKVRDARRRLKELVDRVKRVVEESEKRIRKLVKENRDVSRRIEEELKRIVREIEEEAK

SEQ ID NO: 23941 - protein, 60 aa, Artificial Sequence
  Synthetic
SKLEEILKKVEKVSEDTKRKSEDSNRRIKKVSDESKELNKKALRDITEMAKEVDRVLKEG

SEQ ID NO: 23942 - protein, 59 aa, Artificial Sequence
  Synthetic
EDRVDEARRRLERLVEDNARVVKRSEDELRKLVEDNRRVSEEIERKLKELLKRVAESVT

SEQ ID NO: 23943 - protein, 60 aa, Artificial Sequence
  Synthetic
SKAEEALKELERVADEARRASEKSNREAKKAADDAKRASEKSLREAERAAREAEKALREG

SEQ ID NO: 23944 - protein, 59 aa, Artificial Sequence
  Synthetic
KDDAKRIKDEADKIVKRAEDAARESKKRLKRLVEDAERAAKESKEELDRLVREAEEKAR

SEQ ID NO: 23945 - protein, 60 aa, Artificial Sequence
  Synthetic
SEVERVLKELEDLIRKLEEEIERSLRELEKLIEELKKEIKESLDELEKLIRDLIRRLDER

SEQ ID NO: 23946 - protein, 56 aa, Artificial Sequence
  Synthetic
SEEADKRAKELLDKLRKVIEKSKEDSRKILKDLERTVKRSEEESRKVLEKLERRVQ

SEQ ID NO: 23947 - protein, 60 aa, Artificial Sequence
  Synthetic
DEVERVLRELRELIKRLEEEIRKSLKELEDLIRRLIEEIEETLKKVEKIIRELKARLEER

SEQ ID NO: 23948 - protein, 54 aa, Artificial Sequence
  Synthetic
ELREEAKKLLRRLEKTVEKSKRDSEKVLRDLEEVVRESERASKELLKDLKRKVD

SEQ ID NO: 23949 - protein, 61 aa, Artificial Sequence
  Synthetic
SELERLLREVEKSSRESVETSRKLNEEVEKTTRESKRRIEELLRRVEKIVDEVKKVIDRDG

SEQ ID NO: 23950 - protein, 62 aa, Artificial Sequence
  Synthetic
DEARERLRRVAEEIKRLAKENKRVAEESKRRAKELLDDNKDTVRRVSERLKELLEDLDRKLK

SEQ ID NO: 23951 - protein, 61 aa, Artificial Sequence
  Synthetic
DEIEDLLRRVRKTTEESKKRSEDLNKEVKDSTREVKKRIKELLEEVERRVKEVKERMERDG

SEQ ID NO: 23952 - protein, 62 aa, Artificial Sequence
  Synthetic
EEAEKRVRRAKEEAERLIRDNERKLKESEEELRRLIKETEDVLRKAEEDIRRILADLRRRLK

SEQ ID NO: 23953 - protein, 61 aa, Artificial Sequence
  Synthetic
SEVEKLLEDVRESTKRVKELSKRLNEEVERTTKESEDRTRRLLEEVKRIVEDVKDKLRKRG

SEQ ID NO: 23954 - protein, 62 aa, Artificial Sequence
  Synthetic
EEAKKRVKEISDEIRKLAEETREVLERSEKRLRELIRRNEKVNKEVAERLEEILRDLDRKLR

SEQ ID NO: 23955 - protein, 56 aa, Artificial Sequence
  Synthetic
REKEDAKRRLEEILREVKKDLDRVHRENEKLVEDTARTVERIKRELKKLLDRAREV

SEQ ID NO: 23956 - protein, 56 aa, Artificial Sequence
  Synthetic
IEELRKRVEDVVRRVKEELERLLKENEDSTREVKKEAERLLDEIRKVLEKVERDAK

SEQ ID NO: 23957 - protein, 56 aa, Artificial Sequence
  Synthetic
REKEEAEDRMRRILEEVRRTLEEVHKENRRLLEDTRRTVERIERENRKIVEEVRRV

SEQ ID NO: 23958 - protein, 56 aa, Artificial Sequence
  Synthetic
IETLERRVREVVERVKKELERLLRENKKSTEEVKRTAEDLLRKNREVVEEVKKAAK

SEQ ID NO: 23959 - protein, 61 aa, Artificial Sequence
  Synthetic
DEVEELERRLEELLKKSRDEVTKLADELDRVLERSREVVKKDRESLKEILKEVERLVREKN

SEQ ID NO: 23960 - protein, 59 aa, Artificial Sequence
  Synthetic
KELLDRLEKELRESVKRSEERLKELADRIRKSLEDSERLSRRTNERIKRVLEEVTERVK

SEQ ID NO: 23961 - protein, 61 aa, Artificial Sequence
  Synthetic
DEVEDVSRKLDEALERSRRITEDLEKKLREVIETSKREVDKLAERLDEVIREIEERIRKKN

SEQ ID NO: 23962 - protein, 59 aa, Artificial Sequence
  Synthetic
KELIEKLEEDIRRVLEKIKREHERLLRKIEESLKDSKRRLDKLRRDIERILERIREALR

SEQ ID NO: 23963 - protein, 60 aa, Artificial Sequence
  Synthetic
REIEEALRELEEVLRKVKEDNKRLEEEIRRVLEEVKRINEKLLRDAKKELDRVKEILKDT

SEQ ID NO: 23964 - protein, 55 aa, Artificial Sequence
  Synthetic
EEAKKELRRLVKEVEDVVRTSTRRLEELVKEVRRVSEETKRALDELVKEVREEVR

SEQ ID NO: 23965 - protein, 60 aa, Artificial Sequence
  Synthetic
DEIEDVERKIKEVVDRVRDINRRLRDTIRRVLEKVTRINEELRDTVRKVLKEVERILREI

SEQ ID NO: 23966 - protein, 55 aa, Artificial Sequence
  Synthetic
EEIKEKLERLVREVKRISEESAKDLERLVREVEKVVEDSERELRRLVEEVERRRK

SEQ ID NO: 23967 - protein, 60 aa, Artificial Sequence
  Synthetic
SEIEKVRKEIDEVLKRVRKINEDLLRELEEVSKRSKDINDDDLRTNTEVLKEARRILKDS

SEQ ID NO: 23968 - protein, 55 aa, Artificial Sequence
  Synthetic
KDVTKELDELVREVEEEVRRSKDTLRRIVEENREVVERSERKLKKSSDDVREERR

SEQ ID NO: 23969 - protein, 60 aa, Artificial Sequence
  Synthetic
SELEKVLRELEENSRRNEEELRRSNDKVRRVLDEIRRKLEEVLRKVEEVLRRIEEELSDK

SEQ ID NO: 23970 - protein, 60 aa, Artificial Sequence
  Synthetic
VKDKVKKAEDDVRRLLERNRRLVEESKKSSEEFLRRVEKLVDDARKKVEDALRKVRETAR

SEQ ID NO: 23971 - protein, 60 aa, Artificial Sequence
  Synthetic
SELEKVLRDLEKNSRENEELLRRSNKKLKDVVDKIKKKLERALEELREVLEKIRRELSRS

SEQ ID NO: 23972 - protein, 60 aa, Artificial Sequence
  Synthetic
MDDKVRKAEEDVKRILDENRDLVRRSEENSKRLLERVRELVERVKDAADKLLREVREEAR

SEQ ID NO: 23973 - protein, 60 aa, Artificial Sequence
  Synthetic
SELETVLRELEENSRRNEELLRRSLDRVRRVLEDVTKKLREVLEEVRTVLEDVKRKLSRV

SEQ ID NO: 23974 - protein, 60 aa, Artificial Sequence
  Synthetic
VRDKVKEAKDRVRKILEDNRRLVEKSEEDSKRILETLRKLVEEMKRELERIETELREAAR

SEQ ID NO: 23975 - protein, 60 aa, Artificial Sequence
  Synthetic
SELETVLRKLEENSRRNKKLLRDVLEEDKTVLRDVERKLREVLDELRKVLEDIRDKLSRK

SEQ ID NO: 23976 - protein, 60 aa, Artificial Sequence
  Synthetic
VKDKAETMKKAVEEILDRNRKLVTEAEKRSEDSLRKLRKSVKEVEEKVKRVLEEVKKEAD

SEQ ID NO: 23977 - protein, 60 aa, Artificial Sequence
  Synthetic
DELERLLEELERNSRENKKRLDESRKRVKEVLDRIEKKLRDVLREVEDVLRKIREKLERK

SEQ ID NO: 23978 - protein, 60 aa, Artificial Sequence
  Synthetic
VKDKVKELRDRVKELLDRNREEVRKSEEDSKRVLDEVKRLVDELRERLREIRKRVEEEAK

SEQ ID NO: 23979 - protein, 60 aa, Artificial Sequence
  Synthetic
SELEDVRRELEENSRRNEETLRRSLAELEENSERNRRELERVLAEVEKVLKKATETLSRV

SEQ ID NO: 23980 - protein, 60 aa, Artificial Sequence
  Synthetic
VRKEVKKVEDDVRRILEENRRLVEESERRSRRILEENEELVEDIKRKLREIEKELRERVR

SEQ ID NO: 23981 - protein, 60 aa, Artificial Sequence
  Synthetic
SEVEELEREIRELVERNRELVRRLEEEARRLSRRNEELVRELKERAERLVKELKERLDRV

SEQ ID NO: 23982 - protein, 59 aa, Artificial Sequence
  Synthetic
KDTLDEVRKEVRKLSKENEERLREVLEESRRLSKRNEEILKEIAERVKRLVDKLTDDIR

SEQ ID NO: 23983 - protein, 57 aa, Artificial Sequence
  Synthetic
SEVEDVERRVRKLLEENDRLLEENEKSARELMKRDKKVSDENEKSVRDLLDRLRKEI

SEQ ID NO: 23984 - protein, 56 aa, Artificial Sequence
  Synthetic
LEELLKKLRKLSEDNERLLRESNERAKRSTDESERLSRETNERVKDVVTRLKEASK

SEQ ID NO: 23985 - protein, 57 aa, Artificial Sequence
  Synthetic
DEVDEARKEVDKLAKENTELVKRNKDSVKELVREDEDELRKNRESVDELLRRLEEEI

SEQ ID NO: 23986 - protein, 56 aa, Artificial Sequence
  Synthetic
LEEVLKTLREVSDRNKKLLEESNERVRKSTKESKDKLRKSNEEVKRVLKELRDTDT

SEQ ID NO: 23987 - protein, 59 aa, Artificial Sequence
  Synthetic
DELDRLLEEVKRSLEDVEEKLKKLEEEVKRVNDELRKRLTRLLREVERSLKRVEDLIRN

SEQ ID NO: 23988 - protein, 56 aa, Artificial Sequence
  Synthetic
LEEVRERLKESLDRLRKRVEDLKRRLRESLESVRKLVEDLERALRKSLEELRERVR

SEQ ID NO: 23989 - protein, 59 aa, Artificial Sequence
  Synthetic
EELDRLLKRVEESLRRVERILKELLDRVRKVNEDVKRTLDDLLRRSKESLDRVRKLREE

SEQ ID NO: 23990 - protein, 56 aa, Artificial Sequence
  Synthetic
LEEVEERLKRSLRELERLVRELEEELKKSVKSVRDLLEELKRRNEDSLRRLAEEIK

SEQ ID NO: 23991 - protein, 59 aa, Artificial Sequence
  Synthetic
KELDDLLREVERSLDRVRKRLEDLLREVERVNEEVKKRLRDLLEELKRVADELRKLRED

SEQ ID NO: 23992 - protein, 56 aa, Artificial Sequence
  Synthetic
LEDLERELKRSLKELRDEVRELEERLRRSVESVRRVLKELEERARRLLKEVRDEIK

SEQ ID NO: 23993 - protein, 59 aa, Artificial Sequence
  Synthetic
SELDKLLEDVKRSLDEVKRLLKELLDRVKKVNKELEEVLKRLEEDSRRVVEEVEKATRD

SEQ ID NO: 23994 - protein, 56 aa, Artificial Sequence
  Synthetic
LEDLERKLEDSLRRLEELLRRLEDELRKSLTSVRKRVKELEEKNRELLKRVEEKIR

SEQ ID NO: 23995 - protein, 59 aa, Artificial Sequence
  Synthetic
KELDELLKRIEDVVRRLEEELKRLLDEARKVNEDLERRLRKLREDVERSLREVDKMIRN

SEQ ID NO: 23996 - protein, 56 aa, Artificial Sequence
  Synthetic
LKDLEKALEELLDRVRRLVKELRDRLRDSLRSVEEEVKKLKDELDRSRKAVRDKVK

SEQ ID NO: 23997 - protein, 59 aa, Artificial Sequence
  Synthetic
SELDRLLERVRKSSTDSEKTLKELRDEIRRVNDEVRKVLEELLKESRRVAEEVKKVIDN

SEQ ID NO: 23998 - protein, 56 aa, Artificial Sequence
  Synthetic
LEDLERELRRLLRRDRELVKKLEEDLRRSLKSVEEEARRLERANRELLREVEEKAK

SEQ ID NO: 23999 - protein, 59 aa, Artificial Sequence
  Synthetic
SELDKLLRDVEESSRRSEETLRKLEKEVRDSSTESERILRELRDRIKKVADDVEKVIRD

SEQ ID NO: 24000 - protein, 56 aa, Artificial Sequence
  Synthetic
LEELEKRLEDLLRRDKKLVDDLRKKLRDLEKRDRDLVEELRRELEELLKRVEDAAR

SEQ ID NO: 24001 - protein, 59 aa, Artificial Sequence
  Synthetic
SELDRLLREVEKSSKRSEETLRDLRREVEDSSRRSEEILRRLLEESEKVAREVRKLIED

SEQ ID NO: 24002 - protein, 56 aa, Artificial Sequence
  Synthetic
LEELEKRLRELLKRDKELVDELRKRLEELLKRDRELLKRLEEENRRLLEEVERRAR

SEQ ID NO: 24003 - protein, 59 aa, Artificial Sequence
  Synthetic
KELDELLDEVRRSSETSERILRKLLREAEESTDRSKRTLKELLRELEEVVERVKKMIRD

SEQ ID NO: 24004 - protein, 56 aa, Artificial Sequence
  Synthetic
LKDLEKALRDLLDRDRKLVEELEDRLRKLAEEDEKVLRELEEELKRLLEEVAEETR

SEQ ID NO: 24005 - protein, 60 aa, Artificial Sequence
  Synthetic
SLLEKLERDLERVHKESEDLARELRKELKRVHEESRELMKEIDKELRRVLEEVKSLLRRG

SEQ ID NO: 24006 - protein, 62 aa, Artificial Sequence
  Synthetic
EDVKDKVRRVEEKVEELLDRNRKLVEEVRREVEKVLRDDRRLVREVERKLKEALDEVRERVR

SEQ ID NO: 24007 - protein, 60 aa, Artificial Sequence
  Synthetic
SEVEEVERRVDEVLKELKRKVDRSREESERIARELERLVEESEKKVRDVVRELEDLLRKV

SEQ ID NO: 24008 - protein, 54 aa, Artificial Sequence
  Synthetic
DLKEKIKEVEDRVDKVIKENKDLLDDVERRVRKVIKENEDLIKELRKRVEEVAR

SEQ ID NO: 24009 - protein, 60 aa, Artificial Sequence
  Synthetic
SKVEELEKRVRKVMEKLKKLLKDSEKESDDVARRLEELLEESEREVREVLRELEDLLRKV

SEQ ID NO: 24010 - protein, 54 aa, Artificial Sequence
  Synthetic
DVDETIKRVEEEVKKVVDDNRRLNEEILRKVKKVIDDNRRLIEKVREDVDRMAK

SEQ ID NO: 24011 - protein, 57 aa, Artificial Sequence
  Synthetic
SVVETVDKRLKRLLEKVEKSTEDSRRTAEESKKRVDRSTERVKEVLDRLRREVERLK

SEQ ID NO: 24012 - protein, 59 aa, Artificial Sequence
  Synthetic
KEKVRTVEKRAEDVIREARKLLEESKRRHDKVVEELERLLKKSKEDVDRVIKELEERRK

SEQ ID NO: 24013 - protein, 57 aa, Artificial Sequence
  Synthetic
DEVEEVKKRLDELRKEVERSTREVREVLKKLLKEVKDSTDDVRRTIEKLLRDVERLK

SEQ ID NO: 24014 - protein, 59 aa, Artificial Sequence
  Synthetic
KEELKKVEDRVREVIKDLEELLRDSKRTVEKVERELEDLVRKSEEEAERVERELEERAR

SEQ ID NO: 24015 - protein, 56 aa, Artificial Sequence
  Synthetic
SVVEEVDRLLEELLRKVKKSTDESKETAKESRKEVKRSTEDNDRTVEKLRDEVRRL

SEQ ID NO: 24016 - protein, 59 aa, Artificial Sequence
  Synthetic
DDRVREVETRVKKVIDDVRRLVTESKKDHERVVKELRELVEESKRRNDRVVEEAKETAR

SEQ ID NO: 24017 - protein, 56 aa, Artificial Sequence
  Synthetic
SMVEEVKKVLEKLKRDVDKSTDEVRDMLRRLLEEVRESSREVERRLRELKEEVDRF

SEQ ID NO: 24018 - protein, 59 aa, Artificial Sequence
  Synthetic
KEEVKKVKKEVDEVIRRLKELVRRSEEEARRVIKTLEKLLRDSKKRVEDVIKDLDRTVR

SEQ ID NO: 24019 - protein, 57 aa, Artificial Sequence
  Synthetic
SMVEKVEEDLKKLTRDVEKSTEESRKTAEDSARDVRRSSREVEDVLRRLRKEVEELK

SEQ ID NO: 24020 - protein, 59 aa, Artificial Sequence
  Synthetic
KEEVKKVEDKVKEVIERLKKLLDESKKRHEDVIRELEKLLEESERKVRKIIRELEETLR

SEQ ID NO: 24021 - protein, 57 aa, Artificial Sequence
  Synthetic
SVVEEVKRRLEELEKRVEDSTRDSKRTLDESERELEESSRDNRRTVEELLDELRRLK

SEQ ID NO: 24022 - protein, 59 aa, Artificial Sequence
  Synthetic
KEEVEKVEREVREVIKKLRDLVRRSREEHEKVIEKLKRLLEESEDTNRKVIKKVEDDLR

SEQ ID NO: 24023 - protein, 61 aa, Artificial Sequence
  Synthetic
SVTDEVREKLRRLLEELREVVKRVEDISRKTHEETKRVVEKVKRILEKLKREIEEVIRELG

SEQ ID NO: 24024 - protein, 59 aa, Artificial Sequence
  Synthetic
KEDLERLRRDVERVIREIEKLLRDVEEKVKETIKTDEDLLRRVKEDVERVLEEIDRRLK

SEQ ID NO: 24025 - protein, 61 aa, Artificial Sequence
  Synthetic
SVAETVKERLKDLHRRTKESNERAKRISDELNKHNEKSVRDVDREVKRLLEEITEVIKRLG

SEQ ID NO: 24026 - protein, 59 aa, Artificial Sequence
  Synthetic
KEALRKLDEEVKKVADDDRRLNEESRKRAKDSIEESRKLVRDVAERVKEVARKIREDLR

SEQ ID NO: 24027 - protein, 60 aa, Artificial Sequence
  Synthetic
DEARELIERVKRVLDRVREENTRVNKELHDILRRVEKRNRDLLRELREILKDVKKKADEV

SEQ ID NO: 24028 - protein, 55 aa, Artificial Sequence
  Synthetic
RELEKELRRLIAEVARIVEESRRNLERIEEAIKRISETSEKEIREIEDRIKKDVD

SEQ ID NO: 24029 - protein, 60 aa, Artificial Sequence
  Synthetic
SEAERAREEAKKLKEEIKKSNDELRKAAEKLKRDIERSNDELRKAIEELKRRVESLLRRV

SEQ ID NO: 24030 - protein, 55 aa, Artificial Sequence
  Synthetic
DEVLKEVKRIAEELHRHNREVLERIEKIARELEKHNRDVLDDIRRIVEKLERDLN

SEQ ID NO: 24031 - protein, 60 aa, Artificial Sequence
  Synthetic
SEEERAREDLERLREEIRRSNEKLEEDSDKLRRDIEESNRRVEEEIRRLKEDVERKLKDV

SEQ ID NO: 24032 - protein, 55 aa, Artificial Sequence
  Synthetic
EEVLEEVRRLVKKLHEHNEESLRRSEEILKDLERHNRDVLREVEEIVREALERLD

SEQ ID NO: 24033 - protein, 60 aa, Artificial Sequence
  Synthetic
REAEEAKKEADRLEEEVRDSNRKLEEDSKRLEREIRESNRKLKETAERLLRDVERLLKDV

SEQ ID NO: 24034 - protein, 55 aa, Artificial Sequence
  Synthetic
KEVLEDIRRIVKELHDHNKKSMEDSRRIIEELKRHNKRVIDEVKKIVDELREKLR

SEQ ID NO: 24035 - protein, 60 aa, Artificial Sequence
  Synthetic
REAEEAEKELKRLEDDIKKLVEDLDREAKRLKKEVDDSNRELEKESRRVKKEVRELLKDV

SEQ ID NO: 24036 - protein, 55 aa, Artificial Sequence
  Synthetic
DRMLEKVKRIVDELRKLLKTVLDDVRRIVEELHRHNKESMERTRKILEDLARRLT

SEQ ID NO: 24037 - protein, 60 aa, Artificial Sequence
  Synthetic
SEAERAREVLERLREEVERSNKRVREELKRLTEDVRRSNKKLREDSEEVRKRVEDLLKDV

SEQ ID NO: 24038 - protein, 55 aa, Artificial Sequence
  Synthetic
DEMLRRVRRIIEELHRLNKEALDRVRKIIEDLHRKNEDSLKKTEDILRRLEEELR

SEQ ID NO: 24039 - protein, 56 aa, Artificial Sequence
  Synthetic
SSIEEVLERLRRLSDEVRKRTDDVLERAREISRETEERSRRINEEIERIVEELKKR

SEQ ID NO: 24040 - protein, 59 aa, Artificial Sequence
  Synthetic
KEAVDRARREVERLVKENEDILKRLEEEVRKLVKRNEDLVEENRREVEKWRKELEDRKR

SEQ ID NO: 24041 - protein, 56 aa, Artificial Sequence
  Synthetic
SEIDEVLKKLRDDSKKVEEDTRRVLEELERISEKTRKDSEEVLREIEDIVEKLKRR

SEQ ID NO: 24042 - protein, 59 aa, Artificial Sequence
  Synthetic
REEVERAEEEVRKLVEENKRIVKEAKERVDELVERNKEIVEEIRREVERLKKELEDRRR

SEQ ID NO: 24043 - protein, 57 aa, Artificial Sequence
  Synthetic
REVEEVTKELRKISKEVEDLTREVLREAREISRRTEEESRRLNKEIAEIVERLRREG

SEQ ID NO: 24044 - protein, 59 aa, Artificial Sequence
  Synthetic
KEDVRRVAEEVKRLVDKNRRIVEEAKKEVDRLVKRNEDLMRRNREEVERWKRELEEDRR

SEQ ID NO: 24045 - protein, 57 aa, Artificial Sequence
  Synthetic
SEVDEVLKTLKKLSDDARKKTKEVLDRLRDISRRVEEESRKVLEEIRRKVEEVKKRR

SEQ ID NO: 24046 - protein, 59 aa, Artificial Sequence
  Synthetic
KDKVRKVKEDVRRLVEDNKRIVKEAREEVERLKERNKDIVRRIKETVDRLKDELRKRAE

SEQ ID NO: 24047 - protein, 57 aa, Artificial Sequence
  Synthetic
SDVDRVLKELEDISKDVEDKTREVLKRLKEISDEVKKRSEDINREIARIVEDLERRR

SEQ ID NO: 24048 - protein, 59 aa, Artificial Sequence
  Synthetic
KEKVKDARRVVRELVERNKEIVRRAAEVVKKLKKENAKLVEDNTREVKKWKERLERRRR

SEQ ID NO: 24049 - protein, 57 aa, Artificial Sequence
  Synthetic
SEVEDLLRKLKEISDESRERIKRLLEELEEISRKSKEDSERSNEELHRIVKRLKEEN

SEQ ID NO: 24050 - protein, 59 aa, Artificial Sequence
  Synthetic
EEDLRRAEDDVRRLIEDNKRLLEEAKRRVDDLRRKNEEILRESEKNVRRIEKELEDRRR

SEQ ID NO: 24051 - protein, 57 aa, Artificial Sequence
  Synthetic
SEVEDLLRKAEEISDRSRREIEKLLRELERIVREVRERSKRSNDELHRIVKELKEER

SEQ ID NO: 24052 - protein, 59 aa, Artificial Sequence
  Synthetic
EKKLRDVEKRARELIRDNERLLEDAKRRVDELRRELKKILDDSRRNVERIMKELDDEKR

SEQ ID NO: 24053 - protein, 57 aa, Artificial Sequence
  Synthetic
SEVDELLKRLEEISEESRRRSEDSNREVHEIVKEVKKRSEDSNRRLHKIVEDLKREN

SEQ ID NO: 24054 - protein, 59 aa, Artificial Sequence
  Synthetic
KDELKRAEDRVRELIKENKRILDESKENAERIDRELKKILEDSKRNVEEIAKRLEEDRK

SEQ ID NO: 24055 - protein, 57 aa, Artificial Sequence
  Synthetic
KDVEKLLRELEKISEDSKRESDKSNKEVHDSSREVERRSRESNRRLHKVVEDLKRTN

SEQ ID NO: 24056 - protein, 59 aa, Artificial Sequence
  Synthetic
DEDLRRAKREVERLIRENEKILEDSRENLRRIAERSRRVLEESERNVRRLIEELEETRR

SEQ ID NO: 24057 - protein, 57 aa, Artificial Sequence
  Synthetic
REVEELLKDLRRILEEVKRRIEKLLDELRKISEESRRRSEKSNEELHDIVKKLKDEN

SEQ ID NO: 24058 - protein, 59 aa, Artificial Sequence
  Synthetic
EKTLRDAEREVKKLIDTLRKILEDARREVKKLIDKNEKILRDSEKNVRDIAEELRRTRK

SEQ ID NO: 24059 - protein, 57 aa, Artificial Sequence
  Synthetic
DEVRELLREVKEAVDEVRRRSEESNREAHRVSEESEKRSRESNKRLHEIVEDLKRRN

SEQ ID NO: 24060 - protein, 59 aa, Artificial Sequence
  Synthetic
EEKLKRAEEEIRKVIEDLRRILRESRENAKRIIRRNREILRESKKNVEDLERELEETRR

SEQ ID NO: 24061 - protein, 57 aa, Artificial Sequence
  Synthetic
SEVEELLKRLRESSRRVRELSKRSNEEVHRSSDKVRRDSEESNRELHKIVEDLKREN

SEQ ID NO: 24062 - protein, 59 aa, Artificial Sequence
  Synthetic
ERKLREARKEVKKLIEESREVLERSERNIRELIKESRRLLEESRRNVERLKKELEDTRK

SEQ ID NO: 24063 - protein, 60 aa, Artificial Sequence
  Synthetic
SEEDEARKDVKELEDRLRKINEDSERAVRRIEEELKRILEENDREVKRLLRKIEELLRRK

SEQ ID NO: 24064 - protein, 56 aa, Artificial Sequence
  Synthetic
IETVIRELRKALEEAARRSKRLIDELKKVLEEVKRANEETNKRLTEVVEEVAERIR

SEQ ID NO: 24065 - protein, 60 aa, Artificial Sequence
  Synthetic
KEKEDAEREVERLERESRRVNRESEEEIKRLLRESEKVNEDSEREVRRIREELERLLRKK

SEQ ID NO: 24066 - protein, 56 aa, Artificial Sequence
  Synthetic
IDKVLTELRRSSEEVTRLSEELIERVARSSRKVKELSRKLIEELRKVLKDVARRLE

SEQ ID NO: 24067 - protein, 60 aa, Artificial Sequence
  Synthetic
EELERLEKDLREVIKDSERSSDDVRRRLEEVIRDNERLLEELDERLKEVIRDVEDLLRKK

SEQ ID NO: 24068 - protein, 59 aa, Artificial Sequence
  Synthetic
KKLIDDLRRKIEESLKDSRRLDEEARKEIERISRKTREDIKELLDRIKEVLDEIRERIR

SEQ ID NO: 24069 - protein, 60 aa, Artificial Sequence
  Synthetic
DELEDLERKLKEIIDDSKRLLDELEKRLRESNREVERLLDELRKELEKVIRDVEELLKKK

SEQ ID NO: 24070 - protein, 59 aa, Artificial Sequence
  Synthetic
KELIDKLVRELEKSLEESRRLIEELRKEIERTSREIEKRIRDLLKEIKDVLDDIRRRIE

SEQ ID NO: 24071 - protein, 59 aa, Artificial Sequence
  Synthetic
SELEEVEKRAEELARTLEELNRDVNRRLEELLRRLEKINRTVNDELRKLLEELKDVRRR

SEQ ID NO: 24072 - protein, 59 aa, Artificial Sequence
  Synthetic
KEDLDRLDKRVRDIVRDLERINEETRKTLEEIRERLERILKRTEENLKEIKEEVRKDEK

SEQ ID NO: 24073 - protein, 60 aa, Artificial Sequence
  Synthetic
SELEKVTEDVRRLLERLRDINRRVNEALRRLAEELKRLNDEVNKLLRELVTELKKASKDG

SEQ ID NO: 24074 - protein, 59 aa, Artificial Sequence
  Synthetic
KDKLEELKREVERIEKDVREILKRTEDNLRRIVEELKEINERTEDSLRKIVRELSEDRK

SEQ ID NO: 24075 - protein, 60 aa, Artificial Sequence
  Synthetic
REKDELRKKVEELLKRLEEISKRTKDSVERVLRELDKITKESKKRAKKLVDRLKELLKRV

SEQ ID NO: 24076 - protein, 59 aa, Artificial Sequence
  Synthetic
ERAIEEVLKTIEELIKEVEDVNRRVNETIRELLERLRRANEDVIRKVEKLIKEVEDATR

SEQ ID NO: 24077 - protein, 60 aa, Artificial Sequence
  Synthetic
SEKERLRDMLRKIRETLDRISEDTKRSLDEVRRRLEEISKRTKDNARKLVRELEELLRRV

SEQ ID NO: 24078 - protein, 59 aa, Artificial Sequence
  Synthetic
EEFVKRVEDTLRELLDRVRRENERVNRDIDRLLKEVEERNKRVNDELRKLIEDVKEAAR

SEQ ID NO: 24079 - protein, 60 aa, Artificial Sequence
  Synthetic
DDVRELIERLERILKRVEDINRDVNRKLRRVLERVRKDNEDSNRKTEKVLRDVKERADEI

SEQ ID NO: 24080 - protein, 59 aa, Artificial Sequence
  Synthetic
EKLLRDVERELKRVREDLERILRESRDVVRRVKEELDKILEESRRKVEKVRKDLEDTRK

SEQ ID NO: 24081 - protein, 60 aa, Artificial Sequence
  Synthetic
SEVEKLITDLRRILKEVEERNRELNKRNDETLKRVEETNRRVNKELKEILDRVIDEARRK

SEQ ID NO: 24082 - protein, 59 aa, Artificial Sequence
  Synthetic
EDLLRRVEEELRKVEKDLKRILDKSRDDLRKSRERLERILRRSEEIVREVEERLRRAAT

SEQ ID NO: 24083 - protein, 60 aa, Artificial Sequence
  Synthetic
DEVRKIIKELEEILEEVRKRNEKLIRENEETLERVRKINEKAIRELEDILRRVKEAVERK

SEQ ID NO: 24084 - protein, 59 aa, Artificial Sequence
  Synthetic
EDVLRDAERRVREVREKLERINKTSRDRLKRSKEEADRINKESREVVKRVKEELEKTAT

SEQ ID NO: 24085 - protein, 60 aa, Artificial Sequence
  Synthetic
DEVERVIRELERILREVEKRNRDVLRKNEETLREVRERNERAIEELRRILKKVKEEAERK

SEQ ID NO: 24086 - protein, 59 aa, Artificial Sequence
  Synthetic
EDVLRTVRKKVEEVREALDRINETVKKALDDSRRRLEKINRDVRRDVEKVREDLERTAT

SEQ ID NO: 24087 - protein, 60 aa, Artificial Sequence
  Synthetic
DEVKKLIDDLRKILDRVRKENRRVIEELRKILEDVERRNREAIERLERILRRVVDLMRKK

SEQ ID NO: 24088 - protein, 59 aa, Artificial Sequence
  Synthetic
EEVLKRVREEVDRVRRELDRINEDSERVLRDVARELERINREVRKRLKEVEKRLREAAK

SEQ ID NO: 24089 - protein, 60 aa, Artificial Sequence
  Synthetic
SEVEKIIKELREILERVREDNRKIIDDLRKILKEAEDTNRKVIKELKEILKDVSKLMKEK

SEQ ID NO: 24090 - protein, 59 aa, Artificial Sequence
  Synthetic
EELLKEAEKDVRRVKEKLDKINRDVREELKKVAEDVKRINDRSREELRRVKEELKKDSD

SEQ ID NO: 24091 - protein, 60 aa, Artificial Sequence
  Synthetic
KEVEKVIEELRKILDDARRENERLLRELEEILKRVEERNRKLLEDLRRILEEVRKKAKDI

SEQ ID NO: 24092 - protein, 59 aa, Artificial Sequence
  Synthetic
EEVVKRVEEELKKVKEDVERINKEVRDRLREVEERLEKINEDTERTLKKVKDELEETKR

SEQ ID NO: 24093 - protein, 60 aa, Artificial Sequence
  Synthetic
DELRDVLRRLREVLTELEKENRKSIEELKKLNEDVARDIKRVIDELRKLLKRVKEEIEKN

SEQ ID NO: 24094 - protein, 55 aa, Artificial Sequence
  Synthetic
EEVRKELEDVRRKAEKILRDNDERLKESNRHMEKLLREVKEELKRVRDAVEEARK

SEQ ID NO: 24095 - protein, 60 aa, Artificial Sequence
  Synthetic
DEVRDVIKKLKDLNDRLDDENKKSIEDLKRELERLERRNRDSIRRLEELLKDVADKIRRR

SEQ ID NO: 24096 - protein, 55 aa, Artificial Sequence
  Synthetic
KDVRKRLRESNEHMKELLKENKELLKRLEDEVKRILERNKKELDRVLRRAEELRK

SEQ ID NO: 24097 - protein, 60 aa, Artificial Sequence
  Synthetic
RSVEEVRKVLEELKREHEKISKKTEEVLEDLKRRHEEIIKRVRDVLREIEEDLRRIRSRV

SEQ ID NO: 24098 - protein, 59 aa, Artificial Sequence
  Synthetic
DEKVEKVIRELRRSVEDSKRRNDEAIRRLEESVRKSSDEVRRAIKELRDLLKKVRDTTK

SEQ ID NO: 24099 - protein, 60 aa, Artificial Sequence
  Synthetic
STVERVREEADRLRKEHERISDETRKVLRKLEEDHERISRRTEELIERIEREVRKIESRV

SEQ ID NO: 24100 - protein, 59 aa, Artificial Sequence
  Synthetic
DEKVKRVEEEVRRSVEESKKENKKVIDDARRSVKRSEDRNREVIKEVKRLLDTVRERAK

SEQ ID NO: 24101 - protein, 60 aa, Artificial Sequence
  Synthetic
STVEDVRRRADELRRRHKKISEETERVLRRIEEAVRRILEDLRRILKEIEDRVRELLSRV

SEQ ID NO: 24102 - protein, 59 aa, Artificial Sequence
  Synthetic
DEKVKEAKRRVTESVRKSKDRNRRVIEEVDRLLKRVEEEVRRVKEEAKELLREVAERTK

SEQ ID NO: 24103 - protein, 57 aa, Artificial Sequence
  Synthetic
SSVEKVIEDLRRISEKVKKRTEDVLREAEKILRRVEKDNKKVNDDARRIVEELERRG

SEQ ID NO: 24104 - protein, 59 aa, Artificial Sequence
  Synthetic
KRLVDRVREAAKDIEDENREVLRRVEEILRRIEEELKRSSDETEKAVREIKRRLDERAR

SEQ ID NO: 24105 - protein, 57 aa, Artificial Sequence
  Synthetic
EEVERVLEEIKRISTDVARRSKEVLKRARESSERVKRRTEEVLEEIRKTNEDVARRA

SEQ ID NO: 24106 - protein, 59 aa, Artificial Sequence
  Synthetic
KKVVDRLRKEVKRNEDENREMVREVEEEVRRLEKENEEAVRRAADIVRRSEEHLRERTR

SEQ ID NO: 24107 - protein, 60 aa, Artificial Sequence
  Synthetic
KEVEDLLREVEKSSEKVRELIERSIRELERILEKVAEEIRRSIEELEKILERVAEVAKRR

SEQ ID NO: 24108 - protein, 59 aa, Artificial Sequence
  Synthetic
EKIVKRVEDEIRRLMKKSDELLERSTKVVEDIKRELEKLLETSSRMAEDIKRKLEELRR

SEQ ID NO: 24109 - protein, 60 aa, Artificial Sequence
  Synthetic
SEVEKLIEELERILEEVARRLKKSNEDLRKILKEVAKRIKDSIRDLRRILEEVADELRRR

SEQ ID NO: 24110 - protein, 59 aa, Artificial Sequence
  Synthetic
ERIVEEVERAAEEIKRRLEELVRRSEKSVEEIERELRKLLKDSSDVVREIKKRLEDERR

SEQ ID NO: 24111 - protein, 60 aa, Artificial Sequence
  Synthetic
SEVEKLLKEVEDSSRKVEEDLRDSNRELKKILDEVADRIRKSIKRLEDILKKVAEDAKRR

SEQ ID NO: 24112 - protein, 59 aa, Artificial Sequence
  Synthetic
EKIVRDVERRVRELKERSRRIVEESERSAREIKRELKRLEDDSSRVVEDIRKKLEELAK

SEQ ID NO: 24113 - protein, 60 aa, Artificial Sequence
  Synthetic
REVEELIKRVEESSRDVERRLRESNEEVERSTRRVAEEIKKSIDRVREIVERVERKKERV

SEQ ID NO: 24114 - protein, 59 aa, Artificial Sequence
  Synthetic
EKIVERVRRVIEELKRRSDEIVKESERSVRRVEKETTELLEESSRAVERVERRLRELVR

SEQ ID NO: 24115 - protein, 60 aa, Artificial Sequence
  Synthetic
SEVEKLIEEVRRSSKKVEEDLDRSNRELEDILRRVAEELEKSNRELEKILKEVAERVKRR

SEQ ID NO: 24116 - protein, 59 aa, Artificial Sequence
  Synthetic
EEIVKRVEEEARRLKERSREIVKRSEDSAREITKALRKLVRDSEDSVRKIKEKLKEETR

SEQ ID NO: 24117 - protein, 60 aa, Artificial Sequence
  Synthetic
REVEELDKRLKESSTEVEERLRRSNREVEDSTRRVEEEARKSNEELREILERVAEDVKRR

SEQ ID NO: 24118 - protein, 59 aa, Artificial Sequence
  Synthetic
ERIVERVERSARELMRRSRDIVRRSKESIERLKKRTRDLVKESRESVEKIKRDLEELRR

SEQ ID NO: 24119 - protein, 59 aa, Artificial Sequence
  Synthetic
SEVEKLLKELEDSSKKVEDDLRKSNEELRKIVEEVADLIRRLNKELEEILREVRERMRR

SEQ ID NO: 24120 - protein, 59 aa, Artificial Sequence
  Synthetic
EEIVRRVEKIVRDLKRRSDELVRRSRKSVEEIRKELEELVERDRRSVERIKEELDKERK

SEQ ID NO: 24121 - protein, 60 aa, Artificial Sequence
  Synthetic
SEVEKLTKEVRDSSKRVEDELRKSNERLKESTDRVADEIRRLNKELKEILDKVAREVERR

SEQ ID NO: 24122 - protein, 59 aa, Artificial Sequence
  Synthetic
EEIVERVERDARKVKEDSKRLVEESEESVRRLKTDTERLVEEDKKSVDTIKEELKKLTK

SEQ ID NO: 24123 - protein, 59 aa, Artificial Sequence
  Synthetic
DEVEELRKELEDSSREVEELIRRLNKEVEKSTREVAKRVKDSNKRLDEILKKVAEEVKK

SEQ ID NO: 24124 - protein, 59 aa, Artificial Sequence
  Synthetic
REIVERVREEVEKLKKRSEDLLERDKESIDKLDKETKELVEESRKSVRDIERELKKLSD

SEQ ID NO: 24125 - protein, 60 aa, Artificial Sequence
  Synthetic
DEVEKLIKDVEDSSREVEERIRDLNRKAKKIVREVAERIRELNERLKEILDKVAEEVKRR

SEQ ID NO: 24126 - protein, 59 aa, Artificial Sequence
  Synthetic
EEIVKRAEKRIRELKKKSDELLKRDRDSMDRIKKELEKLTREDEESVRRIERELKRLAD

SEQ ID NO: 24127 - protein, 60 aa, Artificial Sequence
  Synthetic
SEVEKLIEEVRRSSEEVERRIKKLNDDVRRSTEKVEEDIRRLNEELKKILDEVAKEMERR

SEQ ID NO: 24128 - protein, 59 aa, Artificial Sequence
  Synthetic
ERIVRRVEKIIRDLKKRSDELLKEDRRSAEEAKRETDRLVEEDKRSVDEIRERLKELSR

SEQ ID NO: 24129 - protein, 60 aa, Artificial Sequence
  Synthetic
DEVEELLRRVEEIVERVAKRIEELNRRLEEILEEVARRSTKSIKELEDILRKVAKEMERR

SEQ ID NO: 24130 - protein, 59 aa, Artificial Sequence
  Synthetic
EEIVERVERRIRELKKRLEKLVRDDEESVKEIRKKLEELVKRSSDVVERIKRELDKLRK

SEQ ID NO: 24131 - protein, 59 aa, Artificial Sequence
  Synthetic
SEVEKLLRELRESSREVEERIRKLNRELEKIVRDVDRESARSIEELKRIAEEVAERAKR

SEQ ID NO: 24132 - protein, 59 aa, Artificial Sequence
  Synthetic
ERIVKEVEEEVRRLKKRSTKLLEDDRKSVEDIKERLKELVRRSSEVVKEIEERLKRLEK

SEQ ID NO: 24133 - protein, 60 aa, Artificial Sequence
  Synthetic
SEVEDLLRRVRESSKEVEERIRKLNDELRKSTKEVEDRSRRSIERLDRIVEKVAREVERR

SEQ ID NO: 24134 - protein, 59 aa, Artificial Sequence
  Synthetic
EKIVRDVEREVRRVKERSDRLLEEDRKSVEELKTRTDRLLEESSKRAEDIKRKLKELEK

SEQ ID NO: 24135 - protein, 60 aa, Artificial Sequence
  Synthetic
SEVEKLLREAKESSREVKDRSKKSIDELRESTKTVERLIRDLNRKLKEILDRVADDMRRR

SEQ ID NO: 24136 - protein, 59 aa, Artificial Sequence
  Synthetic
EKIVRRVEEIVRRLKKESKDLVEESTRVADELRRRTDRLVEEDERSVRKIKEDLDRLRK

SEQ ID NO: 24137 - protein, 60 aa, Artificial Sequence
  Synthetic
SEKEEAKRRARELEKRTDELLEESTRVNEESKRHLKELLDESRRTAKRVKEEIDKLLKEK

SEQ ID NO: 24138 - protein, 56 aa, Artificial Sequence
  Synthetic
VDTLLERVDRSSKEVADRMRKSNEEVKDVNRRVAKALKDSNRDVERVLEDVARKIK

SEQ ID NO: 24139 - protein, 60 aa, Artificial Sequence
  Synthetic
SEKETARKVIEELRKETERLLRESTKTNEDSSRHAKELLKRSEDVAREIEERIDRLLEEK

SEQ ID NO: 24140 - protein, 56 aa, Artificial Sequence
  Synthetic
IEEVIKRLEDSSRDVERRLRKSNEDVKRVNKEVADRLKESNDRLREELKKVEDDIR

SEQ ID NO: 24141 - protein, 60 aa, Artificial Sequence
  Synthetic
DEKEDAERKIRRLEERTKKLLDDSTKTNKESRDHLRKLLADSEKTARDIKRAIKKLLDDK

SEQ ID NO: 24142 - protein, 56 aa, Artificial Sequence
  Synthetic
VDTLLTEVTDSSRRVEEELKRSNDEVRRVNREVAERLKKSNRELEEVLRKVAEDIK

SEQ ID NO: 24143 - protein, 60 aa, Artificial Sequence
  Synthetic
SERERAEEEAKKAKKEAKRLLDESTKANEDSKRHADKLLEDSKRAAEDIKRKAEDLLRKK

SEQ ID NO: 24144 - protein, 56 aa, Artificial Sequence
  Synthetic
ARRAIEEVRRALKEAADASRDLNRRAKEANERAAKASEELNKRAEDALRRASEEIR

SEQ ID NO: 24145 - protein, 60 aa, Artificial Sequence
  Synthetic
SEKEEVKKRVDEIKERLKRLLDDSTRTNEESRKHIEDLLEESKKEIDKVRKDLERLLRKK

SEQ ID NO: 24146 - protein, 56 aa, Artificial Sequence
  Synthetic
VDTMTRKVEEVLRDVAEKIKELNRRVEEANKDMARESERLNREVRDVLRKVAKDIE

SEQ ID NO: 24147 - protein, 60 aa, Artificial Sequence
  Synthetic
SDEDRAREDLKRIKEELKRLLRESTEVNKESEKHIRKLLRESEETIRRLKKAIDDLLRKK

SEQ ID NO: 24148 - protein, 56 aa, Artificial Sequence
  Synthetic
IETILRRLERVLKEVEKKSRELNRRVKEVNEKVRRDIERLNKEVKDVLKTVAERIT

SEQ ID NO: 24149 - protein, 61 aa, Artificial Sequence
  Synthetic
DEKERAEERIRELKKRTEELLRESTRVNRESKEHAKELLKRSEDTIRELDERIRRLLERKK

SEQ ID NO: 24150 - protein, 56 aa, Artificial Sequence
  Synthetic
VDTVLARLEESSKEVEDRSKRLNEEVKKVNEEVAKRIKELNEEVERVLRRVAEEIE

SEQ ID NO: 24151 - protein, 59 aa, Artificial Sequence
  Synthetic
SLKEELREKVRKVKEDSERLLRDLERTVKKVREDSKRILDRNRETAKEIERRIRELERN

SEQ ID NO: 24152 - protein, 59 aa, Artificial Sequence
  Synthetic
EELVRKLRKELDDSLKRTKELVDRLKEDLERSLRDSEELARRLDRELEDVLRRIEDEAR

SEQ ID NO: 24153 - protein, 59 aa, Artificial Sequence
  Synthetic
SLLETLKEIVRRVERESARILEDNRRTVTRAKEESKKILDRNAKTVDDLRKEVERLKTE

SEQ ID NO: 24154 - protein, 59 aa, Artificial Sequence
  Synthetic
EELVRRLVEELEKSLRTTERLARELDRKIKESLDTSEELARRLDKRLEEVLKDVKRRAE

SEQ ID NO: 24155 - protein, 59 aa, Artificial Sequence
  Synthetic
RLEEELKKTVDRAREEVKRLLDRDRESVDDLRRAVEEILKTNRRTVEKLRKDLTDLRRN

SEQ ID NO: 24156 - protein, 59 aa, Artificial Sequence
  Synthetic
EKLVRELIEKIKKVLDEVRRLSEKLNEDLREILERVKRLADKLDEELKRMLEKVEETAR

SEQ ID NO: 24157 - protein, 61 aa, Artificial Sequence
  Synthetic
DDVERVKRDIDRLLEKVTRENEKVKEKMKELLDRAREVNRKVKEDIKRLLKEVEDVARREG

SEQ ID NO: 24158 - protein, 58 aa, Artificial Sequence
  Synthetic
EDVRDLERRLREVEEEARKLSEDVRRVLEEVRKELERLSRDTERVLKRVREEIRKIEK

SEQ ID NO: 24159 - protein, 61 aa, Artificial Sequence
  Synthetic
SEVEEVIRRVRKLLKDAKDLNEEVKRRLKELLDRVKRVSEKTKEDIKRLLEEVERVVRTKG

SEQ ID NO: 24160 - protein, 58 aa, Artificial Sequence
  Synthetic
DLAERVRDVLRRVAEAAKELSKDTKRVLDEVKKAIDELLKDNKRTVEEVEKEAKKTLK

SEQ ID NO: 24161 - protein, 61 aa, Artificial Sequence
  Synthetic
DEVEKVKKTLKKLLEDARRRNEEVRKEIEDLDRELERLNRESKKRIEDLLEEVKRVVDRDG

SEQ ID NO: 24162 - protein, 58 aa, Artificial Sequence
  Synthetic
ELVRELERVLDTVRREAERLSRKTREVVDESRRRNKKLLEEDERVVRKVVEDAERKLK

SEQ ID NO: 24163 - protein, 61 aa, Artificial Sequence
  Synthetic
DEVKKVIDDIKDLLRRVEEVSRRVNKELERLLREVREVNKDVKRKLEELLRRVKEVVRRDG

SEQ ID NO: 24164 - protein, 58 aa, Artificial Sequence
  Synthetic
DLAERVRKVLEDVTRAAKELIKRDKKSLEDVKREIEKLSRDVKRVLEKVAEDAKDTLR

SEQ ID NO: 24165 - protein, 60 aa, Artificial Sequence
  Synthetic
SEEEDLARVVERVERDLKRLDDDNKRVLDESRRRNEELVKRTAEIVERVRRELERLRREG

SEQ ID NO: 24166 - protein, 56 aa, Artificial Sequence
  Synthetic
VEEVKRTMEKLLDDVRKANEDSKREIEKSDDEVRKRNEEVVRDIERLLKEVEERAR

SEQ ID NO: 24167 - protein, 60 aa, Artificial Sequence
  Synthetic
SEEEDLRRRAEEVHRRNEELLRDNERTVKKVHDRNRELLEDLRRVVERIERELRRLEEEG

SEQ ID NO: 24168 - protein, 56 aa, Artificial Sequence
  Synthetic
VEEVKERIDRLHEELEKLSRTTKEKLKELHKRLEDVVREVKRRAEELLREIKERAD

SEQ ID NO: 24169 - protein, 60 aa, Artificial Sequence
  Synthetic
SEVEEVRKVVEEVKRELRRLSEDSRRVVEEIVEADKRLSEKNETSVREVKKALKKLKDDG

SEQ ID NO: 24170 - protein, 62 aa, Artificial Sequence
  Synthetic
KDAEELVRDVIRRAREVLKRVEDVHRKVKKDLKKVHDDNKKISEDIDRRLEEVLRKVEEDDR

SEQ ID NO: 24171 - protein, 60 aa, Artificial Sequence
  Synthetic
SEVEDVKRKVREIEKADEELSKRNEDSARESKKRLKEWSDDTKEVVERVRKRLKDLEDEG

SEQ ID NO: 24172 - protein, 62 aa, Artificial Sequence
  Synthetic
EEAERLVREVTKEMKDVHDKNKKLSEDIDKRVEDTNRRLKEVHERVKEEAKKVVRDLEETAK

SEQ ID NO: 24173 - protein, 60 aa, Artificial Sequence
  Synthetic
SLVETVEDVLREVEERLRKLLRDNEESVERIKKRDEDLSKENEESVKRVEDTLDELRERG

SEQ ID NO: 24174 - protein, 60 aa, Artificial Sequence
  Synthetic
VEELVRKVIEDARRLLDDVRRKSERLDREAERVHRENKKLSEDLDRRVKTVVDDVRERAR

SEQ ID NO: 24175 - protein, 60 aa, Artificial Sequence
  Synthetic
SLVEEVEKEARDIERRDDELSKRNEKVARDIEERDRRLSDEVREVVKRVKRELERLVESG

SEQ ID NO: 24176 - protein, 60 aa, Artificial Sequence
  Synthetic
AEKLVRRVIKDLRKLHKENEDLSREIDKRLEDAHKRNRDLVEEVKKRMERVREEVERAAR

SEQ ID NO: 24177 - protein, 60 aa, Artificial Sequence
  Synthetic
KEKEDVKKVVEDIERADKKLSEDNRRVVKRIEEADRKLSKENKESVERAKKRLDDLERRG

SEQ ID NO: 24178 - protein, 62 aa, Artificial Sequence
  Synthetic
EEAEELVRRVIKEMEEVHKRNRDLSKRLDDELKRIHKENEDRLRRLDEEIEKVVKKVEDDAR

SEQ ID NO: 24179 - protein, 60 aa, Artificial Sequence
  Synthetic
SLVEELRKDVEEIKKRLKRLVEENEKVVREVTEADKKLSKELEDEARDVKRALEELRRRG

SEQ ID NO: 24180 - protein, 62 aa, Artificial Sequence
  Synthetic
EEVEELVRRVREDMERVVREVEKVSRDLDREIRRVHRENRELIEDVKRKARKVLRDAEEEAR

SEQ ID NO: 24181 - protein, 60 aa, Artificial Sequence
  Synthetic
KIVEDVEKVVKEVDDRLKKLVDDNERKVREIIRRDEELSEKNEKSVRDVKEELKRLAEEG

SEQ ID NO: 24182 - protein, 62 aa, Artificial Sequence
  Synthetic
EEVEKLVREVIDRMRRVVREVEEMSKRLDEELEEVHRRNRETLTRIDEEAKKVVDDVDRRAR

SEQ ID NO: 24183 - protein, 60 aa, Artificial Sequence
  Synthetic
SVRETLEEVLRRIAEAIDELIKTLEKVLEESRREIERWKKENEDSLREIKKKLEDLEKKI

SEQ ID NO: 24184 - protein, 59 aa, Artificial Sequence
  Synthetic
EEKAKRALEEIKRLLERVKKRVEEALEEIKKSNKEAADIVRDIDRRLEELLRTVADKTR

SEQ ID NO: 24185 - protein, 57 aa, Artificial Sequence
  Synthetic
DEVEEVIKTSREINDRVRRELERVLRRSEEIIEEVAKSIEEVIKESEDIIRKVEKDG

SEQ ID NO: 24186 - protein, 59 aa, Artificial Sequence
  Synthetic
EELKRKIRDVLRDDERAARKWVRDLEEVNKRTEDKIRELLRKLEEVNEKTERDIRRREK

SEQ ID NO: 24187 - protein, 57 aa, Artificial Sequence
  Synthetic
EEVERVIEEIKKLLKDVAELVERVIKEIRKILDDVAKENKRLLDESRKIIKEVAERG

SEQ ID NO: 24188 - protein, 59 aa, Artificial Sequence
  Synthetic
EEVKRKIRKVLKEIKEEIEKLLKKLRDALRDVEEKIRDLTRRAREVNEKSREDLERRKD

SEQ ID NO: 24189 - protein, 57 aa, Artificial Sequence
  Synthetic
DEVEDVIRRLEEIIREVEDRLRKILETSKKIIKEVEDENRRVVTEIERILREVEKRA

SEQ ID NO: 24190 - protein, 59 aa, Artificial Sequence
  Synthetic
EELKRRIEEVLERLRRKIERLAKELKDVNDESEREARRLTEEVKRVLEEVARRIKEAAE

SEQ ID NO: 24191 - protein, 56 aa, Artificial Sequence
  Synthetic
REVEEVRKKIEEDIDRVDKELKEVLETSRDILRRVAKENEDVLRDLERLVDEVRRD

SEQ ID NO: 24192 - protein, 59 aa, Artificial Sequence
  Synthetic
EELKKKLEKVVRDLSKRLEELLKELEKVNEEVKRRLERLTEEVRKVLEEITKKLKERAR

SEQ ID NO: 24193 - protein, 57 aa, Artificial Sequence
  Synthetic
SKVEEVMRRLKEILKRVAEELEKVLTESEKILRDVADENRRVMEESRKILKDVAERG

SEQ ID NO: 24194 - protein, 59 aa, Artificial Sequence
  Synthetic
EEVKKKIDKVLEDVRKELDDLRRKLEEVNKRIEEEIRRLTEDVRRVNDEIRKRAEDRKR

SEQ ID NO: 24195 - protein, 60 aa, Artificial Sequence
  Synthetic
SLREKADEVVKRIKERLDRLEDKSREVVKDSRRKLREWYEKSKRAVEDIETKLDELRKDL

SEQ ID NO: 24196 - protein, 59 aa, Artificial Sequence
  Synthetic
KDMVEELIRELEKIVTDVAKKVEDTIEESRKINEEVAKRVEDTIKRLEDILRDVARRVK

SEQ ID NO: 24197 - protein, 60 aa, Artificial Sequence
  Synthetic
SLREKVDKVVEEIKRKLDKLLEDSERVVEKSERDLRRWLKEAEEVVREIEKTLKELEKRA

SEQ ID NO: 24198 - protein, 59 aa, Artificial Sequence
  Synthetic
KDVVEDLIRELEEIVRRVAEEVRTTIEDLRKINDEVREKVKRLIEELKKILDDVAEEVR

SEQ ID NO: 24199 - protein, 60 aa, Artificial Sequence
  Synthetic
SLEEKAREVVKEIRRRLDELLRKSHDVVREIEERLDKLEKESEDAVREIEKRLDELAKRI

SEQ ID NO: 24200 - protein, 59 aa, Artificial Sequence
  Synthetic
AKVVEKLIKELRDILREVAERVERTIRRLREIVKRVERKVERSIEEMERIVREAEEETR

SEQ ID NO: 24201 - protein, 60 aa, Artificial Sequence
  Synthetic
SLREKVDEVVKRIEKRLEELIRKSRKANEDIRKKLEELIKKSEDVVRKIKRELEELKRRV

SEQ ID NO: 24202 - protein, 59 aa, Artificial Sequence
  Synthetic
REVVEDLIRELEEILRKVAEEVEDTIRRLEKILKEVAERVERTIKDLEDIVRDVAEKVK

SEQ ID NO: 24203 - protein, 60 aa, Artificial Sequence
  Synthetic
SLREKVKRMVEEVKRELDELEKESNRAVERVERELEKLIRKSERVNERIRERLKELAARS

SEQ ID NO: 24204 - protein, 59 aa, Artificial Sequence
  Synthetic
DKVVEKLIKEVRDIVKKVAEEVKKTIEDVERKVKEVAERVEDTIRRLDEAVKEVEERVR

SEQ ID NO: 24205 - protein, 60 aa, Artificial Sequence
  Synthetic
SLREEAERVIREVREDLDRLRRESKKVNDRIRRTLDELRKRSDDAVRDIKEKLKELAKRT

SEQ ID NO: 24206 - protein, 59 aa, Artificial Sequence
  Synthetic
KDVVRELAERLKRLLEEVEKRVKDTIRELEKIVEEVRKRVEDTIRRLEEVLDKVAKEVT

SEQ ID NO: 24207 - protein, 61 aa, Artificial Sequence
  Synthetic
SIEEELKKVLKEIEDRVRKSDKENKEASERIKRTVEELERRLREVLRRIEEAVRKLVREKG

SEQ ID NO: 24208 - protein, 59 aa, Artificial Sequence
  Synthetic
EKKVKEVVDELRKLLRELEKLSEESNRKLKKLTDDIEKLVRDVEKELRKLLKELAEKIK

SEQ ID NO: 24209 - protein, 60 aa, Artificial Sequence
  Synthetic
SVEERLKRVLERAREEIKRLLDELERVLEESRKEIKKLSEDLTRANEDTRREIEKLAREI

SEQ ID NO: 24210 - protein, 59 aa, Artificial Sequence
  Synthetic
ERIVKKVEEEIEELVRRVEKRVREVKKRMEDSNREVRKANEEVKKRSEDLLRKVRRDAE

SEQ ID NO: 24211 - protein, 60 aa, Artificial Sequence
  Synthetic
RVRDELREVLRKAREDIKRLSDKMREVLRESEEKIKRLSDDLRRVNEETKKEIDRLRKEI

SEQ ID NO: 24212 - protein, 59 aa, Artificial Sequence
  Synthetic
KEIFRKVEKEIEDLLEEVRDVNRKIEEEARRSNEDVERVNREIKKRSEELLRDVEKKTE

SEQ ID NO: 24213 - protein, 60 aa, Artificial Sequence
  Synthetic
SVREELKKALDRVRESIRRLSEELREVLERSEDTIRRLVEDLERVNEETRREIEDLARKI

SEQ ID NO: 24214 - protein, 59 aa, Artificial Sequence
  Synthetic
ERIMKEIEKRIEDLEREVKEVNREVIERAEESNRRVEELVREAKKRSRELLKRVREEAK

SEQ ID NO: 24215 - protein, 60 aa, Artificial Sequence
  Synthetic
SVREDLERALRRAAEEIEKLSRDLKRVLEESRKNIERLRRDIERMNEETEKEIRRLAREI

SEQ ID NO: 24216 - protein, 59 aa, Artificial Sequence
  Synthetic
EEDAEEIKTRIKELIDRVRRVNEEVKERMKKSNEEVEEVVRRVKEESKRLLERVEEDVR

SEQ ID NO: 24217 - protein, 60 aa, Artificial Sequence
  Synthetic
SLREDLRRVLERARDELRKLSKELKEVLKRSRDNIRKLSEDVKRANERTEEEIRRLTKEI

SEQ ID NO: 24218 - protein, 59 aa, Artificial Sequence
  Synthetic
DEIFKRVKKEIKELVDRVREVNKDVIRRMKKSNDEVKRENEKVIRESEKLLKDVEDARR

SEQ ID NO: 24219 - protein, 60 aa, Artificial Sequence
  Synthetic
SVRERLEKVLKEVEDSIKELSDDLRRVNKRTEEEIRRLAEDLERVLERIEREIRKLAKEI

SEQ ID NO: 24220 - protein, 59 aa, Artificial Sequence
  Synthetic
EEIAERVERTIRKLEDDVRKVNEDVKRRSRELLERVARLVERVKEEAEKLLEDVKRKAD

SEQ ID NO: 24221 - protein, 60 aa, Artificial Sequence
  Synthetic
SLREDLERVLEEIERELKELSDDLRRMNEETEREIRKLSDDLRRALEKIRDEIRKLAEEI

SEQ ID NO: 24222 - protein, 59 aa, Artificial Sequence
  Synthetic
EEIFRKVKEEARRLVREVEEVNKEVKKRSRDLLREVRKVNEDVKREIERLLRKVAKDAE

SEQ ID NO: 24223 - protein, 60 aa, Artificial Sequence
  Synthetic
SMREDLRRVLEEAEKKIRKLSKEAKDANRETEKEIRKLSEDVKRVNKESKDEIDRLAEEI

SEQ ID NO: 24224 - protein, 59 aa, Artificial Sequence
  Synthetic
KEIAEKVKREIEKLVRDVERVNREIIERSEKLLREVREENERVKRESRRLLKEVEKAAE

SEQ ID NO: 24225 - protein, 60 aa, Artificial Sequence
  Synthetic
SVRETLKKVLEDVRRELKKLSDKLRKVLEDSRRNVKRASDKLREVLKRVKEEIERLRREI

SEQ ID NO: 24226 - protein, 59 aa, Artificial Sequence
  Synthetic
EEIAKRIIEEIKKLLDRVREVNEDVIRRMKKSNEDLDRRNEEVRKRIEDLLEKVARDAK

SEQ ID NO: 24227 - protein, 60 aa, Artificial Sequence
  Synthetic
SLEETAKEVIERSEDHLRRLEETNRKVVEDSERHLDDLTRRIKKVVEDIKKRLDEIEKRG

SEQ ID NO: 24228 - protein, 60 aa, Artificial Sequence
  Synthetic
AEELLRTVVKEIEDANRRVEEVSRKNTEDIKEWNKRLEEELRRVVERARRELKKVEDAAR

SEQ ID NO: 24229 - protein, 59 aa, Artificial Sequence
  Synthetic
SLEETAKRVIEESRKHLDRLRRENERVVKEIRDALRELEKKVEDVVRRIAEELERIRKE

SEQ ID NO: 24230 - protein, 62 aa, Artificial Sequence
  Synthetic
EEAEDLLRKVIEDIKELNRELERVSRKNIEDLRRWLEEVREMVKRVEEKAKRVLEELREAAK

SEQ ID NO: 24231 - protein, 60 aa, Artificial Sequence
  Synthetic
SLEETIEKVVERSKRNLEKLRREIRKVVKESDENLKDVERRAREVVEEIKKALEDIRRKG

SEQ ID NO: 24232 - protein, 62 aa, Artificial Sequence
  Synthetic
EEAEELLRKVIKESEDLNRRLREEVKKVVREIEEANKRVNDTVRKMEEALKKLLDDLREKAR

SEQ ID NO: 24233 - protein, 60 aa, Artificial Sequence
  Synthetic
SLEEDMKRVVDESRRNLERVEKENRDVVKESRDNLKKVEDDIRKVVKDIRDELEKIRKRG

SEQ ID NO: 24234 - protein, 62 aa, Artificial Sequence
  Synthetic
EEAEELVRRVKETSKRVNEELDKTAKKNVDDIKDWNRRVNEKVKKVKEDAERVLRELEETAR

SEQ ID NO: 24235 - protein, 59 aa, Artificial Sequence
  Synthetic
SLEETITKVVEESKKNIDRLLEEVRKVVEDSRRDLDRVIDEARKVVEKIDRELKRIEKR

SEQ ID NO: 24236 - protein, 62 aa, Artificial Sequence
  Synthetic
EEAEELVRRVKKRSEDVNKKLDEDVEEMKRRSEKLNKDINKDVDRVRKRLEEVLKRLREAAK

SEQ ID NO: 24237 - protein, 60 aa, Artificial Sequence
  Synthetic
SLKDEIKKVVDDSRRNLEEVKKEITRVVKESRERLEELERDIERLVEKVTRELDRIEEEG

SEQ ID NO: 24238 - protein, 62 aa, Artificial Sequence
  Synthetic
EEAKELVEEVIRRSREVNRDLNRRVREVEKESRDANERVKRRVEEVKRRAREVLERLKKAAE

SEQ ID NO: 24239 - protein, 60 aa, Artificial Sequence
  Synthetic
SLEEDAKRMVDTNEDRVREWERKIDKVVKDSEKRLRELREDAERMVREIKKELEKIRTEG

SEQ ID NO: 24240 - protein, 60 aa, Artificial Sequence
  Synthetic
AEELVRRLKKASEDSNEKVARLIEEVIKRSKDVNDDLERDLREVKKRLKDVLKRLKEKAK

SEQ ID NO: 24241 - protein, 60 aa, Artificial Sequence
  Synthetic
SLEEDAKRAVEESKRTLRELEEENKKVVEDIRRALRRLEEDIKRVVEEIRRELDRIRREG

SEQ ID NO: 24242 - protein, 60 aa, Artificial Sequence
  Synthetic
AEELVRRVKKTIEDVNRKVAKVVKENIKRLREWLKRVEERLKEVKDRLRKVLEDVERAAK

SEQ ID NO: 24243 - protein, 59 aa, Artificial Sequence
  Synthetic
DVEEDVKRVADDNRRELERWRRDVKKVADEVKDRSRKLERDVERRIREIEKTLEDLRRE

SEQ ID NO: 24244 - protein, 59 aa, Artificial Sequence
  Synthetic
KEVVKRLKEESKKSNEDVARRVEKLKEELERSTREVERAVRELKKELDEVVREVKERAK

SEQ ID NO: 24245 - protein, 60 aa, Artificial Sequence
  Synthetic
SIEERLDKLLRDVKRALEELEERIRRSNKRLREAVEKLKKEVEDSNRELDKAVKEVLRRK

SEQ ID NO: 24246 - protein, 59 aa, Artificial Sequence
  Synthetic
EEAVRTAADLLRRVLERVKRLAEELHRHNKEVLDEARKIARDLHRLNEEVLRRVEEATK

SEQ ID NO: 24247 - protein, 60 aa, Artificial Sequence
  Synthetic
SIEEDLKRLLDEVRKRSKDLKEEVKRSNDRVREDLKRLKEEIDRLLEEARRRLEEIIRRK

SEQ ID NO: 24248 - protein, 59 aa, Artificial Sequence
  Synthetic
KELVDRARDKIRESLRRSEKIIEELHEHNKDALRRVREEIKRLKDKLKKVVEEVERATR

SEQ ID NO: 24249 - protein, 57 aa, Artificial Sequence
  Synthetic
DSVERVKEESERTNREIAKLSKKVEDETRKVLKDLEDISRDTERRSREVLERARRDK

SEQ ID NO: 24250 - protein, 58 aa, Artificial Sequence
  Synthetic
ELVRELEEVVRENEERVRRLIERNKKLVDDARKRVEELVRRNDKIVKEIEKVVRDIKT

SEQ ID NO: 24251 - protein, 57 aa, Artificial Sequence
  Synthetic
KSDEEVEKLIREVLKRIEELSREAEKLTDEVRKLLKEISDRVEERSRDVLDKIRRTN

SEQ ID NO: 24252 - protein, 58 aa, Artificial Sequence
  Synthetic
ELVRKLEKLLEDAERRVRELVKRNKEVVERVKRTVDELKARNKKIVEEIKKVMEEITR

SEQ ID NO: 24253 - protein, 57 aa, Artificial Sequence
  Synthetic
RELEEVEKKVRTVLEEVRRISEKAEELSRRVLEEARKISEDNEREVRRVVEDVRREN

SEQ ID NO: 24254 - protein, 58 aa, Artificial Sequence
  Synthetic
DLVERLKELVKKVEDEVRRLVKRNKDIVDDIRRRVEELVRRNKRITDEVRKEADKLRR

SEQ ID NO: 24255 - protein, 60 aa, Artificial Sequence
  Synthetic
SELEKVKKEIRELLEEVRKISKESEDRSRKSNDELHKSSEEVEKRIRDLLRELEKIVREL

SEQ ID NO: 24256 - protein, 59 aa, Artificial Sequence
  Synthetic
KDVVKELREVLERAEREARKLIKRNDEILKESEKNARDLIRRTEELLRRAKKRVDELKK

SEQ ID NO: 24257 - protein, 60 aa, Artificial Sequence
  Synthetic
SDVEEVKKEIARLLEELKRTTDKVKEDSDRSNEEVHRSSEKVKKDIEKLLDELRKVVEEL

SEQ ID NO: 24258 - protein, 59 aa, Artificial Sequence
  Synthetic
REVVKELEDVLKRAEEVVERLEEKTRRILEESRKNIERLKRETEEMLKRAEDEVKKLKD

SEQ ID NO: 24259 - protein, 60 aa, Artificial Sequence
  Synthetic
SLVDRVRELIERLLRRLEEIVREVEERLRRSNERLHESSADVERLIRELLERLRDIVRKL

SEQ ID NO: 24260 - protein, 59 aa, Artificial Sequence
  Synthetic
EDVVRELEELLRRAKERVDELKKRLEELLKESREDVERLKKKTDEALKRAEEEVEKLRK

SEQ ID NO: 24261 - protein, 61 aa, Artificial Sequence
  Synthetic
RDLEEVKKRIDELLKRVRETTKRVEDELRRSNKELHESSRRVEEEIKKLLEELEDVFRKVK

SEQ ID NO: 24262 - protein, 59 aa, Artificial Sequence
  Synthetic
EELVRTLEDMLRRAREEIEKLKEKTRKLLEDSERDVKRLIERTTEVLKRARERVEELKK

SEQ ID NO: 24263 - protein, 61 aa, Artificial Sequence
  Synthetic
SELEEVKKRIDDLLKRLRDIVDTVRKELRKSDKELHDSSKRVEEEIKKLLEELRRIVETLK

SEQ ID NO: 24264 - protein, 59 aa, Artificial Sequence
  Synthetic
REVVETLRRVLKRAEDDVRRLLEELRELLERSKRNVERLIERTKELLKRAEDEVKKLED

SEQ ID NO: 24265 - protein, 61 aa, Artificial Sequence
  Synthetic
SLLEKVEEEVRRLLKRLRDIVEEVRRLLEESNERAHRSSKKVKEDIDELLKELEDVVRRVK

SEQ ID NO: 24266 - protein, 59 aa, Artificial Sequence
  Synthetic
KDLVKTLEDILERAEREVKKLEDRLRKLLEDSKRNAEELIKRTEDVLEEALRRVEELKK

SEQ ID NO: 24267 - protein, 59 aa, Artificial Sequence
  Synthetic
SEAERVREILKDAEKKIRDILRRLREINRESARRIEDIKRKLDEILKRNEDDVRRLEKD

SEQ ID NO: 24268 - protein, 56 aa, Artificial Sequence
  Synthetic
VEDAERTVRELIKRVEEALERAERASRELIKTVEKVLEEVERRNRKSNEELKEATR

SEQ ID NO: 24269 - protein, 60 aa, Artificial Sequence
  Synthetic
SLEEEAKELVKRVRDELRKIERTIEKIVEDSRRRLEENRKRNKELIERVEKELRELKKRV

SEQ ID NO: 24270 - protein, 60 aa, Artificial Sequence
  Synthetic
ARDILREAKKMLEKVLRDLRRVLEELRKENEKVLRELEEISKETEDRLREVLRELRERTR

SEQ ID NO: 24271 - protein, 57 aa, Artificial Sequence
  Synthetic
SVEDEVREVAKKIRRILEKLKRELDRHSKKIEDILEEIRDKNEKAKEEIEEVLRRRL

SEQ ID NO: 24272 - protein, 59 aa, Artificial Sequence
  Synthetic
KEDVERVKRELEKVLRELAEEVRESLERVSEVAERLKRENDEVNDRLKKMLEDLLRKAT

SEQ ID NO: 24273 - protein, 56 aa, Artificial Sequence
  Synthetic
DEVEEVIRRVEESNKRVNEENDRVVRESKEIVRKVEEDNRRAIKESEEMLDRVAKD

SEQ ID NO: 24274 - protein, 56 aa, Artificial Sequence
  Synthetic
EEDLRRVVDKSRKNVEEVERKNRDVLRRIDKRAKELEDRNREVLKKIEKTIRDLEK

SEQ ID NO: 24275 - protein, 56 aa, Artificial Sequence
  Synthetic
SEVDEVIRRVEKSNKDVNDENKRVIDRSKELNREVNERNKEAIKRSRDLADEVRRD

SEQ ID NO: 24276 - protein, 56 aa, Artificial Sequence
  Synthetic
EERLREVVKRSEDNVRKVEEDNRRVLEESTRNVKEVKERNEKVLEEIRKTLEDLER

SEQ ID NO: 24277 - protein, 56 aa, Artificial Sequence
  Synthetic
SEVDKVRKELEDMAREIEKRAEDVIREIKRSNEEVNRTNEKVIRDSERMLEKAERD

SEQ ID NO: 24278 - protein, 56 aa, Artificial Sequence
  Synthetic
EERLDRVREKLERIVREIEDRLRKVLEDSRRNVEEVRRRNEEAVKKIRRILEELER

SEQ ID NO: 24279 - protein, 56 aa, Artificial Sequence
  Synthetic
DEVDDVIRDVDRTNEEVERENRRVIEEVRKSNEEVNKKNADAEKRSREMAERAAED

SEQ ID NO: 24280 - protein, 56 aa, Artificial Sequence
  Synthetic
KEKLDRVLERSKKTVEELEKRNREALDRSRRNVEEVEKRNREVVKEIAERVRRLKK

SEQ ID NO: 24281 - protein, 56 aa, Artificial Sequence
  Synthetic
SEVDKVVEDVKRMLKEVEDRNEKVIRDVEKMLREVEEKNKRVIEDSERVAKEAADD

SEQ ID NO: 24282 - protein, 56 aa, Artificial Sequence
  Synthetic
KEKLDKVLEEIREIVKRLEDRNREALRRIKEIVDRLEKRNRKVVEDVERIVREIER

SEQ ID NO: 24283 - protein, 56 aa, Artificial Sequence
  Synthetic
SEVDEVIKRIEETNRRVEEMNKDAIRRVKESNKRVEERNKEVIERSKKLIDDVRRD

SEQ ID NO: 24284 - protein, 56 aa, Artificial Sequence
  Synthetic
EERLRKVLKDSERTVKELEKRNRRVLEESDKEVKRLEKENRDVVDEIRERAKEIER

SEQ ID NO: 24285 - protein, 56 aa, Artificial Sequence
  Synthetic
SEVDKVITELEKMLRRVKEENKRVIDESRRALEEVEKRNREVIERSDEMARRAAED

SEQ ID NO: 24286 - protein, 56 aa, Artificial Sequence
  Synthetic
EERLREVLERIARRVRELEERNKKVVKEIEERVRELERRNREVVKKIEEKVKRLET

SEQ ID NO: 24287 - protein, 56 aa, Artificial Sequence
  Synthetic
DEVRKVIKELRDELRRVEELNKEVIDRSRKLVEDIARESKEVIERSRKLLDDVRKD

SEQ ID NO: 24288 - protein, 56 aa, Artificial Sequence
  Synthetic
REDLERALKEIEETIRRLEKRNRDVLKEIEDEARRLEEENRKVLKEARKIVEDIKT

SEQ ID NO: 24289 - protein, 56 aa, Artificial Sequence
  Synthetic
SEVDDVTRKLERILEELTETSERVVRTSRRVAEELEKRSKEAVERSRKLAEEVARD

SEQ ID NO: 24290 - protein, 56 aa, Artificial Sequence
  Synthetic
REKLERVLEEIRRRIEELSEKNRKVVKDIREIVRKLTERDEKVVREIKKIVDDIET

SEQ ID NO: 24291 - protein, 56 aa, Artificial Sequence
  Synthetic
SEVDEVTREVEELIREVEKLSEDVIRTSKELAKRAEKLSREVIKRSEELIDEVRRD

SEQ ID NO: 24292 - protein, 56 aa, Artificial Sequence
  Synthetic
KKKLEDVLREIAKKVREIEERDRKVVEEIREILKRLEDENREVLKKIRRIAEEIRR

SEQ ID NO: 24293 - protein, 56 aa, Artificial Sequence
  Synthetic
DEVRKVIKELEDRLREVEKKSKDAIDTSREMLKRVDDENKDVKRRAEEILKRVDED

SEQ ID NO: 24294 - protein, 56 aa, Artificial Sequence
  Synthetic
EEELRKLLEDIREKVERIVKRDEDVVREIEEEARRLADENRKVLEEIERIIRELER

SEQ ID NO: 24295 - protein, 56 aa, Artificial Sequence
  Synthetic
REVDEVTRRIKELNDELERRVRRAKERIEELNKRVNREDEEIVDRVRKLNDELAKD

SEQ ID NO: 24296 - protein, 59 aa, Artificial Sequence
  Synthetic
EDVKRKLKEVVDESRRTVDEIRRELERVVEKSRKNIEEVKKHTREVLKRSEETARELKK

SEQ ID NO: 24297 - protein, 56 aa, Artificial Sequence
  Synthetic
SEVDRVLEEIRKLNEDLNRRVDDATRKIRDLNRKLNEDVKKVTEDIKKLNEDLRKD

SEQ ID NO: 24298 - protein, 59 aa, Artificial Sequence
  Synthetic
EEVKRKLEKLVRESERNVREVKKKLDEVRKESKTNADKVREELKRVVEESERTVRELEK

SEQ ID NO: 24299 - protein, 56 aa, Artificial Sequence
  Synthetic
SEVDEVEKDIERLLEELRERVKRVTDEIRKLNKELNETDTDIVRKIRELLERLERD

SEQ ID NO: 24300 - protein, 59 aa, Artificial Sequence
  Synthetic
EEVKRRLEEVLRKVKRELDRIRDELRRVVEESETNVRDVRRHTEEVVKEVEDEVRRLEK

SEQ ID NO: 24301 - protein, 56 aa, Artificial Sequence
  Synthetic
SEVEELERRIRELLRRVKRIDEEIVRRIRELNKELNRRDERIVETVRELVERVARD

SEQ ID NO: 24302 - protein, 59 aa, Artificial Sequence
  Synthetic
EEVKKRLEDVLRRVREEIERLKKHTDDVLRESEKNAEDVKKHTDDVVREIEERIRELKK

SEQ ID NO: 24303 - protein, 56 aa, Artificial Sequence
  Synthetic
SEVEEVIKEIEKLNEDVNRIDKEIVKRIRDLNREVNERDKEIVKEIKRLVEEVRKD

SEQ ID NO: 24304 - protein, 59 aa, Artificial Sequence
  Synthetic
EEVKDRLRKVLESSSDNVRRVTEHTDKVLEESRKNIEDVKKHTDEVVKEIEKEVRELKK

SEQ ID NO: 24305 - protein, 56 aa, Artificial Sequence
  Synthetic
DEVKEVIRRAEKLNEKINDILRRVEEEIRRTLDEVRRRDEKIVKEIRDLMRELSED

SEQ ID NO: 24306 - protein, 59 aa, Artificial Sequence
  Synthetic
EEVKRELEEVVKESEKNIREVTDRLRKVLEESTKIVEELEEHTKRVVDEIRKRADELRR

SEQ ID NO: 24307 - protein, 60 aa, Artificial Sequence
  Synthetic
SLEEEIDRVLDEIRRIIEEIKKHTTEVLEESKRNIEEVKKHTDEVNEKSRRDIEKIKREV

SEQ ID NO: 24308 - protein, 59 aa, Artificial Sequence
  Synthetic
KEKVRKVIEEIKKIAEDVARRDKEMVDRSREINKKVNEEDKKIVEDSKRIIEDVKRKTD

SEQ ID NO: 24309 - protein, 60 aa, Artificial Sequence
  Synthetic
SLEKEIKDALDRIKKDIEDSARRTKEVNDKSKEIIDRLKKHTDDVNDESRRRIKEIKDEV

SEQ ID NO: 24310 - protein, 59 aa, Artificial Sequence
  Synthetic
KRLVKEVIDRLDEIVEDVKRRDEEIIRTSEKLLRDVARLDEEIAKRSRDLLRDVERKVK

SEQ ID NO: 24311 - protein, 60 aa, Artificial Sequence
  Synthetic
SLEERLKKVLKEVDERIREIKKHTDKVNEESRDKIRKLKEELDRVNRESEEEARKIKSEV

SEQ ID NO: 24312 - protein, 59 aa, Artificial Sequence
  Synthetic
DKDVRDVEEEIRKLLDEVRKLDEEMVERSKKLARTVERLVKEVIRESKEIIRKVKEETD

SEQ ID NO: 24313 - protein, 60 aa, Artificial Sequence
  Synthetic
SLEEEIERVLRKVEKEIRKIKERLDEMLKEIRERIERSKRRTDKVNEDSRRRIEEIKRRV

SEQ ID NO: 24314 - protein, 59 aa, Artificial Sequence
  Synthetic
KEDVKKVKKDIDKLLKEVREEVKEAEDRIRRIAEEVDKEDKRMIETSRRIIRKVDEDVR

SEQ ID NO: 24315 - protein, 60 aa, Artificial Sequence
  Synthetic
RIEDKLRKVLEEVERIIREIRKRLEDANDDSRREIEESKEDTDRVLEEIRRRIEEIKREV

SEQ ID NO: 24316 - protein, 59 aa, Artificial Sequence
  Synthetic
DEDVERVLRKIKELLRRVEEEVERVIRESKKLLDEVRKEDEEIKKTLRDIVREVARKVK

SEQ ID NO: 24317 - protein, 60 aa, Artificial Sequence
  Synthetic
SLEETVEKALKDSKDNIKRLKERVDRVLEESRRTIEELRDRARRVREEVKKRLDELRRRG

SEQ ID NO: 24318 - protein, 59 aa, Artificial Sequence
  Synthetic
KDAVKKLIDDVRKINKELNDTVEKLARDVEEINKEVARRVEKLVRELEKIDEDVTRREK

SEQ ID NO: 24319 - protein, 59 aa, Artificial Sequence
  Synthetic
SLEEKVREVLKRSEDNIRKLEDESRKVLEDSERNLRKLKKEVDDAADRVRRKIKELRER

SEQ ID NO: 24320 - protein, 59 aa, Artificial Sequence
  Synthetic
ARIVDKLIREVEKINRDVNEKVRTSIEDLKRINEELNERVERLIREVERILKEVEDRAR

SEQ ID NO: 24321 - protein, 60 aa, Artificial Sequence
  Synthetic
SLDERVERALEKSEENLRRLKKRSEEVLEEVKEAIKELKRRSREALEDVRRVLDELRKDG

SEQ ID NO: 24322 - protein, 59 aa, Artificial Sequence
  Synthetic
AKVVEELIKRVEEINTRLNEKVKKSIDDVRRIIEEVRRRVEKTIRDVERIKEEVERRRR

SEQ ID NO: 24323 - protein, 60 aa, Artificial Sequence
  Synthetic
RLEDEVRKMEKEVREEVKRLEDESRKVLEESRRNLDKLREESKRVLDTVRERIKDLRRRG

SEQ ID NO: 24324 - protein, 59 aa, Artificial Sequence
  Synthetic
AKVVKELIDRVRKILEDVEREVKKSIEEVKEINRRLNEEVKKTIEEVKEIVKEVTERAK

SEQ ID NO: 24325 - protein, 60 aa, Artificial Sequence
  Synthetic
SLEDEVRDMDRKVDEALKRLRDESKKVHDDNKREIDKLRKESEDVHRENKETLDRLRERG

SEQ ID NO: 24326 - protein, 59 aa, Artificial Sequence
  Synthetic
KDAVRELKRDVERIIKEVDELVKRSIEESRRITEEVARRVKETIDRSRKITKELRDRAD

SEQ ID NO: 24327 - protein, 60 aa, Artificial Sequence
  Synthetic
SEIEELEERLERSTRDVEKKVRDTIRESERSTEEVARRVDESIKRLERVVEEVEERVRRI

SEQ ID NO: 24328 - protein, 59 aa, Artificial Sequence
  Synthetic
EEIRKRVEDVAKKVKEDTDKLRDDSRKVHERNEEESRRLEEKSERVLRRVEEILKEIER

SEQ ID NO: 24329 - protein, 60 aa, Artificial Sequence
  Synthetic
SEVDRLITELRRSTKRVEEEVRRLIEDSKRSTREVAERVKESIRRVEKVVEEVKRRVDRI

SEQ ID NO: 24330 - protein, 59 aa, Artificial Sequence
  Synthetic
EDIRRKIEEVVKEVKEETDRLREEAEKVVRENRKASEKLRRESEEVVERVKKKVDDTET

SEQ ID NO: 24331 - protein, 60 aa, Artificial Sequence
  Synthetic
REVEEIIKELRKSTTDVAETVERLIKRSRESTKEVADRVKRLIDEVRRVVEDVERKVRRI

SEQ ID NO: 24332 - protein, 59 aa, Artificial Sequence
  Synthetic
ERIEKEIEDVVREMEERTKRLEKRAEEVNEENKRRSDELRKRIKKAVDEVEKRLDEIRN

SEQ ID NO: 24333 - protein, 60 aa, Artificial Sequence
  Synthetic
SEVEDLIKKLEESTEEVDRRVKKLIEDSRRSTEDVDRKVKELIKDVRRVIREVEERVARI

SEQ ID NO: 24334 - protein, 59 aa, Artificial Sequence
  Synthetic
DRIRETVERVFRKVERKTRELREEIREVDERNRRDSKRLRDEVERVARELEKKLKEIDE

SEQ ID NO: 24335 - protein, 60 aa, Artificial Sequence
  Synthetic
EEVERLIRELEESTDRVAREVERLIRESRKSTEDVRRKVDKLLREVREAIKEVEERVRRT

SEQ ID NO: 24336 - protein, 59 aa, Artificial Sequence
  Synthetic
EEIKRKIDKVVEEVRRRTEELRERIERVNEENKEASERLERKLREMAKELDKKLKDIRR

SEQ ID NO: 24337 - protein, 60 aa, Artificial Sequence
  Synthetic
KDVDELITRLEESTKRVAEEVKRLIEESRRSTERVAREVRRSIEEVKRVIREVEEKVRRI

SEQ ID NO: 24338 - protein, 59 aa, Artificial Sequence
  Synthetic
KDIERKIREVVEKVERDTRRLEEEAKKVNEENEKASRDLEKESKDAADTLEKKLRDIER

SEQ ID NO: 24339 - protein, 60 aa, Artificial Sequence
  Synthetic
DEVEDLIRRLEESTKDVAKKVDDTIDESRKSTKDVAEAVKRSIDEVRRVVREVEERVRRI

SEQ ID NO: 24340 - protein, 59 aa, Artificial Sequence
  Synthetic
DRIRDEIRKVVERAKERTKELEDKSKEVNDRNRETSERLKKESEDVVREVKKELDRIRK

SEQ ID NO: 24341 - protein, 60 aa, Artificial Sequence
  Synthetic
SEIDKVETEVKKLDKELEELVKRSSEKTEKLDRELEKLLRDVVREVEKLLKEIEDLVRRR

SEQ ID NO: 24342 - protein, 59 aa, Artificial Sequence
  Synthetic
KELAERIKKVARESEETVRRLEERLERDSERSRETLRRLAEAVRRVIEKVKEILERLRT

SEQ ID NO: 24343 - protein, 60 aa, Artificial Sequence
  Synthetic
DKMEEVRRTVEKLLEDLNRLSEEVIRTSEKLLEELRRLSEEVERDTERLLKELEKMKRDG

SEQ ID NO: 24344 - protein, 56 aa, Artificial Sequence
  Synthetic
DEDIKRVLDEVKKILDDNREKNKRALDRVREEVKRLEDRNREVVRKVRKIVEDLRR

SEQ ID NO: 24345 - protein, 60 aa, Artificial Sequence
  Synthetic
RVDERLDTVLKRVEETVRENKKKNDELLERSKENIDRLKKRLDDLLDKVRREAEKLKREV

SEQ ID NO: 24346 - protein, 59 aa, Artificial Sequence
  Synthetic
EEVVKEVEERIKKLLKEVNDTSKDAERRLRETNERLNEIVKEVEKRIRELSEEVRKRVK

SEQ ID NO: 24347 - protein, 60 aa, Artificial Sequence
  Synthetic
SVDERLDEVLERVKEDMDRNRRKNDESLREDEENVRRNKKETDESVKRVEERVRELKKRV

SEQ ID NO: 24348 - protein, 59 aa, Artificial Sequence
  Synthetic
EEVVKTVEEDIKRLLKEVNKVSDEAHKRNKELNERVNRVNKEAHKRNEDLLREAERKVR

SEQ ID NO: 24349 - protein, 60 aa, Artificial Sequence
  Synthetic
DVKERLDKVLEEVKRDIERNKRRNDKLLKESKRIVEENKKKNEKSLEEVKRKADDLRTKV

SEQ ID NO: 24350 - protein, 59 aa, Artificial Sequence
  Synthetic
KEVVEKVEREIERLREEVNRVSKKAEEDVERTNRELNRVSDEAHKTNERLLEKVERDVK

SEQ ID NO: 24351 - protein, 56 aa, Artificial Sequence
  Synthetic
SSEDKARELVRTLEEALRELEREMRKVVEDSKKTLKELEERNRRLEEELEKVLERV

SEQ ID NO: 24352 - protein, 55 aa, Artificial Sequence
  Synthetic
DRVIEELKELLERLRERVERVIKKVKDLNEELRRRNDKVAKDLKRLLKELEDRTR

SEQ ID NO: 24353 - protein, 58 aa, Artificial Sequence
  Synthetic
SIEDEIRKVLTRLRRVLEEIKRSSKEVADELKRVLEEIKRSSEENNKEVEEVLKEIEK

SEQ ID NO: 24354 - protein, 58 aa, Artificial Sequence
  Synthetic
REVREVIERLERMLEELERHNRDVERDLRRVLEEAKRHNEESLRRSKELLKKVRDEIE

SEQ ID NO: 24355 - protein, 59 aa, Artificial Sequence
  Synthetic
SIEDEIRKLKEDIKRVLDKVRRDNERLKERLDKVLEDIRRSSEDNNRKLEEVLKRIRDK

SEQ ID NO: 24356 - protein, 59 aa, Artificial Sequence
  Synthetic
EERVREVIEKLKETLERLKREDKEVADRAEKLLREAEEHNKRSLDESRRVLEELDEEIR

SEQ ID NO: 24357 - protein, 59 aa, Artificial Sequence
  Synthetic
SIEDRVRRVLEELEEVLERIKDSSRRVVEEAEDVLRKLEEENRKLERDLERVLKEIEEE

SEQ ID NO: 24358 - protein, 59 aa, Artificial Sequence
  Synthetic
ERELEEVEKRLREVLRRLEKHNEDVIRDLRRLLEEAADEDRRVIKTLRDVLRELKKRIK

SEQ ID NO: 24359 - protein, 59 aa, Artificial Sequence
  Synthetic
KIEEKIRRLEEDLDRVLDEIRRNSERVTKEAEEVLERLKRENEKLKKRLEEVLEEIRRR

SEQ ID NO: 24360 - protein, 59 aa, Artificial Sequence
  Synthetic
ERRVDKVIEDLKRVLDEARRHNEDVVRKLKEALDKLREDDDRVRRDLEKKLRDLERRIE

SEQ ID NO: 24361 - protein, 59 aa, Artificial Sequence
  Synthetic
SIREKIRELEERLEEVLRRIEENSERVLREAERVLKEIKDNSKRNNEKLERALEEIRKL

SEQ ID NO: 24362 - protein, 59 aa, Artificial Sequence
  Synthetic
EREVDRVIRKLEDVLRKLEEHNRRVVERLKRLLEELKKHNEDSLRKSEEVLRKLEEDAR

SEQ ID NO: 24363 - protein, 59 aa, Artificial Sequence
  Synthetic
SIEERVRELMRDLERVLKEIREHSKRVIEEAKRVLEEIERNSERNNKELEEVLDEIRKR

SEQ ID NO: 24364 - protein, 59 aa, Artificial Sequence
  Synthetic
EKELEEVERRLRKVLEDLRRNNKEVVDRLKEVLERLKEHNRRSLDESRKVLRELKERIR

SEQ ID NO: 24365 - protein, 59 aa, Artificial Sequence
  Synthetic
SIEDRIRELEKRLEKVLREIEEHSKKVVREAEKVLREIEENSRRNNKRLEEVLDEIRKR

SEQ ID NO: 24366 - protein, 59 aa, Artificial Sequence
  Synthetic
EEDVRKVIRDLEDALRRLKEDNEDVVRRLKEVLKELRKHNKRSLDESEKVLRELRERIR

SEQ ID NO: 24367 - protein, 58 aa, Artificial Sequence
  Synthetic
SIEDEVRKLAKDLDDVLREIEENSKRVLEKLDEMLERIREHSERVVERAKRVLDEIRK

SEQ ID NO: 24368 - protein, 59 aa, Artificial Sequence
  Synthetic
ERELRTVIRKLKEVLDRLREHNKRVVEELEEALKELEKDNRKVVEDLERMLEELKREVN

SEQ ID NO: 24369 - protein, 58 aa, Artificial Sequence
  Synthetic
SIEEEIEKVKKRLEDVLREIKKHSEEVKKKAEDVLRKIEKHSRDNNRKAEEVLKDIAR

SEQ ID NO: 24370 - protein, 59 aa, Artificial Sequence
  Synthetic
EEEVRKVIEELEELLERLRRNNEEVVRDLERVLEELKRDNEKSVEDSERLLTELKREIE

SEQ ID NO: 24371 - protein, 61 aa, Artificial Sequence
  Synthetic
SVKEELDDLERKVDEDVRRIRRELDEVLKESRENVKRSKDHLDEVLRRVEEAVKRLIRERG

SEQ ID NO: 24372 - protein, 59 aa, Artificial Sequence
  Synthetic
KEKVDRAKKEIEDLLREVRKRVEDVAREIKRLNEDVNRINDKVTREIEKLLEDVDRKVK

SEQ ID NO: 24373 - protein, 61 aa, Artificial Sequence
  Synthetic
SVEDKLRELEKRVRDVHRKNEEDLDRLLRKSHEMHKRNEDELRKVLEEVRDAVRKLLKEKG

SEQ ID NO: 24374 - protein, 59 aa, Artificial Sequence
  Synthetic
DEEVERVIKRIDDLLKEVHKILREVIRRIEKSLEEVHKRVRDLVREIKELLKEVDRKAK

SEQ ID NO: 24375 - protein, 60 aa, Artificial Sequence
  Synthetic
SLEDKVRELERKSRENIKRNEEELRRAKRESEENIKRNEEELKRNKERSDRMIEKIRRET

SEQ ID NO: 24376 - protein, 59 aa, Artificial Sequence
  Synthetic
KDVVERLREALEDANRRVNERNRELIKRLKEANKKVNEENEDLLRESEEILRRVEEEVR

SEQ ID NO: 24377 - protein, 60 aa, Artificial Sequence
  Synthetic
SIEELVKDAKRRSKENADRNREKLRKVEDDSRRNIEENERRLEENEKRSREVIKELADRT

SEQ ID NO: 24378 - protein, 59 aa, Artificial Sequence
  Synthetic
EDVVEKLIRELEEINREVNKRNDDLIRELREINKKVNEENKRLMKESDDILKEVRERVR

SEQ ID NO: 24379 - protein, 60 aa, Artificial Sequence
  Synthetic
SIEDLVRELKKKVDEVAEDLRRKVREALERSRENIDRLKKHSEENLRRSEEVVDKLRKET

SEQ ID NO: 24380 - protein, 59 aa, Artificial Sequence
  Synthetic
DKVVKKLIKEVDDILREVTKLVEKLIRELEDINRKVNERNRRLAEESRKILDEVEKRVR

SEQ ID NO: 24381 - protein, 60 aa, Artificial Sequence
  Synthetic
SLDEKVEELRREVDEAIKDIKEKVKRANEESERNIRELEERVKRNLEKSKKAIEELARRV

SEQ ID NO: 24382 - protein, 59 aa, Artificial Sequence
  Synthetic
EKVVEKLRKEVKEVLKEVEDRVRKLIREVERINEEVNRRVKELLEESEKILDDVDKRVK

SEQ ID NO: 24383 - protein, 59 aa, Artificial Sequence
  Synthetic
EVEERVKELEKEVEEVLKESEDHVRKSEEDLRRALEESRKHIEDLERKLKKVLEELERK

SEQ ID NO: 24384 - protein, 59 aa, Artificial Sequence
  Synthetic
KDLLKKLEEEIRKIITENRKLNRDLHRENERIIRDVRRENKRLADELEEIIKEVRERLK

SEQ ID NO: 24385 - protein, 59 aa, Artificial Sequence
  Synthetic
SVEEKVEELEKEVRKALEDSKRHVDESEKRARDLARRSRELVRRWEEEVEKIVRELETR

SEQ ID NO: 24386 - protein, 59 aa, Artificial Sequence
  Synthetic
EDLLRKLADEIRRILEDNRDLNRRLNEKNKEVLDRLEELNKTLADELRDIIRKLEKELE

SEQ ID NO: 24387 - protein, 61 aa, Artificial Sequence
  Synthetic
KELEDVVRKIEEDLRRLEESNEKVHRENEEIIRRVDETNKKVMKEIKEMEKKVRDLVRERK

SEQ ID NO: 24388 - protein, 54 aa, Artificial Sequence
  Synthetic
EVERVIERLEKVVRDSAANVERSIRELERVVEESSKHVEDVKRELKKVVDEIRT

SEQ ID NO: 24389 - protein, 60 aa, Artificial Sequence
  Synthetic
SDLDRVREEAERVVETVRRSNKEVKKKLDRELKRLRDSNKDVVDKIKRVLEKLRELIKRR

SEQ ID NO: 24390 - protein, 54 aa, Artificial Sequence
  Synthetic
EIEEVRDKLRKVVEESSKHAEEVKRDLERVVEESTRNVDRVREDLKRVLDEIET

SEQ ID NO: 24391 - protein, 60 aa, Artificial Sequence
  Synthetic
SLRERIEELKEELRRVLEELERRHRETEKKLEEVLKELKRRHEELVRRLRKALKEIKDKL

SEQ ID NO: 24392 - protein, 59 aa, Artificial Sequence
  Synthetic
EEAIKDVERKVKKLLKELRDLSEKVRKESDDLLRRLRRESERVERETRKLEKELRDEVR

SEQ ID NO: 24393 - protein, 60 aa, Artificial Sequence
  Synthetic
SKADEVRKKVDDINKRLRETTDRVAEETKKLIEELKKSAEEVKREVDKINKDLRKLAEDG

SEQ ID NO: 24394 - protein, 56 aa, Artificial Sequence
  Synthetic
EKDVERLTRKSEKVVREIEKKNEELKRELTEVLKDDERRNKELVEDSRRVLEEIRT

SEQ ID NO: 24395 - protein, 60 aa, Artificial Sequence
  Synthetic
DKARDVARKVEELLERLRELSERVSRTSEDLNRKLKKISEDVSRTSKKLLDELRRAKEKG

SEQ ID NO: 24396 - protein, 56 aa, Artificial Sequence
  Synthetic
EEDVRRLKERVKKVMEELERRHERDKEKSRRVVEKLERDHREDLKRVKKVLEEITK

SEQ ID NO: 24397 - protein, 59 aa, Artificial Sequence
  Synthetic
SKADKVEEEVKELLKRAKALSDRVSEESRRLLKELRDSARRVEEEVKRLEEELRKLKED

SEQ ID NO: 24398 - protein, 56 aa, Artificial Sequence
  Synthetic
EEKVRRVLREVREMLKDLEKKHRDDIKRVTEVLKEDEEKNRDLMRKVDKFLEDIRK

SEQ ID NO: 24399 - protein, 59 aa, Artificial Sequence
  Synthetic
SKAEEVEELVKKLLAEVKKSLDDVRRTVEKLLREVRKSLREVEETVKRLLKRLKDLKDD

SEQ ID NO: 24400 - protein, 56 aa, Artificial Sequence
  Synthetic
EEKVEKLERDVRRALERDTRENKKLEDRVETALREDKKRNDDLREDVKRVLEEIRT

SEQ ID NO: 24401 - protein, 61 aa, Artificial Sequence
  Synthetic
DELEELIRRIEKLIRDSRKITDDVRKEIEKTIRESREINKEVHERNRKLLEEITEVVKRDG

SEQ ID NO: 24402 - protein, 56 aa, Artificial Sequence
  Synthetic
EEDLRRVDDRVRRVVEESEERLRRVYEESRKVVEESRKHLKEDLDRVKRTVEEIER

SEQ ID NO: 24403 - protein, 61 aa, Artificial Sequence
  Synthetic
SELERVEEEIKKLIRTSREINKEVAKRIEETIKESRDINKEVVDRIRELIERLREVVKRDG

SEQ ID NO: 24404 - protein, 56 aa, Artificial Sequence
  Synthetic
EKELKRVEDEVRKVVEESKDHLRKVYEKSKKVVEESKEHLDRVLREVEKEIEEIRR

SEQ ID NO: 24405 - protein, 61 aa, Artificial Sequence
  Synthetic
SELERVEEEIKRLIDESERINRKVVKEIEDTIRTSEEINREAHRRNRELIKRVEDVVRTKG

SEQ ID NO: 24406 - protein, 56 aa, Artificial Sequence
  Synthetic
EKELRRVEEEVRKVVRDSERHLDEVYKRSKEAVDRSKKHLDKDVEEIDRVVKEIER

SEQ ID NO: 24407 - protein, 61 aa, Artificial Sequence
  Synthetic
RELEEVKKEIDRLIREVEEVNKDVVRKIKETIRRSREINKRVVDEIRRLIKELDDVVKTKG

SEQ ID NO: 24408 - protein, 56 aa, Artificial Sequence
  Synthetic
ERELRKVLEKVERVVKKSRDHLDRVYEDSERVVRESEKHLDEVLERVREEIERIRK

SEQ ID NO: 24409 - protein, 61 aa, Artificial Sequence
  Synthetic
RELEEAEKTIEKLIKESRDINEKVARDIDKTIREIREEMKRVEEEIRDLIRRIREVVKRDG

SEQ ID NO: 24410 - protein, 56 aa, Artificial Sequence
  Synthetic
ERKLREVTKRVDKVLEESRRHLEEVYRKSKEVVDEIRKRLREVLKRVREDVERIER

SEQ ID NO: 24411 - protein, 61 aa, Artificial Sequence
  Synthetic
SELDEVAKRIKELIKESRRINEEVERRIKKTIDEVRKINKEAAKTVDDLIKTIRDVVRRKG

SEQ ID NO: 24412 - protein, 56 aa, Artificial Sequence
  Synthetic
EKKLRDLEEEVRRVVEESKDHLRKVYERSRKVVEESRKHLDEVLTRVDKVVKDIRT

SEQ ID NO: 24413 - protein, 60 aa, Artificial Sequence
  Synthetic
SELEEAEKKIERLIEEVRKMNKTVHEENERLIEDLRRVVKEAHERNKRLIEELEDVVRKI

SEQ ID NO: 24414 - protein, 59 aa, Artificial Sequence
  Synthetic
KDVEKKLKDVLDKVRKVVEESRRHLEESLDKVRRVAEEIRKRLKESKDRVDEAAKEIRR

SEQ ID NO: 24415 - protein, 60 aa, Artificial Sequence
  Synthetic
DELEEAEKRIKELIDRLEEFNEEVHRRNEKLIRELREVLKRVEEEIRRLIKELRDEVRKI

SEQ ID NO: 24416 - protein, 59 aa, Artificial Sequence
  Synthetic
KRVEERLERVLREVEEVVKRSRKHLEDSLREVEKAVKEIRDRLDEVLRRVEKAVEEIRT

SEQ ID NO: 24417 - protein, 60 aa, Artificial Sequence
  Synthetic
SELEDAERKVKELIDRLREVNRKVHEDNKRLIDELRDVNRKVAEEVRRLIEELKEVARRV

SEQ ID NO: 24418 - protein, 59 aa, Artificial Sequence
  Synthetic
KRVRDRLKEVEDRVRKVVEDSRRHLEKSLREVEEVIRESREHLEEVLRRVKEEADKIRK

SEQ ID NO: 24419 - protein, 60 aa, Artificial Sequence
  Synthetic
SELEKVREDIKRLIEDLRRANDRVRRESERLNRELREVNKRVHDDNRRLIEELRRLVKDI

SEQ ID NO: 24420 - protein, 59 aa, Artificial Sequence
  Synthetic
ERVRDELRKLLRTVEKVVEESKKHLKEVLDRSREVVEESKTHLEKSLTDVEKVVREIRT

SEQ ID NO: 24421 - protein, 60 aa, Artificial Sequence
  Synthetic
STLDEAVKRIDELIKRLREVNEEVARRSKRLNDELKKVNEDVARKIEELIRRLRDVVRKI

SEQ ID NO: 24422 - protein, 59 aa, Artificial Sequence
  Synthetic
KRVEEELERVLRKVEKVVKESRDHLEEVLRRSEDMARRSREHLEELLKRVEKVVREIRT

SEQ ID NO: 24423 - protein, 60 aa, Artificial Sequence
  Synthetic
SELEEAIRRIEKLIRELREVNKRVAEEVKKSNEESKEVNKRVKDDVKELIERLRDIVKKV

SEQ ID NO: 24424 - protein, 59 aa, Artificial Sequence
  Synthetic
KDVEDKLREVLRRVEKVAEESRRHLEKVARESEEVVKRSRKHLEEVEREVKKVIDEIRK

SEQ ID NO: 24425 - protein, 60 aa, Artificial Sequence
  Synthetic
RTLEEVEKEVEKLIEDLRRVNREVAERIKKSNEDSKRVVERVEDEIRRLIEELKDMVRKV

SEQ ID NO: 24426 - protein, 59 aa, Artificial Sequence
  Synthetic
ERVDKRLRDVLRKVKKVAEESRKHLEELAERSKEVVERIRRRLEEVLKRVREEAEKIRK

SEQ ID NO: 24427 - protein, 60 aa, Artificial Sequence
  Synthetic
SELEDAERRIERLIRELRKANEEVARRIEKSNEDSRRVNKKVAEEIERLIKELRDVTKDV

SEQ ID NO: 24428 - protein, 59 aa, Artificial Sequence
  Synthetic
KRVEEELKRVLDEVKRVIEESKERLKKWLRDSERVVEESRRHLEELRKRVEKAVREIRT

SEQ ID NO: 24429 - protein, 59 aa, Artificial Sequence
  Synthetic
RVEDEVRKMREKSEKVDREIREAVRRSLTRIKEVVDEIRDEVRRSEDKVKKEIDRLRKE

SEQ ID NO: 24430 - protein, 62 aa, Artificial Sequence
  Synthetic
EEVDKLLDEVRREADESNTRLRERVKEVNKRNEEVIEELRKRVEEVHRTNEDLIRELRKKTT

SEQ ID NO: 24431 - protein, 59 aa, Artificial Sequence
  Synthetic
REEEELERVKRRSEKVDEEIKKRLREVAEEVKRSNEEVKKRLEEVLRDSKRKLDELREE

SEQ ID NO: 24432 - protein, 56 aa, Artificial Sequence
  Synthetic
VRELIRELEESNKRVKDVLRKLIEEVKKSDDELREIVKRLVEEVERSNKELEDRVR

SEQ ID NO: 24433 - protein, 59 aa, Artificial Sequence
  Synthetic
REEERLKKLKEDSDRVDREIERKAEKVLEESEEVDRDIERKLREVERKSREVLEELKKR

SEQ ID NO: 24434 - protein, 56 aa, Artificial Sequence
  Synthetic
LEELRKEVEKSNTDLEKIIEDLIRRLKKSNEDVRRTVTELVKEVDRSNKKLEDEVR

SEQ ID NO: 24435 - protein, 59 aa, Artificial Sequence
  Synthetic
REEEELEKLRERSERVDDEIRKRLREALERSREVDEELRRRAEESKKESDEVIKDLARR

SEQ ID NO: 24436 - protein, 56 aa, Artificial Sequence
  Synthetic
LDELRREVEKSNEDVRRFLEKLVRDLEESNRRVRERIKRLHEENKKSNDELRKRTK

SEQ ID NO: 24437 - protein, 60 aa, Artificial Sequence
  Synthetic
SELEELKKKSKKLNDDIERVVEEVLKRSEDINERVKKEVKDVIDRNTDVLRRVKRDVERE

SEQ ID NO: 24438 - protein, 56 aa, Artificial Sequence
  Synthetic
EEAVRKVEKENRESVEKLKKAVKEVRDRNRKVIEELKDLVRRSRDKSKKVVDELRK

SEQ ID NO: 24439 - protein, 60 aa, Artificial Sequence
  Synthetic
REVDKARKDVDDILKRVTEAVDRMDRDNERVLREVEETIRKLEEDSRRINKDIEDAVRKE

SEQ ID NO: 24440 - protein, 56 aa, Artificial Sequence
  Synthetic
RKDVEDVRRKVEEVVRRMEKRLRESEKKSRDVVRKLRKVIEDVERDNDRVVKELEK

SEQ ID NO: 24441 - protein, 60 aa, Artificial Sequence
  Synthetic
SELEEMRRRIERLAEEVRTTVEEVVRRSEELNKEVEKAVRKVVDENRRVLEEVKEEVRKE

SEQ ID NO: 24442 - protein, 56 aa, Artificial Sequence
  Synthetic
KEEVKRVEERVERVVEELRRLVEEVRKRNEDSIEKLKDLVRRSKEESERVVKELED

SEQ ID NO: 24443 - protein, 60 aa, Artificial Sequence
  Synthetic
SDLERVRKESEDLNRRIKTEVRRVLEELKELLKRIKEEVEELVRRNEEVLKRVREEVTKR

SEQ ID NO: 24444 - protein, 56 aa, Artificial Sequence
  Synthetic
EEAVRKVKEDNDRSVEELKELVKDVERKLREAIKELEDLIRRSEEKSREVVERLRR

SEQ ID NO: 24445 - protein, 61 aa, Artificial Sequence
  Synthetic
SLEEEVRRVKKELRRVLEKSTKLIEEVTRELETVLRESRDRVRRAKEELKEAVREVRRDVG

SEQ ID NO: 24446 - protein, 59 aa, Artificial Sequence
  Synthetic
EEEVRKVVEDVERVLRELEKHDRDVAEEVRRVLDELRKHDEDVRRKLRKVLEELKEKIK

SEQ ID NO: 24447 - protein, 61 aa, Artificial Sequence
  Synthetic
SIEDRVRRVEKELREVERKSTETVKRVEEELEEVVRRSRELVERVKERLKKMVEEVKRDTG

SEQ ID NO: 24448 - protein, 59 aa, Artificial Sequence
  Synthetic
EKELEDVERDVRRVLKEAEDNDRRVVERVRRVLKEAEKHDRDVVRRVDEVLKRLKEEIR

SEQ ID NO: 24449 - protein, 61 aa, Artificial Sequence
  Synthetic
SIEEAVERVAKRLEEALRRSTEEVKRVKEETRESVERSRREVEKVEKELREVVERVRRERG

SEQ ID NO: 24450 - protein, 59 aa, Artificial Sequence
  Synthetic
DDRLRKVVEELETVLDELRKNDRRVIEEVRRINDELRRRDEEVIKRVRDMLKKLTEEIK

SEQ ID NO: 24451 - protein, 59 aa, Artificial Sequence
  Synthetic
SLEDKLRENKRRSEAVVEEAERRLRKNEEDSRKVVRELEDKLRRLREESKEMADRLRRK

SEQ ID NO: 24452 - protein, 59 aa, Artificial Sequence
  Synthetic
DKVVEKLLKESKEILDRARETVKRILDDSERILRELRRRVEKLIKESRDILRKVDEDER

SEQ ID NO: 24453 - protein, 59 aa, Artificial Sequence
  Synthetic
KAEEILEDIKRAVEEALRKLEESVRRNKERIREAVERLRETVKEAKERVDEVKRELEEK

SEQ ID NO: 24454 - protein, 59 aa, Artificial Sequence
  Synthetic
EEVLRKVREDLERIIRRVEEESKKSHKDSEDVLRRVEERSKKSLEELEDIIKKVKEEAD

SEQ ID NO: 24455 - protein, 60 aa, Artificial Sequence
  Synthetic
DMEKIVRDVEDRVREVEDRLRRIAERNKREIERVVEELKKTVKEIEDKVREVVKRLEEKG

SEQ ID NO: 24456 - protein, 59 aa, Artificial Sequence
  Synthetic
EEVLRKVVTDLERILRRVLEDAKRVHEESKRRLDDVRRRSEDSVRRLEEELKRVEEEVD

SEQ ID NO: 24457 - protein, 59 aa, Artificial Sequence
  Synthetic
DAEKILEDIKREVDEVLKRLRDIIRRNEEEIRRAVEDLKRIADEDREAIKRVIDELRKK

SEQ ID NO: 24458 - protein, 59 aa, Artificial Sequence
  Synthetic
EEALRKVVEELRKILRDVTEVAKKVHRDSEEVLKKVREDVRKVHEDSKRVLDKVDKDAN

SEQ ID NO: 24459 - protein, 56 aa, Artificial Sequence
  Synthetic
SRLEEVLRRHEELNERVERTVKKVHDDSKELIDRIRKDVEKVVRELEKVIDEVEKN

SEQ ID NO: 24460 - protein, 55 aa, Artificial Sequence
  Synthetic
EKVEEIERHARKVERRLEEIVDRNRKSVDKAKKELEKIVRDVRRRVEEVVDRLRK

SEQ ID NO: 24461 - protein, 56 aa, Artificial Sequence
  Synthetic
DEVRRVLEELRRLLDEVRERVRRVVEEHKRLNDRIRREVERAHEENKRVDDDLRRK

SEQ ID NO: 24462 - protein, 55 aa, Artificial Sequence
  Synthetic
KDVKEVKKEVERVKEELRRLVEELRKHAEKVKEELKRIVDRDRETNERTVEELKK

SEQ ID NO: 24463 - protein, 57 aa, Artificial Sequence
  Synthetic
SEAEDVLRKLERLLEEVRERVADAHRRSKELLDRVDKEVKRVNEENRKLDDDIRKKV

SEQ ID NO: 24464 - protein, 55 aa, Artificial Sequence
  Synthetic
DEARKVREKVKKVEEELRRIVEEDRKEVEKVKRKLEKDVREDEKENRKTVRELEQ

SEQ ID NO: 24465 - protein, 60 aa, Artificial Sequence
  Synthetic
TLEELLEEIRRKVEEVLKKLEDLLRRDHEEVKKVEEELEEINKRSEDRVRKAVRRLERDA

SEQ ID NO: 24466 - protein, 59 aa, Artificial Sequence
  Synthetic
EEAIRKVLRKLEEEAKRLEKRIEEVLKESKDRIDELRKRIEESHKDLERIIEELERRIK

SEQ ID NO: 24467 - protein, 60 aa, Artificial Sequence
  Synthetic
RLEELLERIRKRVEEVKRESERLLKEDHDRVEEAKKRSEDINRRSKEEVDRMLRELETKA

SEQ ID NO: 24468 - protein, 59 aa, Artificial Sequence
  Synthetic
EEAIRRVLKKLEEIAKRLLDENRRVLEESKKIIDKLEEDNRRSHRELKRILDELRKRIK

SEQ ID NO: 24469 - protein, 60 aa, Artificial Sequence
  Synthetic
KEAEDLEKKVEDILRRVRELLEELHRRSEKILKDVKDRSRDLLRRVREILKRVEEKKERV

SEQ ID NO: 24470 - protein, 56 aa, Artificial Sequence
  Synthetic
ERLVREVEKKLRTVEEEVRRIVKENKERLDEAREDVKRSNKTIRDELERARERIET

SEQ ID NO: 24471 - protein, 60 aa, Artificial Sequence
  Synthetic
SEAEDLTRRVREILKRVEDLSKKLNDDTKKILDELRELSKRLMEEVKKILRRVEEKKERV

SEQ ID NO: 24472 - protein, 56 aa, Artificial Sequence
  Synthetic
KRLVDTVREELERVRKKVEDSDRRNEEELRKVKEEARRSNERIRELLKTVEDRIRT

SEQ ID NO: 24473 - protein, 60 aa, Artificial Sequence
  Synthetic
DEVRKLVREVEDILRRVREKSERLVRLVEEILRRVLEESRRLLEETREILERVEEKKERV

SEQ ID NO: 24474 - protein, 56 aa, Artificial Sequence
  Synthetic
ERLVREVKELLDRVADEVRKSDEDIRRLLEDAARKVEESNKRNRDLLETVRRRIEK

SEQ ID NO: 24475 - protein, 60 aa, Artificial Sequence
  Synthetic
SEVEKLKKEVKESSKEVIKEVEKLHRESEKSSEDVKREVEKLHRRSKEVADEVRERVRRR

SEQ ID NO: 24476 - protein, 56 aa, Artificial Sequence
  Synthetic
ERVVEEIERDVRESLRRIEEIIRRNEKRVRESLEDLKRILRENKETVRKVVDELRK

SEQ ID NO: 24477 - protein, 60 aa, Artificial Sequence
  Synthetic
SEVDDLTRRVRDVLRRVEEKVRDLHRRSEKVARDVEREVEELHERSKDVARKVEEKVRRI

SEQ ID NO: 24478 - protein, 56 aa, Artificial Sequence
  Synthetic
KDVVDRIRREVEEMLRRLEDILRRNEDTVRRVKEKLKRIVKRDEEEVRKVLDRLRK

SEQ ID NO: 24479 - protein, 60 aa, Artificial Sequence
  Synthetic
SEVEELKKRVEDVAEEVKDRVRKLHEKSERSSREVEKEVRKLHEESRRVAREVTERVRRI

SEQ ID NO: 24480 - protein, 56 aa, Artificial Sequence
  Synthetic
EEVVKEIRDTVEKVLEEARKIIEDNRKRVAESVETLKDIIRRDEKTMRDVVDELRT

SEQ ID NO: 24481 - protein, 60 aa, Artificial Sequence
  Synthetic
DEVEELRREVEESSRRVEKEARRLHKRSEESSREVEERLKRLHDDSRRVAREVEEIVARS

SEQ ID NO: 24482 - protein, 56 aa, Artificial Sequence
  Synthetic
EDKVRDIKRRIDESKRKIEEIIKRDKEEAEKSEEKIKEIIERDRETVERVVRKLRE

SEQ ID NO: 24483 - protein, 60 aa, Artificial Sequence
  Synthetic
EIEEIEEELKDRVRRSEEKLRRIEKELRELVEKSRKELEDLLDKDRRDMKRVADELRRDD

SEQ ID NO: 24484 - protein, 59 aa, Artificial Sequence
  Synthetic
RRVVEELTRKLEESIKKSEDEVKKVKERLEESIRRSKERLEDARRESERVLTEIRERLR

SEQ ID NO: 24485 - protein, 60 aa, Artificial Sequence
  Synthetic
EVERILDELRRRVEEVVKENEKALDTLRKESERTEEENKRLLDEAREKVDRVVKELKRDD

SEQ ID NO: 24486 - protein, 59 aa, Artificial Sequence
  Synthetic
EKVLRDLAKKLEDVIRKSEELTKELAKRLRESSKRSIDLTRELLKRLEEVLKKVRDALR

SEQ ID NO: 24487 - protein, 60 aa, Artificial Sequence
  Synthetic
SVEEIVEEIRRRSKETEDRNRRVVEELEERVRRVLEELKKIVEDARRKVEKVARELKRDD

SEQ ID NO: 24488 - protein, 59 aa, Artificial Sequence
  Synthetic
EKVVEELLRRLKETSDDSLRRTDELRKELERVLKEVRERLKELDRELKRVLDDVREKIR

SEQ ID NO: 24489 - protein, 59 aa, Artificial Sequence
  Synthetic
KLEDILRKIEKELKEVKEKSERIVREIEKRHEDDKRRVEDIVRRIKEEVERVVKEIKEA

SEQ ID NO: 24490 - protein, 59 aa, Artificial Sequence
  Synthetic
DEVMKKVEKEVRDVIKELEDTAREVEKKSEKVLKETNDLAKEVMDKVRKVAEDLRKKLE

SEQ ID NO: 24491 - protein, 59 aa, Artificial Sequence
  Synthetic
ELEEIVRRIEEEVRRADKEVKEILTEIEKEHRRDVERSDRSLEKIKRDVDRALEEVERV

SEQ ID NO: 24492 - protein, 59 aa, Artificial Sequence
  Synthetic
REVMKKVTEEVREVLDRLRELLKEVAKRSEEVIKRTNELNETVMRDVERVLRELREELR

SEQ ID NO: 24493 - protein, 59 aa, Artificial Sequence
  Synthetic
SEVEKLEEDFREMIERSERTLEKLKKENEDASKKSKEKLEKLLREMKEIIDRIRDLIRK

SEQ ID NO: 24494 - protein, 55 aa, Artificial Sequence
  Synthetic
EEVIKKLRELLERLEREHRKVIEELKKSNKKNEEDIRRVLEELRRLVKKLADDAR

SEQ ID NO: 24495 - protein, 59 aa, Artificial Sequence
  Synthetic
REAEELLKEMKRASEKSEKIIEDLRRENEKLSKESEDIIRKLKEDNERMIRTIEELIRA

SEQ ID NO: 24496 - protein, 55 aa, Artificial Sequence
  Synthetic
EEVIKELRELLERNEREIKKVLDELRRSNEKNERDIERALEELKRTNDELAKRAK

SEQ ID NO: 24497 - protein, 59 aa, Artificial Sequence
  Synthetic
DEVEKLRREIEEIIKEWEKRTRDLKREMKKISDDSRRRIEELLRDFKRIIDELRKAIED

SEQ ID NO: 24498 - protein, 55 aa, Artificial Sequence
  Synthetic
KEVIERLRELVKRVTDKVRKVNEELRKLLEDNADEIRRAIERLRELLRRLEEEAR

SEQ ID NO: 24499 - protein, 59 aa, Artificial Sequence
  Synthetic
SEVEKLVREAEKIIEDIRRVIEELLRRARKINKEWDDVSRKLKEDAKRIIDTVLKLIRE

SEQ ID NO: 24500 - protein, 55 aa, Artificial Sequence
  Synthetic
KDVIERLRDLVRRVKEDIERVLDEWRKSSEEAEERSRRVIEELRRLLEELKERVR

SEQ ID NO: 24501 - protein, 59 aa, Artificial Sequence
  Synthetic
SELEELKKTMDEVNKETKKENDRLLDEARKVNEESRRRLEKLRKELDDVVREVEDARRR

SEQ ID NO: 24502 - protein, 59 aa, Artificial Sequence
  Synthetic
SDKVERVLRELRKSSRKVHEDSKKVVEDLERSSRTVEKELRDALKELEDKVREVEKKLK

SEQ ID NO: 24503 - protein, 60 aa, Artificial Sequence
  Synthetic
DELEKLLEEARKVNEETKEANERLLREMEKVNKESEDANRKLLEELKEVVDRVDDLARRN

SEQ ID NO: 24504 - protein, 59 aa, Artificial Sequence
  Synthetic
SEDVKRVVDELRESSREVHRRSREVVERLRRSSEEVHKKSRDVLRELTRLVREVKERLR

SEQ ID NO: 24505 - protein, 60 aa, Artificial Sequence
  Synthetic
DELETLLRELERVNKETERELERLKREAEEVNKATRKDLDELRKEIDKVVKEVEEARRRN

SEQ ID NO: 24506 - protein, 59 aa, Artificial Sequence
  Synthetic
SERVKKVVDELRDSSRRVKEKLEDVVRRLRDLSRRTKEEVEKVEEDLRRKVREVEERLR

SEQ ID NO: 24507 - protein, 60 aa, Artificial Sequence
  Synthetic
DELETLLDEAKKVNEETRRANRELRERVREVNKRTEEELKKLRDRLEKVVDDVDKLRKRN

SEQ ID NO: 24508 - protein, 59 aa, Artificial Sequence
  Synthetic
SRRVREVEERLKKLSEDTHRDSRRLVEEMRRLSKETEKKVEDVVRDLRRLVKEVEERVK

SEQ ID NO: 24509 - protein, 60 aa, Artificial Sequence
  Synthetic
DELEKLRRELEEANRRTKKANEEILREAERVDERSEEELRKILETLKKVVKDVDDMARRN

SEQ ID NO: 24510 - protein, 59 aa, Artificial Sequence
  Synthetic
DRRVRTVVEELKKLSRETHEDSKRVVEELERLSRESERKLREVVKEMRKLVKDVEDKVK

SEQ ID NO: 24511 - protein, 60 aa, Artificial Sequence
  Synthetic
DELEELLRRVEEVDKESKRRLDEIKRRMKEVNDRTREALRDLLRRLAEVVKRVLDLIRRG

SEQ ID NO: 24512 - protein, 59 aa, Artificial Sequence
  Synthetic
SERVKKVVDDARDSSRKTVERLETVVRDLKRSSDDVEREVRELLKELERLVKKVEDDAK

SEQ ID NO: 24513 - protein, 60 aa, Artificial Sequence
  Synthetic
RELEELLRKVRKLVEEIERELKKLLEEDRRLSEESREELRKLLEDARRMIREIEELLKRR

SEQ ID NO: 24514 - protein, 58 aa, Artificial Sequence
  Synthetic
EDAKRVLKEIRRLAEELKKSVKRVIEEVEDSNRRNEEEVRRVLEEIRRLLEDLDRKVK

SEQ ID NO: 24515 - protein, 60 aa, Artificial Sequence
  Synthetic
SELEELLKDAKRVIDTSRRLITELEKRDEEIIRRIKDLLRRVTEEAKRMLDEIREELKRR

SEQ ID NO: 24516 - protein, 58 aa, Artificial Sequence
  Synthetic
EKAKRVLEEIRKLLEDSKKESEDVARKLKKSNDELRRDVERVLREIEKRLEDLKREVE

SEQ ID NO: 24517 - protein, 60 aa, Artificial Sequence
  Synthetic
SELEKLLREVEKIIRDSDDLLRRLEKRNRDLIRTSEKLLKEVKDDVDRVIRELERLLEEE

SEQ ID NO: 24518 - protein, 58 aa, Artificial Sequence
  Synthetic
EKAEDVLRRIEKLLDDSRRRSEKVAKELEESNERSKRKTEKVLKEIKEALDRVREKVK

SEQ ID NO: 24519 - protein, 60 aa, Artificial Sequence
  Synthetic
SEIEKVARDVEELLKKVEKKNRDMVERVRRLLEKVKRENEELVRRVEESNERLKERVDRS

SEQ ID NO: 24520 - protein, 56 aa, Artificial Sequence
  Synthetic
VEELEKTVRKLARDAEKISEDVERRVRELARRLRKISEEVLRRNKELVRRVDEEIR

SEQ ID NO: 24521 - protein, 60 aa, Artificial Sequence
  Synthetic
SEVEEAVERVKKLLEKVRKDNEEFRERVRKSNEEAEERNRRVVEEVRRSNEELKEKVERS

SEQ ID NO: 24522 - protein, 56 aa, Artificial Sequence
  Synthetic
VEDLKRRVKELADEARRISEKVLRDNKRLLTELDKISERVLRENEKLVREVEETIR

SEQ ID NO: 24523 - protein, 60 aa, Artificial Sequence
  Synthetic
SEIEKVAREIEELLRKVAEDNRRMVERVRRLLEEVKTRNKKMVDEVKESNERLKDKVRRR

SEQ ID NO: 24524 - protein, 56 aa, Artificial Sequence
  Synthetic
VEELKRRAERLIEELRKISEEVERRVKRLVEELEEITRRIKEENDKLVREVEKELK

SEQ ID NO: 24525 - protein, 60 aa, Artificial Sequence
  Synthetic
SEVEKVVEELKDLVRKSSEKNRKVAEEVKKSNDDLRRKVEEAVREVRESNERLKREVDES

SEQ ID NO: 24526 - protein, 56 aa, Artificial Sequence
  Synthetic
VEELKDRVRKLIEESERISREILKTNRKLLKELEELLKRLLKRNRELVREVKEEIK

SEQ ID NO: 24527 - protein, 61 aa, Artificial Sequence
  Synthetic
SDIERVVKEVKDLLEEVRKDNERVMDEVRKLLEELKRKLRKVVEEVRRSNEELKKEVDRRN

SEQ ID NO: 24528 - protein, 56 aa, Artificial Sequence
  Synthetic
VETLRKEVEELADDLRRISEEVRDRVRKLVTKAEEILRRVLETNKKLLKEVKETLK

SEQ ID NO: 24529 - protein, 60 aa, Artificial Sequence
  Synthetic
SEIEKVAEEIKKLLRKVEEDNKTVVEEVRRSNEKLKRDNDKVVRDVERSNRELKEELDRS

SEQ ID NO: 24530 - protein, 56 aa, Artificial Sequence
  Synthetic
VEELKKRVEELARRAKEISDKVRDDNEKLLRELREITKRVKEENDRLLKEAKDAIK

SEQ ID NO: 24531 - protein, 60 aa, Artificial Sequence
  Synthetic
KEIEDVAKRVEELLRESSREVEEVLREVEELVRRSTRRNEEAVRRVRKSNKELEDEVRRS

SEQ ID NO: 24532 - protein, 56 aa, Artificial Sequence
  Synthetic
VKTLLDEAKRLVDRSRELLERLLRDVRRLIKESDKITRELERKNEKLLKEVKEEID

SEQ ID NO: 24533 - protein, 60 aa, Artificial Sequence
  Synthetic
SEIEDAEREVRRLLRESSERVKTVIEEVRELLRRVKRENDEAVKEVEKSNRDLEDKVRRG

SEQ ID NO: 24534 - protein, 56 aa, Artificial Sequence
  Synthetic
VEELKERVKRLVADSERLLKELRDRVKELADEARRTTEEVLRRNRELVRRIEEDIR

SEQ ID NO: 24535 - protein, 60 aa, Artificial Sequence
  Synthetic
SELDEVLKTVRKIIEENEKIVKEVLDTSRRSVEEVRKHTKEVLDRVRELAKELEDATRKT

SEQ ID NO: 24536 - protein, 58 aa, Artificial Sequence
  Synthetic
EEVDKVAEEIEKLVRESNRKVREVVKEIEKLNRDMRKESEDAVKEIEELLRTLEEKVR

SEQ ID NO: 24537 - protein, 60 aa, Artificial Sequence
  Synthetic
SELDEVLKTVEKIIRDNEEIVKEVLRRSERSIKELKKHTDDILRKARKLAEELKRVVERT

SEQ ID NO: 24538 - protein, 58 aa, Artificial Sequence
  Synthetic
KRVKDVAERIRELVEESNRKVREVVERIKDLNRKVNKTSEDAAREIEKLLEELREEVR

SEQ ID NO: 24539 - protein, 60 aa, Artificial Sequence
  Synthetic
DELEEVLKRVREIIKRNEDHSDRVREKSRESVKELEEHTERVLRDVERLARELEEMIDKT

SEQ ID NO: 24540 - protein, 58 aa, Artificial Sequence
  Synthetic
KKVDDVAREIEKLLKESNDKSRELVKEIKDLNKRLNEKSEEAVKRIEDLLRRIEERVR

SEQ ID NO: 24541 - protein, 60 aa, Artificial Sequence
  Synthetic
KELEDVLERVKEIIKRNEEILDKVRREVEESVRRAEEILKEVLERVRDLVRKLDDIKDKM

SEQ ID NO: 24542 - protein, 58 aa, Artificial Sequence
  Synthetic
EEVKRVADEIKRLADESNEKVRRVVRRIDELNKEVDRKLKEVMKEIKKELEDAERRVR

SEQ ID NO: 24543 - protein, 60 aa, Artificial Sequence
  Synthetic
DELEEVLRRVRKIIEENKEIVRRVLEDVKRSVEELERHTERVLREAKRLADELEDARRKI

SEQ ID NO: 24544 - protein, 58 aa, Artificial Sequence
  Synthetic
EEVKRVAKELRELLERSNREVRRVVEEIKKLNDEVRKKSEEMRRRIEKLLEELERKVK

SEQ ID NO: 24545 - protein, 60 aa, Artificial Sequence
  Synthetic
SDLEEVLRRAEKLIEDLERIVRKVLEDSDRSIDEVRRHTEKVLRDVRKLAEELKDIARKT

SEQ ID NO: 24546 - protein, 58 aa, Artificial Sequence
  Synthetic
EEVKRVIDEIRDRLRKAEERVRKVIEDIKRKNKKLREDSEKAEREIDELLRKVEEDVK

SEQ ID NO: 24547 - protein, 60 aa, Artificial Sequence
  Synthetic
SELEEVLERVKDLLKKLKEHSDRVLEESKESIDRVRKHTEEVLRTARELIERLDEMRKRT

SEQ ID NO: 24548 - protein, 58 aa, Artificial Sequence
  Synthetic
EEVKDVAREIRRRLDELRKDSERVAEEIRRLNKKLRDESRKAIKEIEELLRRVTKKVE

SEQ ID NO: 24549 - protein, 60 aa, Artificial Sequence
  Synthetic
DELEEVLERVRKLIDELRKHSKEVLDTVRDLLRRHKKKNEDSLRTVRKLLTDLEDAVRKI

SEQ ID NO: 24550 - protein, 58 aa, Artificial Sequence
  Synthetic
ERVKRVAEEIKKLLEDLRKESEDVVKELEDLLDELRRRTEKVVREIEELLKRLEERVK

SEQ ID NO: 24551 - protein, 59 aa, Artificial Sequence
  Synthetic
SEVERVERRLEKVIEEDKERTKRVEREVEDSNKKDDDLTREVLDRVRKSARDVERKLEE

SEQ ID NO: 24552 - protein, 55 aa, Artificial Sequence
  Synthetic
REALRRLRELVKKLEDDNRRVLRRLDKLLDDVRKKNEEAMRESRDLSRKVAEKIR

SEQ ID NO: 24553 - protein, 59 aa, Artificial Sequence
  Synthetic
DEVREVEKRVRESNERDKKLLREVLEEVRRSDKDDDDRTRKVLKRVEKAAEEVKRLLEK

SEQ ID NO: 24554 - protein, 55 aa, Artificial Sequence
  Synthetic
EDVIRKLRKSLKEVKDDSRRVLKELDDSLRETHKRNRDAMRRLDELLEEVARRIK

SEQ ID NO: 24555 - protein, 59 aa, Artificial Sequence
  Synthetic
DEIEEIKRRIEKSSEDDKRVLRELEARAREIRKELDERVKRLEKRIKELLERLRKLKED

SEQ ID NO: 24556 - protein, 58 aa, Artificial Sequence
  Synthetic
RDVRRVLEEWKRLSRKNEEENKAVIEKLRALLEDLKRRLKEVLKRIAELVKKIADELK

SEQ ID NO: 24557 - protein, 60 aa, Artificial Sequence
  Synthetic
RESEELRREIEKISRENKELVRRLEEAIKRLSDEDKELVERLRRETKKIADKVEDLLEKL

SEQ ID NO: 24558 - protein, 55 aa, Artificial Sequence
  Synthetic
EEVLREIKKIIDDNRRENREALERIKDIVRRNEEENEKALRESRKRTRELEERLR

SEQ ID NO: 24559 - protein, 60 aa, Artificial Sequence
  Synthetic
SRVETIRKRVEDLIRRSEDLIRRLEEDVKRVVDEIRKLLEKLKEDDERVIRRIEDLLRKE

SEQ ID NO: 24560 - protein, 55 aa, Artificial Sequence
  Synthetic
ERVVEEIKERLDRSRRRTEEALERIRKRLEEVKKEVEDVLREVEKTNREIKKEVR

SEQ ID NO: 24561 - protein, 60 aa, Artificial Sequence
  Synthetic
SRVDELRRRVEELLKRSKELLEEIKRRDEEVLRRIKELLDRLRERVDDALRKISELLTRE

SEQ ID NO: 24562 - protein, 55 aa, Artificial Sequence
  Synthetic
EEVVREIKKKLTESREDTKRLLEELKKTNDDIRKDVERLRREVEKKVRDIERRVK

SEQ ID NO: 24563 - protein, 59 aa, Artificial Sequence
  Synthetic
SEVEKLLEEVRELTKRHKEELRRLNKEMEKATRDHLRKSKKLNDEAREMVRRVEELVKN

SEQ ID NO: 24564 - protein, 58 aa, Artificial Sequence
  Synthetic
ERAARVKEELDKLHKDLEREVRESKRTLKELHDRLRKAVEESKEHLKRLLDELRKKVK

SEQ ID NO: 24565 - protein, 59 aa, Artificial Sequence
  Synthetic
DEVERLLEEVRRVVKEIEDRSRKLNEDARRVTEDHLRKSEELNRRVEDAVRRIRELTKN

SEQ ID NO: 24566 - protein, 58 aa, Artificial Sequence
  Synthetic
EEARKIRETLKRLLDELRKKLEESKKHLDELHDRLRRELEKSKRHLEELLKRLEDELR

SEQ ID NO: 24567 - protein, 59 aa, Artificial Sequence
  Synthetic
SELERLLEKARRDTERHLRESERLNRELKKATDDHLRKSRELNKRLEEVVRRVEEESRN

SEQ ID NO: 24568 - protein, 58 aa, Artificial Sequence
  Synthetic
REAKKVEDDLRDLHRRLKEAVDRSKKHLEDLHKELEDELKRSIDHLRKLLEEVKRKLD

SEQ ID NO: 24569 - protein, 59 aa, Artificial Sequence
  Synthetic
SRVEDLLRRVREVVKRVKKDLTKLLEEVKRMTDEHLKRSKELNDRAEEIVRRLKELLDR

SEQ ID NO: 24570 - protein, 58 aa, Artificial Sequence
  Synthetic
ERAREVVERLDELLKEVADRVEEVKDRLRKLHRKLEESVKKSLEHIKRLIDDLRRKAK

SEQ ID NO: 24571 - protein, 59 aa, Artificial Sequence
  Synthetic
RELEKLLEDARRVVTTLTRASEKLNEDVKKVTEEHKDRIRRLLDTVRRIVEEVDKRTKG

SEQ ID NO: 24572 - protein, 58 aa, Artificial Sequence
  Synthetic
EEARKVKEELDRLLEDLRKKLEDSKRHLDELHRELEETVREVSERLKELLDAVRRRAK

SEQ ID NO: 24573 - protein, 59 aa, Artificial Sequence
  Synthetic
SELEKLLKDVADMVREITERSKKLNDELKKLTEDHDRKIKRLNERLEEIIREVEKLVDD

SEQ ID NO: 24574 - protein, 58 aa, Artificial Sequence
  Synthetic
DEARKVAERLKELLDRLRRKLEESKRHADELHERLRKSVEDSKKHIKDLVDELKRRVD

SEQ ID NO: 24575 - protein, 60 aa, Artificial Sequence
  Synthetic
SRVEELLKRLEDATRRHLEVSKRLNDDLRRATKDHLDKLRELNERVKKVVDDVVEKIKSN

SEQ ID NO: 24576 - protein, 58 aa, Artificial Sequence
  Synthetic
EEAREVRERLDRLHEELEKEVRRSEKTLKELHDRLRKEVERSKRHLDELLKDLEDKVR

SEQ ID NO: 24577 - protein, 59 aa, Artificial Sequence
  Synthetic
SRVEKLVREVEKVVEEVERTIRKLLEDVKEMTDRHLKMIEDLNRELEEIVRRVTELIKN

SEQ ID NO: 24578 - protein, 58 aa, Artificial Sequence
  Synthetic
DEARKVKKRITELVERVEREVDRVKKELEKLHERLKREVEKSSEHIKRLLDELRKRAE

SEQ ID NO: 24579 - protein, 59 aa, Artificial Sequence
  Synthetic
RELEEILRRVKEVTKDHLDKIDELNKRLDKATKEHLERLRDLNRRLKEVVERIEEEIRN

SEQ ID NO: 24580 - protein, 58 aa, Artificial Sequence
  Synthetic
READKVRKDIRRLHEELAREVKKSEDHLRKLHEELRDEVRRSEEHLDALLEDLKRKVD

SEQ ID NO: 24581 - protein, 59 aa, Artificial Sequence
  Synthetic
SELEKLLRDMEEATKRHDEMLKKLNDEIRKVVERILKELEDLNRRLEEIVRRLKEESKN

SEQ ID NO: 24582 - protein, 58 aa, Artificial Sequence
  Synthetic
EEADDVRRRLERLHRELRKSVETSKKHLKELLDRLAKSIEDSKKHARELLKRLEEDIK

SEQ ID NO: 24583 - protein, 59 aa, Artificial Sequence
  Synthetic
SEVEELLDRVRKVVEDLMRESKRLNDELKKIVDDILRRLRELNKEIKDVVDEIKKLLDN

SEQ ID NO: 24584 - protein, 58 aa, Artificial Sequence
  Synthetic
EEADKARKDLKRLLDRLRREVERSKEEMDKLLEDLERAVRESEKHLEKLLRDLERRAR

SEQ ID NO: 24585 - protein, 59 aa, Artificial Sequence
  Synthetic
SRLEELLKRLDDIVKRVLTKIRELNERLKKIVEELLRRSEELNREVRRVAEEIRRLEEG

SEQ ID NO: 24586 - protein, 58 aa, Artificial Sequence
  Synthetic
DKARDVRRTIRKLVRDVAEAVRRSTEHIDKLLEDLEREVRRSERDIERILRELEEEAR

SEQ ID NO: 24587 - protein, 59 aa, Artificial Sequence
  Synthetic
SDVEKLLEDVRRMTEEHKELIKELNERVERIVRKVVEDSKKLNDELREIVKRVEDESRN

SEQ ID NO: 24588 - protein, 58 aa, Artificial Sequence
  Synthetic
EEAARVREDLDRLHEELERFVRESKKHLDEMLKELRRRLERSKEEIDRLVKEAEEKLR

SEQ ID NO: 24589 - protein, 60 aa, Artificial Sequence
  Synthetic
REVEEVLKEVKKIVDRNREELKRVLDEIRELVKRIEDDLRRVNEESEKLVRTLLELMRRG

SEQ ID NO: 24590 - protein, 55 aa, Artificial Sequence
  Synthetic
EEVRERIERLIEKSERDVREVKKKVEELARRLREEVEKLKKHVKRLLEELKKAAD

SEQ ID NO: 24591 - protein, 60 aa, Artificial Sequence
  Synthetic
SEAEDALRKIKKLVDEVVERIKKVDDDSRKLVEEVERTIEKLDKESEDLVKKVKDMKRRG

SEQ ID NO: 24592 - protein, 55 aa, Artificial Sequence
  Synthetic
EEVKKEVKRLLEELKRRLDESNKRNKRLIDELRKKLEDSRRRNEELLRDLKETAT

SEQ ID NO: 24593 - protein, 60 aa, Artificial Sequence
  Synthetic
DEAEEVERRSRELVERAKTEIEKLDRESKRLVDTVARKIEEVDKRSEELVRTVEELRRRG

SEQ ID NO: 24594 - protein, 55 aa, Artificial Sequence
  Synthetic
EEVEKENRELNRRLKEALDESNKRNRTLLEDLRRKLRESEERNRRLLRKLEEDAR

SEQ ID NO: 24595 - protein, 60 aa, Artificial Sequence
  Synthetic
SEAEEALKKVEELVRRVEEEIKRVDERSKDLVRRVERKLEELVERSKELVKRLLDMRRRG

SEQ ID NO: 24596 - protein, 55 aa, Artificial Sequence
  Synthetic
EDVERRVRELIERLKRKLEESNRRNKKLIDELRKRLEEVKRENEKLNEDLERETK

SEQ ID NO: 24597 - protein, 60 aa, Artificial Sequence
  Synthetic
DELERVLKRVKELIDKSRREDEELDERSKELVKKVLDELKDALRKIEKLVRDLKEMTDRG

SEQ ID NO: 24598 - protein, 55 aa, Artificial Sequence
  Synthetic
EEVRKDAERLIRENEEDNRRSNERNKKILKELKDALDRVKEEVRKLIRRLEEEAR

SEQ ID NO: 24599 - protein, 60 aa, Artificial Sequence
  Synthetic
SEAETVLEEVKKLVERSREEDKEVDDESRELVERVEEKLRRVLKKSKEDVDRVMRLIEEG

SEQ ID NO: 24600 - protein, 55 aa, Artificial Sequence
  Synthetic
EEVEDTIRRLIEENKKRNEESNRRNRELIKKLERKLEEVKRRNEDLNRKLEETAR

SEQ ID NO: 24601 - protein, 57 aa, Artificial Sequence
  Synthetic
STLEEAEEEVRRLIKRTEDETRRVADEVKKLLDKHRRATEDVEKKVRELLDRLKKDE

SEQ ID NO: 24602 - protein, 59 aa, Artificial Sequence
  Synthetic
DREIEKIVRRAKETNEENREIIERILKEIKELIDDANRKLKEILDRIRELVETVKRKAK

SEQ ID NO: 24603 - protein, 57 aa, Artificial Sequence
  Synthetic
STLEEVERRIRELLDRHRRATEEVEKEVDRLNKETRDELDRVRKEIEKLLKDLDRKE

SEQ ID NO: 24604 - protein, 59 aa, Artificial Sequence
  Synthetic
DEELRRILKRVEKLVKDLNDKLRKILDDARRSNEEIKRRLEEILKEVKRLVDTVTERAR

SEQ ID NO: 24605 - protein, 58 aa, Artificial Sequence
  Synthetic
SRIERAEEELKRSLKELREDLERVVRTIRKILREHEEKSKDVKRRIEELLREVKKRMV

SEQ ID NO: 24606 - protein, 56 aa, Artificial Sequence
  Synthetic
VDKVLRDVEDLNRTTLKLLEDLLRTVEEVVRRADKLLEDLLREIKRLVDEVMERDR

SEQ ID NO: 24607 - protein, 58 aa, Artificial Sequence
  Synthetic
SEIEEIEKEIRKSVEEVKKTLDKVVTEIRKSTREHEKKSEEVRKRSKELNKDLRDRLV

SEQ ID NO: 24608 - protein, 56 aa, Artificial Sequence
  Synthetic
VKTVLDDVRRVNEETKKRIRDLLEESKRSDEEADRRAEELLERNERLVRKVAEEAR

SEQ ID NO: 24609 - protein, 58 aa, Artificial Sequence
  Synthetic
SRIEEVIRRAREILEDHRRKSTEVRERLKKLLKEHEDKSRRVKEESEKINRDVKRELV

SEQ ID NO: 24610 - protein, 56 aa, Artificial Sequence
  Synthetic
VDKVLKEIEDLVRKADELLRELLKRVEDLVRRADEVLEELLRRNRKLAEDVMRKDK

SEQ ID NO: 24611 - protein, 58 aa, Artificial Sequence
  Synthetic
REIEEVEKEIKKLLDEHRKKSDDVVRKLEKILRDHERRTEDVKRESEKINREVEKRKV

SEQ ID NO: 24612 - protein, 56 aa, Artificial Sequence
  Synthetic
VDEVLERVRELLERADRKLEELLERVRKLVEDANRVIEEVLERNKRLADEAMKKDK

SEQ ID NO: 24613 - protein, 58 aa, Artificial Sequence
  Synthetic
SRIEEIVKRIRDILKEHEDKSRRVVEDIKRSTEELKRALREVVERIKTILDDVRRRLV

SEQ ID NO: 24614 - protein, 56 aa, Artificial Sequence
  Synthetic
VDKVLEDVRRVAKEADDRLEELLERSKKLNKETLDELERLLREVEELVKEVAERDR

SEQ ID NO: 24615 - protein, 58 aa, Artificial Sequence
  Synthetic
SRIEEVSERVREILRRHEEKSREVVERIKKSTKELRDEVRKVRATSKEINDDVRRRLV

SEQ ID NO: 24616 - protein, 56 aa, Artificial Sequence
  Synthetic
VDRVLERVEKMVRDADKRIDEVRKESERLNEETRRRIERLLRENKKLADEVAERAR

SEQ ID NO: 24617 - protein, 58 aa, Artificial Sequence
  Synthetic
SRIERVEERMRELLDRHRETSKRVVEEIRKSTEEHKEKSERVVRESERLNREVERELV

SEQ ID NO: 24618 - protein, 56 aa, Artificial Sequence
  Synthetic
VDRVLEEVERLVTEVNREIKELLERSKRSDKEADRRLEEVVKTNRELAERVARRAT

SEQ ID NO: 24619 - protein, 58 aa, Artificial Sequence
  Synthetic
SEIEEVVRRLEELVKRVAEELKRVVDRIEDLLREHKDKSRRVEERSKEINEDVARRLV

SEQ ID NO: 24620 - protein, 56 aa, Artificial Sequence
  Synthetic
VKEVLERVKKLVDDLIRRLKKLLEDLKKLVDDADEEIKRVLEENEELARRAAERDT

SEQ ID NO: 24621 - protein, 58 aa, Artificial Sequence
  Synthetic
SEIEDVVRRARELLERLRKRVREVVEDIRRSTEEHKEKSERVVKTSEELNKRLEDELV

SEQ ID NO: 24622 - protein, 56 aa, Artificial Sequence
  Synthetic
VDKVLEDVRRLVKEAVDRIDKILRDSRESDRRADEEIKKVLDRNRELVKKVADEDT

SEQ ID NO: 24623 - protein, 58 aa, Artificial Sequence
  Synthetic
DEIERVEEEIRRLLEEHKKRSDEVVRRLEKLLKDHKEVTRKVVEESERINRDVERRLV

SEQ ID NO: 24624 - protein, 56 aa, Artificial Sequence
  Synthetic
VKEVLERIRKLVKDVNKRLEEILEEVERLVRRANRRIEELLERNRRLVEEVARRDE

SEQ ID NO: 24625 - protein, 58 aa, Artificial Sequence
  Synthetic
SEIEKVEEEIRRILEEHKRISDEVKRRVRKSTEEHEKRTEDVERRSREINEEVEARLV

SEQ ID NO: 24626 - protein, 56 aa, Artificial Sequence
  Synthetic
VEEVLRRIRKLAEEVNKELKRLLDESKESDDRLNKRLTEILRENEELARDVARRVK

SEQ ID NO: 24627 - protein, 58 aa, Artificial Sequence
  Synthetic
SKEERIEEALRDLVRRHKEVSRRVVETIKDLAKKLEEKLRRVETDSKRINDEVRDKLV

SEQ ID NO: 24628 - protein, 56 aa, Artificial Sequence
  Synthetic
VERVLEEIKKLVEEVNRELRELLKRIEELLKRAEEMLERLLRENRRLVEEVARRDK

SEQ ID NO: 24629 - protein, 60 aa, Artificial Sequence
  Synthetic
SESEELDKEIDDIVREDEELNKELRKRNDDAVRRVEKVIEDLLRRNEDAAEKVKKLLEEL

SEQ ID NO: 24630 - protein, 55 aa, Artificial Sequence
  Synthetic
RELLRKLREILEDLRRKNERTEEESEEILRRLTKLAEEVLRRSRKILEDLREALR

SEQ ID NO: 24631 - protein, 60 aa, Artificial Sequence
  Synthetic
SEKDELRKRMRDISKENKELLEKLEREIRELSKENEKLNEKLRRELEELRKTIKDLLDRL

SEQ ID NO: 24632 - protein, 55 aa, Artificial Sequence
  Synthetic
RELLKEAKELLEENRKRNEEILRRAEKVLRDNAEKDKRTLEKVEEILDRLRRELT

SEQ ID NO: 24633 - protein, 60 aa, Artificial Sequence
  Synthetic
KEAEDLEREMREISDRNRKLNKKLRRDIKEISDDNRRLLEELRRRLKKMEEDVRRLLEEL

SEQ ID NO: 24634 - protein, 55 aa, Artificial Sequence
  Synthetic
RELLTEARKLLERNREEDKKSLDDARKALKENKEENDKIKEEIDKILRELEEELR

SEQ ID NO: 24635 - protein, 60 aa, Artificial Sequence
  Synthetic
EESERLAKRVDDLSRENEELNKRLRDEMEKISRENKELLKDLRRKADKIVKDVERLLEEL

SEQ ID NO: 24636 - protein, 55 aa, Artificial Sequence
  Synthetic
RELTRRIEKLLKDNTDRDKKSEDDLRELLKENKKRNDEILEEIRRILEELRKKLT

SEQ ID NO: 24637 - protein, 60 aa, Artificial Sequence
  Synthetic
SLDKEIERKVEEIERRLKESNDRLREKVDEIRRRSERLNTELNERVDRIAERIRRMKRDG

SEQ ID NO: 24638 - protein, 55 aa, Artificial Sequence
  Synthetic
ERLEEKIDRIIRELERRNDKSREELEKIIRELRERTKESEKRLEDIIRELEERTR

SEQ ID NO: 24639 - protein, 60 aa, Artificial Sequence
  Synthetic
DADKRLRTDVRRIVEDLKRSNEELRRRSEEIAKRSDKLNKELNKKSKEIEERVKRMRDEG

SEQ ID NO: 24640 - protein, 55 aa, Artificial Sequence
  Synthetic
KDLEKELRDIIRELRERNRESEEEDERIIRELEKRTKDSEKRDDEILRELEREIR

SEQ ID NO: 24641 - protein, 60 aa, Artificial Sequence
  Synthetic
SLVEKIAREVRKIKEDSKRLNDELNEKVRKAVEDLERSNRELEKRVREIEERVRRAETEG

SEQ ID NO: 24642 - protein, 55 aa, Artificial Sequence
  Synthetic
KELEDDIERIIKELEELTRRSEEKLRETIERLEERNKETAERLERIIKELEERSK

SEQ ID NO: 24643 - protein, 60 aa, Artificial Sequence
  Synthetic
KEAEELEERVKRIEEESRRLNRELNEKVKDIAKKLEDSNDKLRKDSEEIAERVKRARTEG

SEQ ID NO: 24644 - protein, 55 aa, Artificial Sequence
  Synthetic
DEVVKKLEDIIREIEKTTRESEKRLEDIIRKLKKKNDDTEREDREIVKRLREETK

SEQ ID NO: 24645 - protein, 60 aa, Artificial Sequence
  Synthetic
SLLEKLERDVERLSEEDEKLNEDVRRVDREIVERDKKLNREVNERVKRLAEEVKDIRRRV

SEQ ID NO: 24646 - protein, 55 aa, Artificial Sequence
  Synthetic
ERAEERLRRIIKRNKEENERTAKESRDSIEELKERNERSKRRLEKILEDLERETR

SEQ ID NO: 24647 - protein, 60 aa, Artificial Sequence
  Synthetic
REAEELEKRVRKIEREDDKLNEELNRRAKDVSREDKELNDRVREVVRRLVEEVDRIRRDV

SEQ ID NO: 24648 - protein, 55 aa, Artificial Sequence
  Synthetic
EELEKKLEDIIRELKKRNDESAERIRRLIKTNEDENRRTAEEIKKILDDIRRKVK

SEQ ID NO: 24649 - protein, 59 aa, Artificial Sequence
  Synthetic
SELEEIRKKIDDLRRRVEEINERITREDKRLVDELKEINKRITDRVRKIARDVEELLRK

SEQ ID NO: 24650 - protein, 60 aa, Artificial Sequence
  Synthetic
DEERLRTVDEEVKKILDELREKLDRNRRRSEETNRRLDELLKENARRVEEIIRRLREEVK

SEQ ID NO: 24651 - protein, 59 aa, Artificial Sequence
  Synthetic
SELEEIKKRVEEIARTLEKLNRDITKLDEDLAREVEDINRRITETVEEIAKRVERLREK

SEQ ID NO: 24652 - protein, 60 aa, Artificial Sequence
  Synthetic
DKERLDKLRTEVKKIMDDLRRILEKNAKDSKRSLDRLRKILEDNKEKVKRIADRLREAVR

SEQ ID NO: 24653 - protein, 59 aa, Artificial Sequence
  Synthetic
KDEKRIKDVLKKLEDDNKKLNDEIKKLNEEIARKNEELNKRIEDMIRKAEREVDELKRN

SEQ ID NO: 24654 - protein, 55 aa, Artificial Sequence
  Synthetic
KEVDDEARRILEKLRRENERTKEESKEINEELEKRNRESVERIKEILRRLEEKLR

SEQ ID NO: 24655 - protein, 59 aa, Artificial Sequence
  Synthetic
SEVERLLREVEKVLRRVVKRSRDLNEELKKRSKEHKETSERLNREMKRVLREVEKKIDE

SEQ ID NO: 24656 - protein, 55 aa, Artificial Sequence
  Synthetic
REVKKRLDELLKRLEREVRESEKRMDRSHEDVRREAERSKKELEELLKKLEDKVR

SEQ ID NO: 24657 - protein, 60 aa, Artificial Sequence
  Synthetic
SEVEKILRDVEDATRRHKRTSEELNRRLEEVVRRVKEESKELNERLREVVKRVKEEIRKT

SEQ ID NO: 24658 - protein, 55 aa, Artificial Sequence
  Synthetic
REVKKRIDELHDDLRRVMEASKERIDRILEDLRRVVERSKEELRKLLEDLKRTVD

SEQ ID NO: 24659 - protein, 59 aa, Artificial Sequence
  Synthetic
SEVEELLKRVEEATERHKREIERLEDEIRKVLEDVDKRSKELNDHNRDVIEKIRERIER

SEQ ID NO: 24660 - protein, 55 aa, Artificial Sequence
  Synthetic
REVKTELDKLHEDLKRTAEEVKKRLDDLLKELEKKVEESKTEIDRSLEELEKTAR

SEQ ID NO: 24661 - protein, 57 aa, Artificial Sequence
  Synthetic
DEERRVKEELEKLLEDLRRTIKKVEEDSDRINKDLERVIRRSEREADKILEDLERAG

SEQ ID NO: 24662 - protein, 59 aa, Artificial Sequence
  Synthetic
EEKLRELLERAKKLVEDIKRRLKELLDRHRDLVRRIKERSKELNKRLKDLIDEIKERAR

SEQ ID NO: 24663 - protein, 56 aa, Artificial Sequence
  Synthetic
SSKDDLRRKIEKLLRDLERVIRESEKRSEEINRDLERTLKRIKEEADKILDKVRRG

SEQ ID NO: 24664 - protein, 59 aa, Artificial Sequence
  Synthetic
DRLLEKLLRELEKLIRRIEEESRKLNEEHEKLLKRIKDELKKLLDDLRRLAREIEERRR

SEQ ID NO: 24665 - protein, 57 aa, Artificial Sequence
  Synthetic
KSTEDAKREIDKLLEELEETIRRAEDRSRRLNEDLARTLKRIEEELKRINEEVEKRG

SEQ ID NO: 24666 - protein, 59 aa, Artificial Sequence
  Synthetic
DELLKKLLDELRELIDRIRRDLERLLREHEELIERIKRTLEELLRRHRELVKRIEETAR

SEQ ID NO: 24667 - protein, 57 aa, Artificial Sequence
  Synthetic
SEEDRLEEEIKRILDDVARVVKRIKEELKRINDELKKVIDESRDHARRVNDDVRRRG

SEQ ID NO: 24668 - protein, 59 aa, Artificial Sequence
  Synthetic
EELLKELLKRLEELARRIKKKLEELLREHEKLLEEIEKALRRSNEEHRKLVEKIKRDAT

SEQ ID NO: 24669 - protein, 57 aa, Artificial Sequence
  Synthetic
DEEERVKEAVERLLRDLERAIKESEDHLRRLNEDLDRVIRESKEHLKKVNDDVRRAG

SEQ ID NO: 24670 - protein, 59 aa, Artificial Sequence
  Synthetic
EELLKKLLEELKRLIERIKRDLKRTNDEHEKLIREIKKRLEDSNRDHERLVKDIKETAR

SEQ ID NO: 24671 - protein, 57 aa, Artificial Sequence
  Synthetic
SKEDRLREELKKLLKRLREEIERLKRALEESNKDLKRTIDRSEKHLRDVNEDVKRAG

SEQ ID NO: 24672 - protein, 59 aa, Artificial Sequence
  Synthetic
EEELDKLLKEARDLIREIEKRLEELLKRVEKLTEDAKRDLERSNREHKELADRIKETAR

SEQ ID NO: 24673 - protein, 56 aa, Artificial Sequence
  Synthetic
SEAERIEEEARRLLEELRRAIERVKEEADRLLEELRDAIRKSKEHLKRLNEDVERA

SEQ ID NO: 24674 - protein, 59 aa, Artificial Sequence
  Synthetic
EEALKRLLEKLKRLIEEIKRELKRLLDDLKRLIDEIAEALKRSNDRHEELVRRIKEKAR

SEQ ID NO: 24675 - protein, 57 aa, Artificial Sequence
  Synthetic
DSKEEIRRKIDELLKRLEETIRRSEEHFRRSLDDARKELKRSRDHVRKVNKELRDRG

SEQ ID NO: 24676 - protein, 59 aa, Artificial Sequence
  Synthetic
DEELERLLRDLERLIREIEKTLEDTNRSNEELVRRLKRRLEESNKRHEDLADEIRRRTD

SEQ ID NO: 24677 - protein, 57 aa, Artificial Sequence
  Synthetic
SEEDRIREEMEEILRRVERTVEEIKKELKKINDDVDRTARESEKHVREVLERVEREG

SEQ ID NO: 24678 - protein, 59 aa, Artificial Sequence
  Synthetic
EELLEKLLEDLKRVVEKIRRDAEDLLERHKDLVRRIKEELRRSNRKLEDLVKKISERAT

SEQ ID NO: 24679 - protein, 56 aa, Artificial Sequence
  Synthetic
DEDREVRRTLEELLDDLRRVIEESERHLEKLNEDVREAIRRSEEHVRRVLDRVRRG

SEQ ID NO: 24680 - protein, 59 aa, Artificial Sequence
  Synthetic
EDLLRKLLEEAKRVLDEIRKTLKKTNEDHERLVERIKRELEKSNKDLERLAKEIIDRDK

SEQ ID NO: 24681 - protein, 57 aa, Artificial Sequence
  Synthetic
SSKEDITKKIEELLRELEEELKKSEKHLRELNEEAKRTAEESRRHLEESLRKVEKDG

SEQ ID NO: 24682 - protein, 59 aa, Artificial Sequence
  Synthetic
DEELKKLLKELEDLVKEIKERLRKTNEEHRKLVEEIKERLKRSNESNERLVRRIEEEAR

SEQ ID NO: 24683 - protein, 57 aa, Artificial Sequence
  Synthetic
SELERAEEEIEKLNRDLKRTLDEIRDRIRKINDDLRKTLRKSDEDSKRLLKELRDEV

SEQ ID NO: 24684 - protein, 58 aa, Artificial Sequence
  Synthetic
EKLKDMLDKHRKLIDDLKRRLERRLREHKRLLDEIEKRLRDSLKRIEEIVREILERAR

SEQ ID NO: 24685 - protein, 57 aa, Artificial Sequence
  Synthetic
DELERIRRELERINTTLDELLKRSKEETDRILKKVEDSIREVEKKVKELLEELKRRV

SEQ ID NO: 24686 - protein, 58 aa, Artificial Sequence
  Synthetic
ELLKKILDEHRDLLRRIEEELRRSLEDIKRVAKEVEERIKKVLDELRRLIEELLRRAK

SEQ ID NO: 24687 - protein, 60 aa, Artificial Sequence
  Synthetic
SVLEEAEKELRKIVEDNRRTLREVKERNKKLNKENRDTIKKIEDDVRRIIRELKEDLKRS

SEQ ID NO: 24688 - protein, 59 aa, Artificial Sequence
  Synthetic
EEDLRRLEEEIRRRSEENKKRIRDLLRRSEELSRRDKKKLKEILERIKRLADEVREKIR

SEQ ID NO: 24689 - protein, 60 aa, Artificial Sequence
  Synthetic
SDLEDILRKIEDLSRKNEEELKRVLEENKKLSDDDKRRLEKILREVEKKIRKIKKDIKDE

SEQ ID NO: 24690 - protein, 58 aa, Artificial Sequence
  Synthetic
EEVRKLEEDVRRIIERNKKLTEDLARELKKLNDDNERTLRKVEEDIRRIIADLRRTLK

SEQ ID NO: 24691 - protein, 60 aa, Artificial Sequence
  Synthetic
SELDEILERLRRLSEENKRRIEEALRRNKKLSEDDERLSREIRRRVRELVEEAKEVLRRE

SEQ ID NO: 24692 - protein, 58 aa, Artificial Sequence
  Synthetic
EEVKRVAEELDKLVKENRRVTEKVARELKKLNDKNREVNERLERELDKIIKDLRRTDK

SEQ ID NO: 24693 - protein, 60 aa, Artificial Sequence
  Synthetic
SEIEKILEDVKKLADDLRRTLKRALEENKELSDRDKEELRRILEEIKKLAEEIDKLIKEE

SEQ ID NO: 24694 - protein, 58 aa, Artificial Sequence
  Synthetic
ERVREVARRIEKIIEDLRRDLERVRRELKKLNDDNRRVLEEVKRTVEEIIKRLRESAK

SEQ ID NO: 24695 - protein, 60 aa, Artificial Sequence
  Synthetic
DEVDELLKEAEEVIREVTREHKRLLDEARKISEENKKRSEESNREVRELVRRIKEEIKKG

SEQ ID NO: 24696 - protein, 59 aa, Artificial Sequence
  Synthetic
SEKAKRVEEELKKLLDKLSRITEEVERRLEELLKDNERVSRESDEELKRILEDVERDTR

SEQ ID NO: 24697 - protein, 60 aa, Artificial Sequence
  Synthetic
SEVEELLDRLRKLIEDVVREHKRLLDEVRRISRENEELIRRLLEKVEEVIRRIKERIKSG

SEQ ID NO: 24698 - protein, 59 aa, Artificial Sequence
  Synthetic
EKTAREAEEELRRLLERLSEVTRKVEKAIEDILRRNRETSERVAREIRRLLKELEDTAR

SEQ ID NO: 24699 - protein, 60 aa, Artificial Sequence
  Synthetic
SSVEELLERLRRISEENKRRIEKLLREVEKVLRELKDRHRKLLKRVEEIIRKVKEEIKSG

SEQ ID NO: 24700 - protein, 59 aa, Artificial Sequence
  Synthetic
RETAERARETLKRLLDENRDRSKKVKEEIRRILEDLTRTTERVKREIKKLLKELEDTAR

SEQ ID NO: 24701 - protein, 55 aa, Artificial Sequence
  Synthetic
DLLRKLLEEAKKILKEIKDAHEKLLRELEESNKELEKAHRKLLEDAKRMLDDLKR

SEQ ID NO: 24702 - protein, 59 aa, Artificial Sequence
  Synthetic
EDRVRDLRRALEELIKESDEVSRRLKEEIDRSLESSKKVSRDLEEELKKLIKDLEDTRR

SEQ ID NO: 24703 - protein, 55 aa, Artificial Sequence
  Synthetic
SELEKLLRDDRELLKELKKAHKKLLDELKESNDRVRKRHEELLRRIREIAKRLRD

SEQ ID NO: 24704 - protein, 59 aa, Artificial Sequence
  Synthetic
KDKVRRVERESKKTHDESREVSEKLRRDAEDSLRSSEKLSEDLERELRKLIKEVRDEAK

SEQ ID NO: 24705 - protein, 55 aa, Artificial Sequence
  Synthetic
KDIERLLEELKRILEDLKRKHKRLLERLEDSNRRIRRTLEELLKRLEKLVKDLSD

SEQ ID NO: 24706 - protein, 59 aa, Artificial Sequence
  Synthetic
KDKVDDAKRRLEELLKESREVSKKLRDDIERSIRSLREEVKKLDEDAKRLLDKVREEIR

SEQ ID NO: 24707 - protein, 55 aa, Artificial Sequence
  Synthetic
SVLEDLIRRDREMLKRAKEEHDRLRKEIERSNREIDEEVKRLLAEIKKIVEEVSK

SEQ ID NO: 24708 - protein, 59 aa, Artificial Sequence
  Synthetic
KKAVDEVRKESDDTHKESEAVSRDLKRELERSIKSLEKRIREAEEELKRILKELEDEKR

SEQ ID NO: 24709 - protein, 55 aa, Artificial Sequence
  Synthetic
EELERLLEEDKELVRRVERELERLLRELKRSNDEIKKTLEDLLRRIEEILKEIRR

SEQ ID NO: 24710 - protein, 59 aa, Artificial Sequence
  Synthetic
KEKVKRAEDRSRETHRRLEEVVKKLKEDAERSIKSLEELVDKLRKELRRLLEEVREEVR

SEQ ID NO: 24711 - protein, 55 aa, Artificial Sequence
  Synthetic
RELEELIKEDEDLLRRLAETLKKLLEDVRRSNEELRKFHEDLLRDLERLLEELRN

SEQ ID NO: 24712 - protein, 59 aa, Artificial Sequence
  Synthetic
KEKVRRVEERSRRTHKELEDLAREVDKELKKSIKSSRDVTRKVKEDADRLLKKVADDTK

SEQ ID NO: 24713 - protein, 55 aa, Artificial Sequence
  Synthetic
SILETLADRDRDMVRRVKEALKKLLERDKRALERLKRVHKELLDRLRKILEDLKR

SEQ ID NO: 24714 - protein, 59 aa, Artificial Sequence
  Synthetic
EEKVKRVEEESRRTHKELKDVADRVETESDKSHEESKKVTDEVRKELERLLRELEETVR

SEQ ID NO: 24715 - protein, 55 aa, Artificial Sequence
  Synthetic
SEAEKLLRELEDILKKLKDALKRLIEEDERLLKRLKREHEKLLKRLEEVLRELKK

SEQ ID NO: 24716 - protein, 59 aa, Artificial Sequence
  Synthetic
REKVKRVKDEADRLLKELEDVVREVKKRSDESHKRSRDVTREMKKELKRLLEELEKTVR

SEQ ID NO: 24717 - protein, 55 aa, Artificial Sequence
  Synthetic
SELERLLREDEEMVERVERVLKELEEEVRKALKRAKEMHRRLLERLKTILDELER

SEQ ID NO: 24718 - protein, 59 aa, Artificial Sequence
  Synthetic
KEKVKELERRSRKTHKELADKADTLRKRLEEVIKESEDVTEELERRLKKLIDDLRRSVT

SEQ ID NO: 24719 - protein, 55 aa, Artificial Sequence
  Synthetic
SELEKLLRELEELLKELKRVLEELIERDKRLLDRLKEVHERLLRRLEKLLKELKD

SEQ ID NO: 24720 - protein, 59 aa, Artificial Sequence
  Synthetic
EDKVREAKRELERLIEELRRAVRRVEDESRRSHEESKKVTDDLDKRARELLEELRETIR

SEQ ID NO: 24721 - protein, 60 aa, Artificial Sequence
  Synthetic
REVEELEKDVRRTLDELRKRHRDNNERIKKILRELEDLHRRNNERTKTLLARIRELRERG

SEQ ID NO: 24722 - protein, 55 aa, Artificial Sequence
  Synthetic
RELERKLKELVKDVEKVIEDDDRSADKLLTKVKRDADEDRKSNEKLVREVREELR

SEQ ID NO: 24723 - protein, 60 aa, Artificial Sequence
  Synthetic
SEAEEVLKRVEEVVERLKKLHDDNNKKLRDAVRRLKRLHTEHNKETKEIKKEIEDLIRKG

SEQ ID NO: 24724 - protein, 55 aa, Artificial Sequence
  Synthetic
REVEKRLKEVVKRIDEVAEEDERSIREILRELRKVIEDDERSNRKVAKEIRESAK

SEQ ID NO: 24725 - protein, 60 aa, Artificial Sequence
  Synthetic
DKVREVLERLKKLVEDLKRLHKRNNEEVRRVIEEIKDRSRRNNKRTEDILRDIEREIRRG

SEQ ID NO: 24726 - protein, 55 aa, Artificial Sequence
  Synthetic
ERIKEELKKLVEDVRRTAEDDRRTIEDLVRKVEEVLERDRKSNEEAARDVDRKLK

SEQ ID NO: 24727 - protein, 56 aa, Artificial Sequence
  Synthetic
RSVEEVKKELDDSDRRDREVVKEARRRLEESKDRLRKIIERAKEELDKSDERIKKN

SEQ ID NO: 24728 - protein, 59 aa, Artificial Sequence
  Synthetic
DEELKKLLKHNREVLEDSRRKIEELLRTNEKALEDVKRAIEELLKHNEEVLKEVDDRTR

SEQ ID NO: 24729 - protein, 56 aa, Artificial Sequence
  Synthetic
KEVEDAEKRLRDLLKEDRELIERLRRALEESLKEDRKVIKELREELDKSDRKVEED

SEQ ID NO: 24730 - protein, 59 aa, Artificial Sequence
  Synthetic
REDIKRLLEELEEVLRRSEKKLRELLDTNRKILEESKERLRRLLEHNKRVLRRVVEETR

SEQ ID NO: 24731 - protein, 56 aa, Artificial Sequence
  Synthetic
SDEERVEKELKKSDDEDKKLIDELTRRLRESLKRLEEEVRRAREELDKSDEEVRKA

SEQ ID NO: 24732 - protein, 59 aa, Artificial Sequence
  Synthetic
REDIERLLDHNRKVLEKSADDLRKLLKTNEEILRRVAKAIRDLLEHNRRVVEEVKERAR

SEQ ID NO: 24733 - protein, 56 aa, Artificial Sequence
  Synthetic
SEVEEAKRRLDESDKDDRRVIDKLRKELEKSREEAKRLIDRLREELKDSNREAEEA

SEQ ID NO: 24734 - protein, 59 aa, Artificial Sequence
  Synthetic
REDLRRLLEHNKEVLERSKKRLEELSETNKKFLEEVKDALRELLKTNREVLREVKERTK

SEQ ID NO: 24735 - protein, 56 aa, Artificial Sequence
  Synthetic
SSVERAKRELDKSLKEDRDTIRDLKRRLEESRKRDREVIEELKKILKKLLDEVKDS

SEQ ID NO: 24736 - protein, 59 aa, Artificial Sequence
  Synthetic
DDKIKKLLDHNRKVLEDSKEELRRLLETNKRILEESKKRLDRLAEEIEKVARTVKEEAR

SEQ ID NO: 24737 - protein, 56 aa, Artificial Sequence
  Synthetic
DEVERAEEELRKSDEEDRRVVKRATETLKKSKDELEREIKRLEDELERSNREVEER

SEQ ID NO: 24738 - protein, 59 aa, Artificial Sequence
  Synthetic
REEIKKLLDHNRRVLEESERRIRELLRTNREVLERVKKELDELLEHNRRVLEEVEKRVR

SEQ ID NO: 24739 - protein, 56 aa, Artificial Sequence
  Synthetic
SSVEKAKKRLDESDKTDRDVIKRLREELKKSEDTDRELVKKVKEEIEKVEEELRRR

SEQ ID NO: 24740 - protein, 59 aa, Artificial Sequence
  Synthetic
DDKIRRLLEHNEEVMKRSKERLDDLVRTNRKILEESKRKIEKLLKELREVVEEVDRRAR

SEQ ID NO: 24741 - protein, 56 aa, Artificial Sequence
  Synthetic
DKAERVREEIEKLERELRRVLKESREHTKKLEEDLERVLRRSREATKKLKEDLERN

SEQ ID NO: 24742 - protein, 58 aa, Artificial Sequence
  Synthetic
ELIKRMLEELKRLLEELEKRIRDSNAELEKLLRDLIRKLERSLREIKRVLEELKEEAR

SEQ ID NO: 24743 - protein, 60 aa, Artificial Sequence
  Synthetic
SEVETLMREIKKLIDDIKRKNEDSNREIREVSRKTEEDLRDLLRKAREVAEKLKDELRRR

SEQ ID NO: 24744 - protein, 59 aa, Artificial Sequence
  Synthetic
EEKVKRLEDSLERLKRDLRKIIKENEDELRKINRRNEELIKKAEEDLRRLSEDLKRAEK

SEQ ID NO: 24745 - protein, 57 aa, Artificial Sequence
  Synthetic
SELEEVLRRIEKLVRKAHKENEDVLREIERLVRTAHRLNKKVDDDSAKIAEDLKREK

SEQ ID NO: 24746 - protein, 58 aa, Artificial Sequence
  Synthetic
ERVRRLKEILERLKEEVRRSLEELRKEVERLKKEVEDSLRELKKSLEEWVKDLEEATR

SEQ ID NO: 24747 - protein, 57 aa, Artificial Sequence
  Synthetic
SDLEAVLDEIKKLAEEAHKRNEEVDKESAKLVKEAHKVNEDVDKESAEIVKRIDEEK

SEQ ID NO: 24748 - protein, 58 aa, Artificial Sequence
  Synthetic
ERVKRLKDELRRLLKEVKDSLEELDRMLEEWKERVRRSLEELRKRAKEWEDKLRESLR

SEQ ID NO: 24749 - protein, 57 aa, Artificial Sequence
  Synthetic
SELEDVLKKIRKLVRDAHEENKRVLEEIRKTVDEIRKELEDVDTKSAEIAERAKERK

SEQ ID NO: 24750 - protein, 58 aa, Artificial Sequence
  Synthetic
ERVERLRRELEKLVREVEESLKRLKEELDKIKEELRRILEELEEKLRRWSRELKETAR

SEQ ID NO: 24751 - protein, 58 aa, Artificial Sequence
  Synthetic
SELEKVVEDLRRIVEEIERRLREVIKEIRELVRRAHERNKDVDRKSAEIVKDIEEKKK

SEQ ID NO: 24752 - protein, 58 aa, Artificial Sequence
  Synthetic
ERVERLKRALDELERRLKELVRELEDSLKKLADEVKRSLEELDKSLKDWKKKLDDELK

SEQ ID NO: 24753 - protein, 57 aa, Artificial Sequence
  Synthetic
SEIERVLEEIKERVERADRKNEKVDRESAEKVKELHRRNEEVDRESAETVKRAERDK

SEQ ID NO: 24754 - protein, 58 aa, Artificial Sequence
  Synthetic
DKVREIRERVERLVKAVDESLERLERSLEEWARRLDKSLEDLKRSLKRWKEELDRKAQ

SEQ ID NO: 24755 - protein, 57 aa, Artificial Sequence
  Synthetic
SELETLIKEATDLAEEVKEDLRRVDEESAKLVEDADDENKRVDEESAKIVEDLKREK

SEQ ID NO: 24756 - protein, 58 aa, Artificial Sequence
  Synthetic
ERIRDLKEKVRRLMEDVKRLLEELERSLERWKEKVRDSLEKLKKSLEEWAKELKDTSK

SEQ ID NO: 24757 - protein, 57 aa, Artificial Sequence
  Synthetic
KDLETVLEEIKRIVDDLDRRNKEVDKESAKLVKEADEKNKRVDEESAKIVKRLEREK

SEQ ID NO: 24758 - protein, 58 aa, Artificial Sequence
  Synthetic
DRVRRLREEVTKLLDEVRRSLDRLRESLKEWKERVDDSLRRLRDSLRKWKRKLEEATR

SEQ ID NO: 24759 - protein, 57 aa, Artificial Sequence
  Synthetic
SELDDLLRRIRELVRRAEEDLKRVNEESARLVEEMDKDNKRVDEESAKIAEDLKREK

SEQ ID NO: 24760 - protein, 58 aa, Artificial Sequence
  Synthetic
KKIEELKREVKKIADELERILKELEDSLREWSERVRKSLEELKDSLRRWAEELKRDLK

SEQ ID NO: 24761 - protein, 57 aa, Artificial Sequence
  Synthetic
KDLERVVKEIERLVREAEKKIREVNDRSAKLARDLDRRNREVLKEIKKIAEDLEREK

SEQ ID NO: 24762 - protein, 58 aa, Artificial Sequence
  Synthetic
ERVERLKRELERLKRELEETLKRLDEELEKWEERVRESLKRLEDRVREILKRLEDDAR

SEQ ID NO: 24763 - protein, 57 aa, Artificial Sequence
  Synthetic
DELETVMKRIRELAKELNKKNKDVLDEIEDLVRKADKRNKEVLKRIEEILREARKRK

SEQ ID NO: 24764 - protein, 58 aa, Artificial Sequence
  Synthetic
ERVKRLKDELRRLIEEVRRNLKRLKEEVDKIRERVRRSLKKLKEDVKRLSDEVKETLK

SEQ ID NO: 24765 - protein, 60 aa, Artificial Sequence
  Synthetic
KEIEDLLRELRELVKEIDDLIKDATREIERLVKEVHDKNEKVTRRLEKLMRELREVARRG

SEQ ID NO: 24766 - protein, 58 aa, Artificial Sequence
  Synthetic
ERIETLERALRELVRELEEKVDEHRKRTDKVARDLKKSVDDHRRRTEELVRELRKTEE

SEQ ID NO: 24767 - protein, 60 aa, Artificial Sequence
  Synthetic
SELEDVLRRAKKLVEDVHRDNKRVTEELEKLARELHKKNEDVLRELKKLADDLREMLKRG

SEQ ID NO: 24768 - protein, 58 aa, Artificial Sequence
  Synthetic
EKVKRLEEEIRRLARELRESVRRHKERTEELVERLKESLKKLEEDIRRLEKELEDDRR

SEQ ID NO: 24769 - protein, 60 aa, Artificial Sequence
  Synthetic
SDLDDVLRRIRELAKRVHDENKRVTEELERLVEELEKKARELLRRIEELVRTLKEMRERG

SEQ ID NO: 24770 - protein, 58 aa, Artificial Sequence
  Synthetic
ERVERLRRELEKLVKELEESVRRHKKRTRELEERLKDVLRELEDAVRRLVEELEKTDE

SEQ ID NO: 24771 - protein, 60 aa, Artificial Sequence
  Synthetic
EEIERLLEEIKRLVETVHESNRRVLKELRDLAEELKRRNTKSNRDMERLVEELEEMRRRG

SEQ ID NO: 24772 - protein, 58 aa, Artificial Sequence
  Synthetic
EKVKTARDEVRRLVEELKESVERLARELKKLVDELRKVDEDNKRRLEELERRLRESTR

SEQ ID NO: 24773 - protein, 60 aa, Artificial Sequence
  Synthetic
SELEDVLRKLEKLAREVDKINKDLIKRVEELARELKKKNEKSNKEARDLVKKLKEMKDRG

SEQ ID NO: 24774 - protein, 58 aa, Artificial Sequence
  Synthetic
ERVRRLKKEVEELERRLRRSVDDLRRKIKELEDRLREIDERNKREIEKLVKELRDTDR

SEQ ID NO: 24775 - protein, 60 aa, Artificial Sequence
  Synthetic
DELETVAKLLEDLSRTNEDRLREVKETLKRLADTVDKINKEVLRRLRELAKRLKELKERG

SEQ ID NO: 24776 - protein, 58 aa, Artificial Sequence
  Synthetic
EDVRRLEEELRKLEERNRRLVRELEEVLKKLKDELKKSVDRLKEELDRLVKELDEIKK

SEQ ID NO: 24777 - protein, 60 aa, Artificial Sequence
  Synthetic
SEIEDALRKMEKLAEDVNRKNEEVIREVRRLSEENKKKLDDVLETLKKLVRELAEMTKRG

SEQ ID NO: 24778 - protein, 58 aa, Artificial Sequence
  Synthetic
ERIRTLEKAVRDLVRELEESVDRLRREADRLVEENERVVERLKRELKRLVEELERRAK

SEQ ID NO: 24779 - protein, 60 aa, Artificial Sequence
  Synthetic
DELREVLERVKRLVDTVNKINDDLTKRNEDLSRKNVDKIRRLTEEIERLVEEVDRARREG

SEQ ID NO: 24780 - protein, 58 aa, Artificial Sequence
  Synthetic
EDVRRLEEEVRKLVEELRRSVEDHKRRNKESVDRNRRAVEEHERRNREVVERLERKAK

SEQ ID NO: 24781 - protein, 60 aa, Artificial Sequence
  Synthetic
SDIEEALKTMEELSRRNEETLRRVLKRLKELADEVNRKNERVLEEAKELADRLRELRERG

SEQ ID NO: 24782 - protein, 58 aa, Artificial Sequence
  Synthetic
ERIKTLEEDLRRLVEENKKVVEELKRRLKKLVDELRESLKELEKAVRKLVKELRDDEK

SEQ ID NO: 24783 - protein, 57 aa, Artificial Sequence
  Synthetic
SSKETVAKRVEDVKRELEEVLKELARESKRLSDRDKKLNEEAAEEIERLKDELRKKV

SEQ ID NO: 24784 - protein, 59 aa, Artificial Sequence
  Synthetic
DEVLERIVKRVRDLVEEIKRRLEKLAEDNRRLSKRNEDVIRTLLEEARKLVEKVKEEVR

SEQ ID NO: 24785 - protein, 57 aa, Artificial Sequence
  Synthetic
RSKEEVAKEIKRLKEENKRLLDELAKRSEELERRDRRLNEEHHREIRRLTDELRKKV

SEQ ID NO: 24786 - protein, 59 aa, Artificial Sequence
  Synthetic
DRVLKEIVDEARRLSERNEEVLRRLLKENEDLSKRNEDFIRKTMKELRDLAEEVKERAK

SEQ ID NO: 24787 - protein, 57 aa, Artificial Sequence
  Synthetic
KSKEDVKREIERLKKENREVLDTARKRIEDLIREDERVNREAAEEIKRLVEELERRV

SEQ ID NO: 24788 - protein, 59 aa, Artificial Sequence
  Synthetic
DRVLKEIVEELRRLSEENKRRIERALEELEKLSKDNTDRIEEAREDLRRLVRELLEKEQ

SEQ ID NO: 24789 - protein, 57 aa, Artificial Sequence
  Synthetic
KDEEEVAKEIERLKEENDRVLKEAADKIEKLKKENREVNTRAAEEIERLKKELREKV

SEQ ID NO: 24790 - protein, 59 aa, Artificial Sequence
  Synthetic
SRVLEEVVRRLRKLSEENKKRIKEMLDDVERLSRRNEEKIRRVLEDARRLLEDLTRKAK

SEQ ID NO: 24791 - protein, 57 aa, Artificial Sequence
  Synthetic
SEKETVAEEIRRLIEKNKKMLEDHTRDIRRLEKENDDVNRKHHEDIRRLKDRLRKEV

SEQ ID NO: 24792 - protein, 59 aa, Artificial Sequence
  Synthetic
SRVLKEIVDEARELSKRNEDKIRKSLEELKRLSERNKKKIEDTLKELRKLAEEVKRRAT

SEQ ID NO: 24793 - protein, 57 aa, Artificial Sequence
  Synthetic
SEKERVADDIRKLEEENKEVLDRAAEEIKRLKKRDRELNKRHHKTIRDLVDELEKKV

SEQ ID NO: 24794 - protein, 59 aa, Artificial Sequence
  Synthetic
SRVLDEIVKEARDLSEENRKLIEEALERLRRLSRENEETIKKTMEELKRLVEEVKERAR

SEQ ID NO: 24795 - protein, 57 aa, Artificial Sequence
  Synthetic
KSKEEVADKIRKLKEENRKVLERHTREIEKLKRDDEEANKKHHEDVKEVMKRLEKEV

SEQ ID NO: 24796 - protein, 59 aa, Artificial Sequence
  Synthetic
DRVLEEIVREAEELSKRNKDRIDESLKELRKLSEDNKREIERTLEEIKRLAEEVRRRDT

SEQ ID NO: 24797 - protein, 57 aa, Artificial Sequence
  Synthetic
SSKERLKEMIDRLKERNKDLLRKAAEEIKRLEDEDREVNRRHHEEIERLKKELREKV

SEQ ID NO: 24798 - protein, 59 aa, Artificial Sequence
  Synthetic
DRALDEIIKEAKKLSDDNERLIRDVLRRARDLSRRNKETIRRTLEKLKREAEKVKEDAR

SEQ ID NO: 24799 - protein, 60 aa, Artificial Sequence
  Synthetic
SDADRIIEEARRLSEENKRRIEEVLKRNRKLSKENHDKNDELLKRVRELLRRVVERLRRE

SEQ ID NO: 24800 - protein, 59 aa, Artificial Sequence
  Synthetic
KDKLKRLEDEVRKLTDENRRVTEKAERDLRRSNRENDRSTERLEEEIRRIKKRLRDEAR

SEQ ID NO: 24801 - protein, 60 aa, Artificial Sequence
  Synthetic
REAEDLIRRLRELVRRHHELNRKLAEELRKLSEENKRKIEKVTREVEKLVKDVADTLKDD

SEQ ID NO: 24802 - protein, 59 aa, Artificial Sequence
  Synthetic
KDKLKRLEEELERLKEEVRKSNRDLEKEVRDLRKENEKVTEEVKKRIEDLKRKLDEDRR

SEQ ID NO: 24803 - protein, 60 aa, Artificial Sequence
  Synthetic
SEVDKIIKDARDLLKEHHEKNKRLIEENRRLSEENKDRIRRALEKLKKLVDDLRRLIEEV

SEQ ID NO: 24804 - protein, 59 aa, Artificial Sequence
  Synthetic
KKKLDELETEVRRIKETIDRSNERLERELEKSNRENKKVTDDAREVVKKLKEEIKRDED

SEQ ID NO: 24805 - protein, 60 aa, Artificial Sequence
  Synthetic
SEADEIIKEAKKLADDHHRLNKEIIERNKRLSEENHKLNEKIIEDVRRLVKDVAERLKRD

SEQ ID NO: 24806 - protein, 59 aa, Artificial Sequence
  Synthetic
KEKLDRLREKVEEIKRRVDKSNDELRRSMEESNKRNDESTDRLREELRRLDEELDRRRK

SEQ ID NO: 24807 - protein, 60 aa, Artificial Sequence
  Synthetic
SDLERVLKELRELVRRHHELNKDIIRRARRLSEENEKDIKKLLDDARKLLEEVKRTLDRM

SEQ ID NO: 24808 - protein, 59 aa, Artificial Sequence
  Synthetic
KKKLDEARTELRKLEEEVDKSNKELRDEVEKLERRNDELLERAREEVERLKEELRRKAT

SEQ ID NO: 24809 - protein, 60 aa, Artificial Sequence
  Synthetic
SKAERIIEEVRRLSEDNKRRIKKLLDEAKELLDRHHKRNKELLEEIERLLREVKERLKKD

SEQ ID NO: 24810 - protein, 59 aa, Artificial Sequence
  Synthetic
KDRLEELRRDLERLRKENKDVLDRVREDIKRLKEELDDSNRRLKDTIEDLKRELDEEAR

SEQ ID NO: 24811 - protein, 60 aa, Artificial Sequence
  Synthetic
SEVEELVKDLKRILDEIKRTNDELNKELKRLSDESRKLSKENIDRLRRILEEIEKTIRRR

SEQ ID NO: 24812 - protein, 59 aa, Artificial Sequence
  Synthetic
EEKVRKLEKLLEDIKRTVDKIIRESEKRAEEINRDNRRIIEENKKKLEEIARRVEELAR

SEQ ID NO: 24813 - protein, 60 aa, Artificial Sequence
  Synthetic
SSIEELAKRLEDLIRELRDRHRRLNEELKELTDRNRKEIEEANERIKRLIDDLERLRRRG

SEQ ID NO: 24814 - protein, 58 aa, Artificial Sequence
  Synthetic
EEIDKLRRELERLEEELKKVLDRTREELERLVRDNRRLNKEHKDHSDTLVRRLEESRK

SEQ ID NO: 24815 - protein, 60 aa, Artificial Sequence
  Synthetic
SEVEDLIRDLERLLKEHDELNKRSMEELEKLLKDLEKMVRDSLREAREIAERVKETIKRT

SEQ ID NO: 24816 - protein, 59 aa, Artificial Sequence
  Synthetic
EKKLDEARKVLEEIKKRLEDSLRRLREEAERIKRELKRILDEHRKEIERIKKEIDEAAR

SEQ ID NO: 24817 - protein, 60 aa, Artificial Sequence
  Synthetic
SEIEKVLRDVEKLVREHEDLNKKSAEEAERLTRDNKRRVDESKKRIREILKEVDEIIRRT

SEQ ID NO: 24818 - protein, 59 aa, Artificial Sequence
  Synthetic
DKDLRRLAEEAERIKKRLRDSLDELRKIIEELEERNRRINEDHRRDLEDVKRRIEEKSK

SEQ ID NO: 24819 - protein, 60 aa, Artificial Sequence
  Synthetic
SEIEEVARRAEKLTKENEELIRRSLRDIERLVKEMEDIVRKSLKEIKELVERLKDISRKT

SEQ ID NO: 24820 - protein, 59 aa, Artificial Sequence
  Synthetic
DEKLRRLAKRIEELKKRNEDLNREHRKRLEEAEKRLKDVLDEHRRRLEEVKKELDEEAK

SEQ ID NO: 24821 - protein, 60 aa, Artificial Sequence
  Synthetic
DEIERVLEEIKKLTDDNRKLVKESIDRAEELLKRHEEENKKSVERARKLVRDLDEIRRKT

SEQ ID NO: 24822 - protein, 59 aa, Artificial Sequence
  Synthetic
KKKLDELARRAEDMERDNKRINKEHRERIKEIKERIKESLDRLAEEIKKIEKELEDKAR

SEQ ID NO: 24823 - protein, 60 aa, Artificial Sequence
  Synthetic
SEIEKVLEDAKKLTKENEDLIRKSLEDNERLLRRHEEENKKSAEDMRDLLRRLEDIIRKT

SEQ ID NO: 24824 - protein, 59 aa, Artificial Sequence
  Synthetic
EELLERLAREIKKLIDKNRKLNEDHRRESEKSERRLRESLRKLAEEAERIEREMDKSRK

SEQ ID NO: 24825 - protein, 60 aa, Artificial Sequence
  Synthetic
SKIEKIVRDAERLLDELRKLAEDVLRRLEELNRRAEDVIRRLAEENTELLKRLEDLLETE

SEQ ID NO: 24826 - protein, 59 aa, Artificial Sequence
  Synthetic
KKKAEELKRKAEEIKRRIDKIVDEVRKAIRDSAEHLKRLLEEYRRRVEEVKKRVRDAAK

SEQ ID NO: 24827 - protein, 60 aa, Artificial Sequence
  Synthetic
DELERLREEVKRLSEENKELIKEMEKRNRELSKENEKVNRELKKRVDDIIRTLKELRKEG

SEQ ID NO: 24828 - protein, 62 aa, Artificial Sequence
  Synthetic
EKEEREIRRVLEDIKRIADENERENREALKRLEETNKRNTDHNRDVLREIDKLFREVAEELR

SEQ ID NO: 24829 - protein, 59 aa, Artificial Sequence
  Synthetic
SEKEEVIKRIREELKENEKENRDVIRKIRELLDELRRRVEEVLRRLKKSNEDIEREAEK

SEQ ID NO: 24830 - protein, 56 aa, Artificial Sequence
  Synthetic
EEELKERIKKLSKENKDRVRRMLERIKKLVDDLRRLLEELRRRNEKLLDRLRKAIK

SEQ ID NO: 24831 - protein, 59 aa, Artificial Sequence
  Synthetic
KDEEKVIEDIRRILEENHRENKEVIDKIRELLRRNEEENKEAIRRMRKSNKEITDRAEE

SEQ ID NO: 24832 - protein, 56 aa, Artificial Sequence
  Synthetic
REELERRVRELSKENKEMLKRVEDKIRELSERNKRTVKKVREDNERLIRRLEEEDK

SEQ ID NO: 24833 - protein, 59 aa, Artificial Sequence
  Synthetic
SELERIEEDVERLNRRNEETLKRIDEALKRLEKSNKELDEKLEETVKRIKDRVERVKRR

SEQ ID NO: 24834 - protein, 62 aa, Artificial Sequence
  Synthetic
DKAKREVDKVRTDAREILKENKRRNEDVIRKIEEKVRDLERRNRDLLRRVKTKIDRLREELK

SEQ ID NO: 24835 - protein, 56 aa, Artificial Sequence
  Synthetic
KELEDIARRVDELNKRNEELIKDAKRVLKEASDKNKEMNERVDDKLRRLAKKVKEL

SEQ ID NO: 24836 - protein, 62 aa, Artificial Sequence
  Synthetic
KEERDKIRDLLRRIREKIEKNRKDAEDVLREIKKLIDENKKRNEEVLKKIEELLRELEKRLE

SEQ ID NO: 24837 - protein, 61 aa, Artificial Sequence
  Synthetic
SRLEKVIKEIKKTHEELERRFKKNSDEAEESLKRLEDELRKVVTDIERKLRDLERRVREAG

SEQ ID NO: 24838 - protein, 59 aa, Artificial Sequence
  Synthetic
EELITRLKKHVDDTAREVEELIKRHTEHNEKLRRDIKKLLEELKRKVDELRKEIETRTR

SEQ ID NO: 24839 - protein, 62 aa, Artificial Sequence
  Synthetic
SELEELIKRAEDTIRRLEREIDELIERHRRSAERLRETLKELIDRHRKSIEDVMRELKRRRG

SEQ ID NO: 24840 - protein, 56 aa, Artificial Sequence
  Synthetic
KEEIERLIKELEKKIKEVVKRIRDIDEDLKRKAKKVVDDLRELNERLERKAKEATK

SEQ ID NO: 24841 - protein, 60 aa, Artificial Sequence
  Synthetic
SEEERLRDHSRRVEELARRAAEKLRRHSEDVKRLITELIKLIEDVMKKIEDEVRDAEKRG

SEQ ID NO: 24842 - protein, 61 aa, Artificial Sequence
  Synthetic
ELKKRIDELHKRNKDKLDEISERLKRLLEENRKLIKEVEERLRKLLEDLRKLIEDVKRRLR

SEQ ID NO: 24843 - protein, 60 aa, Artificial Sequence
  Synthetic
DFEEEIRRNLKRVRDLAKKLEDLIRKHSEEVKRLAEEVKREIEEVIKRAKKKMEDVRRDG

SEQ ID NO: 24844 - protein, 61 aa, Artificial Sequence
  Synthetic
ELKKRADRLLDEHREELKRIEDRLRELLERNNRLLEDIDRRLKELLEDLRRVLKEIEEELR

SEQ ID NO: 24845 - protein, 61 aa, Artificial Sequence
  Synthetic
SEVERLLEDLRRLAKESDESLKKSHRELRKRHEEVRRTIEELLKDLERTVKEIKEELERDV

SEQ ID NO: 24846 - protein, 60 aa, Artificial Sequence
  Synthetic
EEDVRREIKRVLDTIRKLNEDWKRRNEESKRRLDKLLDDAKKAIDKIVEDVKKLLEDARR

SEQ ID NO: 24847 - protein, 61 aa, Artificial Sequence
  Synthetic
SEVEKLLRDLERLARRVREELRKSHEKLDKLARDSKKSIEDLLEDLRRIIEEIEEELDRRV

SEQ ID NO: 24848 - protein, 60 aa, Artificial Sequence
  Synthetic
REDVEREVRRIKREIKELLDRWRRANEEIAREIRKLNEEVKRRVEKILRDLEELLRRLRK

SEQ ID NO: 24849 - protein, 61 aa, Artificial Sequence
  Synthetic
SELEKLEKELKDLLDKIRRDLEKSLKENDELVKKIEEDLKDLLKKLDDRLEKVARDLKREK

SEQ ID NO: 24850 - protein, 60 aa, Artificial Sequence
  Synthetic
RETATKRVKEVLDKLRKMLEDLRRHNEENKRRNKEVLDELRKKAEDVLRRIDEALKELKR

SEQ ID NO: 24851 - protein, 63 aa, Artificial Sequence
  Synthetic
SVEEMETRLKEVADDLKKKIDEVLTRLEKLNRELTKRSRDMNRELERLNKEAEDRARDVLKRV

SEQ ID NO: 24852 - protein, 59 aa, Artificial Sequence
  Synthetic
RDEARKLLRDLERLIEEIKKTLDELLKHHKEELDRIDREHEELLRHHKKTLERIEEKID

SEQ ID NO: 24853 - protein, 60 aa, Artificial Sequence
  Synthetic
DRVEKVLREIEKRLRDHRKRLKDALDEIRKRIEEHEEKSERLNRESKKLLKDLEDMKRRG

SEQ ID NO: 24854 - protein, 56 aa, Artificial Sequence
  Synthetic
EEVVRRARELVKRLEEDHRRMVEEIRRTIKRAEERHKKSVEDNEKLLRDLRDRLEK

SEQ ID NO: 24855 - protein, 60 aa, Artificial Sequence
  Synthetic
SEVEKVLEDLKRLLDEHEKRSRELNKRSKKLADEARRINEELLRELKKLLDELKELKDRG

SEQ ID NO: 24856 - protein, 56 aa, Artificial Sequence
  Synthetic
KKFLDDMRRLLEELKERHERSERENRKLLRKLEEDSKRTNDESKKLLDKLRDDLEK

SEQ ID NO: 24857 - protein, 60 aa, Artificial Sequence
  Synthetic
DRVEEVLKRVEELVKRHDERLKELEDDLRRLIEEHLEKSRRLNKESEKLLKEILEVKRRG

SEQ ID NO: 24858 - protein, 56 aa, Artificial Sequence
  Synthetic
EEVVKTIDEIVKELRKRHEEVRKRLKELLDEMRERHERSVRRNRERLEKLLDDLRK

SEQ ID NO: 24859 - protein, 60 aa, Artificial Sequence
  Synthetic
SEVERVLRDVERLLEEHRKKSKEANDTSRELARRHKEESDRLNKKSEDDARRLEDVKRRG

SEQ ID NO: 24860 - protein, 56 aa, Artificial Sequence
  Synthetic
EDMVRRIREIVKKLKRDHEKSVEDNRRLLRELEERHRESVERNEDLLRRLEERARK

SEQ ID NO: 24861 - protein, 60 aa, Artificial Sequence
  Synthetic
DEVETVLRDLKRLLDEHRRRSEELNKRSEELLREHEERSKRLNERSEKLARELREMKKRG

SEQ ID NO: 24862 - protein, 56 aa, Artificial Sequence
  Synthetic
EEFVKRMDELLRKLEEDHRRSVRENEKLLEELRRRHKKSVDDNRRLLEKLKRDADR

SEQ ID NO: 24863 - protein, 60 aa, Artificial Sequence
  Synthetic
DEVEEVLRRIEELLTRHRKKSDDLNRRSEELAERHERTNRTLLEELRDLAKKLEDLKREG

SEQ ID NO: 24864 - protein, 56 aa, Artificial Sequence
  Synthetic
EEVVKRMRDLVRRAKEEHKKSVDDNRRTLKELHDRSKKTNDDSRELLKRLEDRLRK

SEQ ID NO: 24865 - protein, 60 aa, Artificial Sequence
  Synthetic
REAEEVLERIRRRLEEHLEDNERILREIKKRLDEHREKSKRVNDRSRELVERLLAVKREG

SEQ ID NO: 24866 - protein, 56 aa, Artificial Sequence
  Synthetic
EDIVREIRRIVRELHERSKDSNREVERLVRKLEDDHRESVERNRELLKKLEDDLRR

SEQ ID NO: 24867 - protein, 56 aa, Artificial Sequence
  Synthetic
RLEDVLREVREDLRRLNEESRKVLEENDKLDKDLNRRLKRLEEEARTEIKKVKDRL

SEQ ID NO: 24868 - protein, 60 aa, Artificial Sequence
  Synthetic
EDELEKRLTEVRKELEDRYRELIERSKDIIRRLEEEVRKLEKELRKVLEDLDRRAREATR

SEQ ID NO: 24869 - protein, 59 aa, Artificial Sequence
  Synthetic
SEREDIKRLIEEIRKLVDEAAKEIERNIEEIRRLVKELEELSKKHIDEAREILERLKRR

SEQ ID NO: 24870 - protein, 55 aa, Artificial Sequence
  Synthetic
ELVEEMERDVREVERALRRLLDKHRRVLEDVERRLRRALEENRRVLEEIEEDSRR

SEQ ID NO: 24871 - protein, 58 aa, Artificial Sequence
  Synthetic
KDEEATKKLRKAHEDSERHIKKLSEDTKKVHEESDRHIRKVSKETEDEARRIEKELRK

SEQ ID NO: 24872 - protein, 56 aa, Artificial Sequence
  Synthetic
EDTLEKIIEENKRLNDELAKENKEVIKENRKLNRELEERNKEVIDRMERILEETKR

SEQ ID NO: 24873 - protein, 58 aa, Artificial Sequence
  Synthetic
REEELKREMEKAHEESERHLEELSRKTRDVHRRSEEHLKRLHERTKEVVDRIVEELRR

SEQ ID NO: 24874 - protein, 56 aa, Artificial Sequence
  Synthetic
EETLRRVIEKNRKLNEDIAKRNEEVIETNKKLNEEIARRNEEAIKTARKIVEDTKR

SEQ ID NO: 24875 - protein, 58 aa, Artificial Sequence
  Synthetic
REKEVVDRLREEVRRVEEEVDRLNKELEEIARKVERELDKINEDYKRRLDKVREDIKR

SEQ ID NO: 24876 - protein, 56 aa, Artificial Sequence
  Synthetic
EETVKRILETARELLDRWKKEVDEIVKTLEELLDRWRKEVERVKRENDKLLEELEK

SEQ ID NO: 24877 - protein, 59 aa, Artificial Sequence
  Synthetic
DEKKVLDDLRRIVEKVKRDLDELLKDNRRVLREVEEELKRLNEELRRIAEEVTRELRRL

SEQ ID NO: 24878 - protein, 56 aa, Artificial Sequence
  Synthetic
EKLAEEVARELRRLLREAEETSRDTKRKLREVLREWRELVKKIVDEMRRLLEEIKR

SEQ ID NO: 24879 - protein, 60 aa, Artificial Sequence
  Synthetic
DLERLVEEIKRRLRELLKELHKKSKEIEEEIRRILKRHHELLERIVRRLEELVEEVKRRN

SEQ ID NO: 24880 - protein, 56 aa, Artificial Sequence
  Synthetic
KKLLEDLEREIEKVKKAARDDLRRLEEIVRDVERRLRENVKRLKEEADRVKEELEK

SEQ ID NO: 24881 - protein, 60 aa, Artificial Sequence
  Synthetic
EELERIKDEIRRILEELKREMEELTKESDRILRELERENEESAKRIKEILDELEKRVRDK

SEQ ID NO: 24882 - protein, 59 aa, Artificial Sequence
  Synthetic
ETLLRRLRESLEKLAKEVEDLLRKYERDVRELAKEDRKLNEELLKRVDDLAKEVRERLR

SEQ ID NO: 24883 - protein, 61 aa, Artificial Sequence
  Synthetic
SKLEEIERELRELERSNEEEDRKWDDTTRKLEEDNREKNREWKKLTKDIRERVERLIRDLK

SEQ ID NO: 24884 - protein, 58 aa, Artificial Sequence
  Synthetic
EEARRLDEELEKVLRELKKRNEDTERRDREVNKKLEKENRDSEKENRDVLREIERALR

SEQ ID NO: 24885 - protein, 58 aa, Artificial Sequence
  Synthetic
KKLEDLEEEIKKLLEELKERNERSAREDREILERLRDENRRTAEELDKSVREILKKTG

SEQ ID NO: 24886 - protein, 59 aa, Artificial Sequence
  Synthetic
DRKLKEVRDTLEKLREENRKLNEEWRRKSEELRRRNEKVNKEVRDRNRETIERVDRKAK

SEQ ID NO: 24887 - protein, 61 aa, Artificial Sequence
  Synthetic
EELERADRRLDRLLEESERDLDTIIRKLKKVVEELERTLEEAKRKAERTLEEIRRELKEAG

SEQ ID NO: 24888 - protein, 60 aa, Artificial Sequence
  Synthetic
VEDLLREIKELLDDLRRHNEKLHRELEELIKTLRRHNEKLLEDIERLLRELRKEVEKLRR

SEQ ID NO: 24889 - protein, 60 aa, Artificial Sequence
  Synthetic
DELRELRRELRKLLEDIRRRLEELTRENRDVLRKSREELERLLRRLKELLDRIRDSLRKR

SEQ ID NO: 24890 - protein, 56 aa, Artificial Sequence
  Synthetic
KDKMKKLLRDLERKLKRAEEESKRHIRENEKLTEEAARKVEELLKEIKRKLEELEK

SEQ ID NO: 24891 - protein, 55 aa, Artificial Sequence
  Synthetic
SVEDTIRELEKRIRDLNREMERLNRESVEKIKRLNEKVRREIEDILREIKRLAEN

SEQ ID NO: 24892 - protein, 55 aa, Artificial Sequence
  Synthetic
ESLRRKLKKLADEHRETVDRMHEKNRKLADDHRDSVRKLEERIKRLTDRLREERK

SEQ ID NO: 24893 - protein, 56 aa, Artificial Sequence
  Synthetic
SEVEETLKRLEEVIREAEKTIDDSNREIEEAVRRIKTTIEKSNRDLKDLVEKLKRL

SEQ ID NO: 24894 - protein, 55 aa, Artificial Sequence
  Synthetic
EDVRRRVKEIIDKLERKIEESERNLKRIIEDLEREMRESEERVKEIIRDLERTEK

SEQ ID NO: 24895 - protein, 57 aa, Artificial Sequence
  Synthetic
SEIDEVLKRVEDSVREIERKLEEIERRLRRLNEEVKKRLDEIEEEIRRLVEELRRRN

SEQ ID NO: 24896 - protein, 59 aa, Artificial Sequence
  Synthetic
DDRLREIEKRIDDLNKKVRDEVERLKREADKSLETIKRLVEELKEKLDRLLEEVREEVR

SEQ ID NO: 24897 - protein, 59 aa, Artificial Sequence
  Synthetic
STRERLKKVLRDVERANKELSDRNKRVLEKLRRDVERLSRENEKLVRELEEAIKDLRRK

SEQ ID NO: 24898 - protein, 55 aa, Artificial Sequence
  Synthetic
EDLRREVEEVLKRIRDSNRDNRRKNEKVKKDIREILRRNEKRNREVNEKIRRDET

SEQ ID NO: 24899 - protein, 60 aa, Artificial Sequence
  Synthetic
KETEEVKDVLRRVRKRIEDLSKKNKDDLRRVEERNKELNERVKRLLEELKRRVDDLKRKG

SEQ ID NO: 24900 - protein, 58 aa, Artificial Sequence
  Synthetic
EDLERVEEDVRRVIKEIRDLARENHEENRDVIRRIRESNKRTEDEAREVLDRIRKTAT

SEQ ID NO: 24901 - protein, 56 aa, Artificial Sequence
  Synthetic
KEREEAEEMLKRLEEELRRLLEESEKIIERSERHLEKLLKDAEDEIRRVKEELDKI

SEQ ID NO: 24902 - protein, 59 aa, Artificial Sequence
  Synthetic
REEIRRLIERLRELLEEIARRIEKTNRELEELNKRLADDIKRLIDELERVLREVEERSR

SEQ ID NO: 24903 - protein, 56 aa, Artificial Sequence
  Synthetic
DEVETLLEEARKVLEELRKKIKELNEDSKRVLEELEKRIRDLDRRSTEVLRRLEES

SEQ ID NO: 24904 - protein, 55 aa, Artificial Sequence
  Synthetic
EELEDALRKIRKAVEELKKDVRRTLEEIKKEVKRLIEEARRSLDKIRRDVEKRDE

SEQ ID NO: 24905 - protein, 56 aa, Artificial Sequence
  Synthetic
EEVKRLVDDLREVTKENEKRARDLDRDSKRVSEENARKIETLNRDNERVNKELADS

SEQ ID NO: 24906 - protein, 55 aa, Artificial Sequence
  Synthetic
EKLDEDLERLERRNRKINEDAKTTLREIERENEELNKRLEETLRRSEKHLRDRRK

SEQ ID NO: 24907 - protein, 61 aa, Artificial Sequence
  Synthetic
REVEKLIKELEDLNRDHARKVKELIAELEKLLRDHAEKVRKLIEEARKTLEDLREIVERKG

SEQ ID NO: 24908 - protein, 55 aa, Artificial Sequence
  Synthetic
KDVREMIRRSEENLKRLNEEVKRAIRKVEEDLKELNKRARDVLEELRKRVEDTFR

SEQ ID NO: 24909 - protein, 57 aa, Artificial Sequence
  Synthetic
SEEEELEKRLRDSEREIEKWLRDLERVIEEVAREDKKIHEELEKILEDVKRELDKLG

SEQ ID NO: 24910 - protein, 59 aa, Artificial Sequence
  Synthetic
SKVVEKLVEDLRRINEEAKRRLERLKEELRKVLKDYKDEIDKLVEELKRTLDEVRKKAK

SEQ ID NO: 24911 - protein, 57 aa, Artificial Sequence
  Synthetic
DEEEDVRRTLEKVERDVERIDEDVERELRKVEEDDKRLHKELSEVVEKVERDIRRTG

SEQ ID NO: 24912 - protein, 59 aa, Artificial Sequence
  Synthetic
KKKLEELKERLKEALKRHEDKVRELKKELKKILDDYTEDVKRIKERLKRILEEIRRRKK

SEQ ID NO: 24913 - protein, 57 aa, Artificial Sequence
  Synthetic
SSEEDVKRELERVRREDERIHRDLERVLEESERRVETWDRDAKRTLEKVEEDLRRDG

SEQ ID NO: 24914 - protein, 59 aa, Artificial Sequence
  Synthetic
EELLEELKRRLKEILDRYRREAERLKRENEEMNKRHRERLEELKKRLKELLERMKEARK

SEQ ID NO: 24915 - protein, 57 aa, Artificial Sequence
  Synthetic
STEEDVRRVMKKVEDDVREINRDLERDLRRVEEAVERLDRDAKREIDRLREEIDREG

SEQ ID NO: 24916 - protein, 59 aa, Artificial Sequence
  Synthetic
EKFAEDLKRKLKKVLDEHRRRIEELKRELEEVLERHARELKRLKDELKKLVDDIRRRRK

SEQ ID NO: 24917 - protein, 57 aa, Artificial Sequence
  Synthetic
SDEEDVERELKRVKDEVDKINEDVRRELRKSEEDVERWDEDLERVVRRVEEEVRKTG

SEQ ID NO: 24918 - protein, 59 aa, Artificial Sequence
  Synthetic
KKVLEKLKKDLRDALKRHRDRVEKLKEENRKLNEDHKKTLEDIKEELKRLLDELKETRR

SEQ ID NO: 24919 - protein, 57 aa, Artificial Sequence
  Synthetic
SDEEDVERELERVKRDVERLDEDAKRVLDEVRKAVEEINRDVERDLRRVEEEIKKTG

SEQ ID NO: 24920 - protein, 59 aa, Artificial Sequence
  Synthetic
KEKLKELKERLKRLLDEHRRELKRLKDELKKALDDHKRKVDKLKKELKDILKKIRDDRR

SEQ ID NO: 24921 - protein, 57 aa, Artificial Sequence
  Synthetic
DDEDDVRRVLRRVAEEVRKLDEDLKRVLKESKERVKRWNDDAKRRLDKVREDLKRKG

SEQ ID NO: 24922 - protein, 59 aa, Artificial Sequence
  Synthetic
KKVLEELKKRLEDLLKRHEEEVRRLKEENKKLNDDHRRELERLKKELTDLLKRLDDERK

SEQ ID NO: 24923 - protein, 57 aa, Artificial Sequence
  Synthetic
SLEEDVKRVIDRVREAVKKINDEVEKELRKSEKAVEDWNRRLEEIHDRARRELEKAG

SEQ ID NO: 24924 - protein, 59 aa, Artificial Sequence
  Synthetic
KDKLEELKRRLKRLLDEHRKRVEELKEENKRLNKEHEKKVEDNVRRVRELLKRVEDRRR

SEQ ID NO: 24925 - protein, 60 aa, Artificial Sequence
  Synthetic
SEVEEIVKKLEELLRRWEKTVRDIVEELKRLLEEIEKLSRETKERLKKILEDVKRLAEEG

SEQ ID NO: 24926 - protein, 55 aa, Artificial Sequence
  Synthetic
DELEDIARRVKEELDRLNEELERIARKVKEDLKRLLEDNKRVLDEVKERLDRIRK

SEQ ID NO: 24927 - protein, 59 aa, Artificial Sequence
  Synthetic
SEIEDIVRRLEELLERWKRRVDKAKERNKRLLEKWAKEVEDIKRELEKLLEDVRRLKEE

SEQ ID NO: 24928 - protein, 55 aa, Artificial Sequence
  Synthetic
DELEKIVEDVERELDKINEDYNRVLKRVEEELDRLNEDLNRVAKRVKDALRKIEE

SEQ ID NO: 24929 - protein, 59 aa, Artificial Sequence
  Synthetic
SEIEKVVEEAKKLLKRWEDEVRKHDKELKEVLDRWKKEVDDIKRRLEELLREVRRLKEE

SEQ ID NO: 24930 - protein, 55 aa, Artificial Sequence
  Synthetic
DELRKIVEDVERELDRLNDENRDSLRRVVEALEEINKDLNRDVKRVKDELDKTRK

SEQ ID NO: 24931 - protein, 59 aa, Artificial Sequence
  Synthetic
SEVEEIKKELKKLDEENKRVIDRIVREIERLNEENERVARKVIKEIEELLRKLEKLRRD

SEQ ID NO: 24932 - protein, 55 aa, Artificial Sequence
  Synthetic
EDLRRVLKESEDRNRKLLEDLERKVRDVKRRDDELLKRAREALKRVKDEIEKIRK

SEQ ID NO: 24933 - protein, 59 aa, Artificial Sequence
  Synthetic
SEVEDIIRRIKELDDRNERKVRELVKTNEKLLRDLHEKSKRIVKEMRELLKEIEDLARR

SEQ ID NO: 24934 - protein, 55 aa, Artificial Sequence
  Synthetic
EELKRVIDESKKRNEKLMRDYEEISKKVHEDVERDAERLRRIAKEVEEELERVRK

SEQ ID NO: 24935 - protein, 59 aa, Artificial Sequence
  Synthetic
SEVEKIKEDLKRLLDEVRKKAEELKRENRELLRRLHELSKKIIRELEKLLEELADLVRK

SEQ ID NO: 24936 - protein, 55 aa, Artificial Sequence
  Synthetic
EDLERTIREVEKELRRLLEDYRRESKKVHEDIDEDRRRLEDAVREVEKEIEKVRR

SEQ ID NO: 24937 - protein, 60 aa, Artificial Sequence
  Synthetic
SEVERIKEDIKKSNEDIRRTAEEIKERIKKSNKEVEDEVREIKERIKRILDKLKRVKEEG

SEQ ID NO: 24938 - protein, 59 aa, Artificial Sequence
  Synthetic
KSVVDDLERVMKESEERVKRIIDDLERTLRESEKNLKRIIDDLERVMREAREAIDRLKK

SEQ ID NO: 24939 - protein, 60 aa, Artificial Sequence
  Synthetic
SEDDELRRRLEELKRRIEDLIRKLREVLKRSEDELRKILRELREVDKDLRRRIEELIKDI

SEQ ID NO: 24940 - protein, 56 aa, Artificial Sequence
  Synthetic
EDEAKKRLEEILRRAEELLERLKRTNERVNRKVREDMKRAKEHAKRLLEEAEELAR

SEQ ID NO: 24941 - protein, 57 aa, Artificial Sequence
  Synthetic
DEVEELIKEVEKVNEDAARESEKRNRELKKMLERVKRENKRLIRELKELLDDARRKN

SEQ ID NO: 24942 - protein, 59 aa, Artificial Sequence
  Synthetic
REVLKKLEEVLRESKKRLKEWNDRNKKTLDDIRREIEKSKKEHEDALRRIEEELKKTET

SEQ ID NO: 24943 - protein, 57 aa, Artificial Sequence
  Synthetic
SELEKLVKELRDLNEKVARDSKRLNDKLEEVLDRLRRRNEELIKRLEEVLEDVERKN

SEQ ID NO: 24944 - protein, 59 aa, Artificial Sequence
  Synthetic
KELLDRLRKMLKESRDSLRKLNKENEETLRRIKKKLDESKRKHEEVLKDIKRRLEELSR

SEQ ID NO: 24945 - protein, 57 aa, Artificial Sequence
  Synthetic
DEVERIIERLRRVNKRVREENERLIKEIEDLITEIAKRSRDLNRELDKTLKDVRRKN

SEQ ID NO: 24946 - protein, 59 aa, Artificial Sequence
  Synthetic
EEVLRRLEKVLRESRKSLEDSAKKHKDVLDEVKKTLKKLNDENREVLKRIKKELDKTRT

SEQ ID NO: 24947 - protein, 56 aa, Artificial Sequence
  Synthetic
SEVEKLIEDMKKVAKELADESEEHIKRAEEVIDRLAKEVEKHDRDVEDTIRRLEES

SEQ ID NO: 24948 - protein, 59 aa, Artificial Sequence
  Synthetic
EEVKKRLREMLEELRRRLERLKDKNKEVLDRLEEKLRKLEKENDDSLKEAEDKLRERER

SEQ ID NO: 24949 - protein, 56 aa, Artificial Sequence
  Synthetic
SEVEKLIEDIERIIRTLAEEVRRHDEDARRVLEDLARKVRKHNEDVKKVLEDLRES

SEQ ID NO: 24950 - protein, 59 aa, Artificial Sequence
  Synthetic
EEMKERLRRMLKRAEDELRRLEEENDRVVERLERELRRLTEDNKRTLKKIEEDLRRREK

SEQ ID NO: 24951 - protein, 56 aa, Artificial Sequence
  Synthetic
DEVRDLIRRLEETVKRLADEVREHDKRARDILRELKKEVKETNRRSEKVADDLEKS

SEQ ID NO: 24952 - protein, 59 aa, Artificial Sequence
  Synthetic
EEVKERLKKVLEKLKRDLEKLKEDNRRVLKELEEELRKIKEELDKSLDDLRKRLEDRKK

SEQ ID NO: 24953 - protein, 60 aa, Artificial Sequence
  Synthetic
SLEEKFRRVLEESKESLERLKRKVEKVLRESEERLKRWLDKVKKVLEEVDDALRRLKDRL

SEQ ID NO: 24954 - protein, 59 aa, Artificial Sequence
  Synthetic
KEIVERLIEELKKLNKELADRLEEIIRRLEEINERLRERIERIITRLRRLLEELEREAE

SEQ ID NO: 24955 - protein, 60 aa, Artificial Sequence
  Synthetic
SEDEDLKRVLDEAEKRLKDLLDDLRRALKRSEDELRKNNEDLERVLKRVEERLKELLDRV

SEQ ID NO: 24956 - protein, 59 aa, Artificial Sequence
  Synthetic
REIVEEIKKRIRDLLRELEKKIEELKTTSERLNREHHKKIEDIKKEIEDLVRELEKKVK

SEQ ID NO: 24957 - protein, 60 aa, Artificial Sequence
  Synthetic
SLREKLEEVLRRIEEALERIREEVEKVLRDSRDDNRRVLKELKELLERVREALEDLLRKV

SEQ ID NO: 24958 - protein, 59 aa, Artificial Sequence
  Synthetic
DKIVKEIIEELEKLLRDIKKRARELIEESKRINEDNNRRAEEVAEEIRRLLEELERKLR

SEQ ID NO: 24959 - protein, 60 aa, Artificial Sequence
  Synthetic
SLEEDVKRVLREAEEELKKNNERLRKVIEDSKRDNDRVLDELRKVLEDIEKALRDLLREV

SEQ ID NO: 24960 - protein, 59 aa, Artificial Sequence
  Synthetic
DKIVDEVRKEIEKLVRDHHKRIKDLKDDLKRLNDENNKRAKEIIDEMKRLLEEIEKRVR

SEQ ID NO: 24961 - protein, 61 aa, Artificial Sequence
  Synthetic
KDVEDIKRRIEELNKKLKEKIERIKKRIKELNEEAAKKVEEIKERLKRLLDEIRELVRRDG

SEQ ID NO: 24962 - protein, 59 aa, Artificial Sequence
  Synthetic
DSLRKRLEEVLRESKKTAEDLKRDLRRALEESKKNLKRLLDEVRKVIDEIRKALEELER

SEQ ID NO: 24963 - protein, 61 aa, Artificial Sequence
  Synthetic
SEVEKIKKDIKDLNDDARRRLEEIKRRLEKLLKELEEKHRELKKELKKLLDEVRDLVRREG

SEQ ID NO: 24964 - protein, 59 aa, Artificial Sequence
  Synthetic
DRLREDAERVLRESKKNLDELEKDVRRVIKRIEDEARRLNEDLKRMLERIKRELEKLEK

SEQ ID NO: 24965 - protein, 60 aa, Artificial Sequence
  Synthetic
SEEERLEEVLKRVETELRRLKRELEKVLRESEEALREIIKKIEDAVRDNAEKVKKLSRTV

SEQ ID NO: 24966 - protein, 55 aa, Artificial Sequence
  Synthetic
RRVEKELEDLLRTATKVLEDLKRDLKRLNEETEEVVKTLEDSHRRSNEEVERRVR

SEQ ID NO: 24967 - protein, 60 aa, Artificial Sequence
  Synthetic
REREELEEVLERSKRELERLVEEIKRALDESRRRLEEIEKRIEEVIRRNKEEIKKLSRRV

SEQ ID NO: 24968 - protein, 55 aa, Artificial Sequence
  Synthetic
EKLKEELKELNRESRKVVEDLREKLDRLNKDTERVVRELEKEHRKSNEEVRKTVK

SEQ ID NO: 24969 - protein, 61 aa, Artificial Sequence
  Synthetic
DEEEELKEDIKRILEELRRLAKEHEELNRRINKELEDLVREHKKRLEDALKRLREIVRDRG

SEQ ID NO: 24970 - protein, 55 aa, Artificial Sequence
  Synthetic
EELEKVLKEAEDDVERIKKRLKRINDESRKHVERLKEELDRADKRIEDEVEKLKK

SEQ ID NO: 24971 - protein, 61 aa, Artificial Sequence
  Synthetic
RIEERLKRVVDKVDDTLRKSEKHLEDVVRDADRDIDRNRRENEKVVKEAEDILRRLVEEAG

SEQ ID NO: 24972 - protein, 59 aa, Artificial Sequence
  Synthetic
EDKVRELEEEAERLLDELRRKNEEAVRRIKKLLDDLNKHSEETIRRIKKLLKELEDKTR

SEQ ID NO: 24973 - protein, 57 aa, Artificial Sequence
  Synthetic
STEEKLKELKKEADKLLKELDKELRDNLRRLRKIVEELKKENRDLTRESEEVLKRLN

SEQ ID NO: 24974 - protein, 59 aa, Artificial Sequence
  Synthetic
DKDVKKLIEEIRRILEKAREEVERLSRDSKRVAEELRKRHKELIDRNKRVLEELKRRRD

SEQ ID NO: 24975 - protein, 60 aa, Artificial Sequence
  Synthetic
SEVEEVARRSRKLNDDLKKIIEELIRRSRKINDELRREIERLIRESRKLNRELEELKRRG

SEQ ID NO: 24976 - protein, 56 aa, Artificial Sequence
  Synthetic
EDKVRRLNEENKESLRRLERELEKLNKENEDSLRTLEELLRELNKENKRSLDELRK

SEQ ID NO: 24977 - protein, 56 aa, Artificial Sequence
  Synthetic
SLVEEVEERVKKLHDENRELDRKSKRDVEEVHKKNEKLIKDVERTVREMIRKLREL

SEQ ID NO: 24978 - protein, 56 aa, Artificial Sequence
  Synthetic
EEELRRLEEELRRSIKESREELRRLEDELRRSIEKLEDALRRLAKELDEVIKDLKD

SEQ ID NO: 24979 - protein, 56 aa, Artificial Sequence
  Synthetic
SLVDEVRRRVDELHKDNKRLDDESEKKVRDAHRENERLDDESRRKVKEAIRKLEEL

SEQ ID NO: 24980 - protein, 56 aa, Artificial Sequence
  Synthetic
KESLDRLAEKLKKSIKESEDILRELEKRLRDSIRESRKILEDLRRELEEVIKRLED

SEQ ID NO: 24981 - protein, 56 aa, Artificial Sequence
  Synthetic
SLAEEVEKRVRDLHRKNEELDRESEKKVRDMDRKNKELIKRAEEEVKKVIDKLRKL

SEQ ID NO: 24982 - protein, 56 aa, Artificial Sequence
  Synthetic
EEKLRELARRLKESIRESRERLRRLEKELEDSIRELRRAIDTLTKRLEKAIEELER

SEQ ID NO: 24983 - protein, 56 aa, Artificial Sequence
  Synthetic
SLVEEVERRVRKLHEENKKLDKESEDKVREANRRNEELIKKVTESVRRMIEKLRRL

SEQ ID NO: 24984 - protein, 56 aa, Artificial Sequence
  Synthetic
EEELRRLADELRRSIEESERILKKLEEELRRSIEELRRALEELDEELKRVIRELER

SEQ ID NO: 24985 - protein, 56 aa, Artificial Sequence
  Synthetic
SLVEEVKKRVDDLHKRNRELDDRSEKMVRKANEENKELDKKSKEDVDRLIERAERL

SEQ ID NO: 24986 - protein, 56 aa, Artificial Sequence
  Synthetic
EEELRRLAEKLKRSIEESREILKELERRLRESIRRSREILKRLKEELERAIERLRR

SEQ ID NO: 24987 - protein, 56 aa, Artificial Sequence
  Synthetic
SLAEEVEKLVRDLHRKNKELDRRSKKTVEDIEREARELDKRSKEEVERMIKKLREL

SEQ ID NO: 24988 - protein, 56 aa, Artificial Sequence
  Synthetic
EDKLRELEKELRDSIRESREILERLERRLEELIRRSKRILEELERELEEVIRELRR

SEQ ID NO: 24989 - protein, 56 aa, Artificial Sequence
  Synthetic
SLDDDVEKKVRELDKRNEDLDRKSEKEVEKVHRKNKRLDDESEKEVKRMIEELKKL

SEQ ID NO: 24990 - protein, 56 aa, Artificial Sequence
  Synthetic
EEELRRLAEELRESIERSRERLKELERRLRESIARSREILEELERRLKRAIEDLER

SEQ ID NO: 24991 - protein, 56 aa, Artificial Sequence
  Synthetic
SLAEDVEEKVKELNRRNKKLDDESKEMVKRAHDRNRELDERSKDRVRRVIEKLRRL

SEQ ID NO: 24992 - protein, 56 aa, Artificial Sequence
  Synthetic
KEKLEELAERLRKSIEESRDILRRLEKELRDSIKRSEEILKELTDRLRKVIKDLRD

SEQ ID NO: 24993 - protein, 56 aa, Artificial Sequence
  Synthetic
SLVEEAERRVRELIKELERLDDRSREMVKEMHERNRELIERVEKRVREVIEELRRL

SEQ ID NO: 24994 - protein, 56 aa, Artificial Sequence
  Synthetic
EDDLRKLAEDLKRVLKRSRDILRKLEEDLRRSIRELEEALRKLEEDLRRAIEELET

SEQ ID NO: 24995 - protein, 56 aa, Artificial Sequence
  Synthetic
SLKDDVEKKVEDLKKEAKDLDRESDKKVKTAHKRNEELDRKSADDVRKLIRKLEKL

SEQ ID NO: 24996 - protein, 56 aa, Artificial Sequence
  Synthetic
EEELKRLAEELERLIRDSRRILEELKRELKRSIEESRKILEDLERELEKVIRELKR

SEQ ID NO: 24997 - protein, 56 aa, Artificial Sequence
  Synthetic
SLAEEVERDVKRLDEENKRLDDRSRREVEKMDEENKKLIEDARREVREMIEKLKKL

SEQ ID NO: 24998 - protein, 56 aa, Artificial Sequence
  Synthetic
DEKLKELAKRLRDSLERSKEELKKLEEELRKSIKELEDALKKLEEDLRDVIRKLEE

SEQ ID NO: 24999 - protein, 56 aa, Artificial Sequence
  Synthetic
SLVEDVERKVRELDKRNRDLDRKSKRKVEEADKENRKLDEDSERKVRELERKATEL

SEQ ID NO: 25000 - protein, 56 aa, Artificial Sequence
  Synthetic
EESLRRLEEELRKSIKESKEILDELRKELEKSIRESKERLKELEKRLEELIRELKR

SEQ ID NO: 25001 - protein, 56 aa, Artificial Sequence
  Synthetic
KLVEDAEELVRRLDEENKRLDDDSKRRVEEANRENEKLIKEIEDEVRKMIKKLRDL

SEQ ID NO: 25002 - protein, 56 aa, Artificial Sequence
  Synthetic
EEELRKLAKRLKDSIDRSRKILEELERELRRSIDELRRALEELTDELRKVIEELRK

SEQ ID NO: 25003 - protein, 56 aa, Artificial Sequence
  Synthetic
SLAEEVEKEVKKLDEENRKLDRDSTETVKELNKKNERLDRESKRKVDEVIEKLERL

SEQ ID NO: 25004 - protein, 56 aa, Artificial Sequence
  Synthetic
KEKLDELADELKKSLDRSRRILERLEEELRRSIRRSEDILRRLKEELERVIRELRR

SEQ ID NO: 25005 - protein, 59 aa, Artificial Sequence
  Synthetic
SVDEEVEKLLKEHEERIRELIKEVEKLNREHAKRIEELIRKLKETNKRIADKIRDLKRQ

SEQ ID NO: 25006 - protein, 56 aa, Artificial Sequence
  Synthetic
EEKLRTIARRIKELNDRFKRAIDESRKHIEELNRRLEKVVEDSRRHLEELADEVRR

SEQ ID NO: 25007 - protein, 59 aa, Artificial Sequence
  Synthetic
SVLEELKRLLDEHRERLERLIRELRKLNEDHDRRIKELIERLKKLNEDIAKRIEDLKRD

SEQ ID NO: 25008 - protein, 56 aa, Artificial Sequence
  Synthetic
EDVLRKIEEDIKRLNREVEKAIRESEENIKRTNKRFKDELRKSEKHLEELVKRFRD

SEQ ID NO: 25009 - protein, 59 aa, Artificial Sequence
  Synthetic
SVLEEVTKLLKDHEDRIREIIKRLRKLNRDIDERIKRLIDEVRKKNDDIRRKIEELKRR

SEQ ID NO: 25010 - protein, 56 aa, Artificial Sequence
  Synthetic
EERLKRLREELEKLNRDVERVIKESKENLDRTVTEAKRELKRSEDNLERLAREFER

SEQ ID NO: 25011 - protein, 59 aa, Artificial Sequence
  Synthetic
TEEEILRRVERDLERLNRELERIVREVEKELKKINDDYERVLKKVKDDIDRIREELDRQ

SEQ ID NO: 25012 - protein, 56 aa, Artificial Sequence
  Synthetic
DKELEELLKRWEEDVKRIVEEVKKLLDEWRERVKRAKDENEKLLRDLEKLVEDLAR

SEQ ID NO: 25013 - protein, 59 aa, Artificial Sequence
  Synthetic
SKEDVLREVKRELKRLLDDNRRMLEEVEEAARRLNKDYNDVLKEVEEEIEKIIRELEKK

SEQ ID NO: 25014 - protein, 56 aa, Artificial Sequence
  Synthetic
EEDLKRLLDEVRRLSEKTKEDLERILRKWKEDVERAKERNRRELERLEREIKELAR

SEQ ID NO: 25015 - protein, 57 aa, Artificial Sequence
  Synthetic
ELDKIVEEVRKALREILEDYKRFSKEIHDRDKELADRLREILKDVKRAVDELIKKLS

SEQ ID NO: 25016 - protein, 60 aa, Artificial Sequence
  Synthetic
VEDVVRKLRELLERFRKKAEDLKEENKRINEENERKIREIVKTLRKLLDELREKLERTKK

SEQ ID NO: 25017 - protein, 57 aa, Artificial Sequence
  Synthetic
SLEDTLRKVDKDLKDNMRRLEETAEKVRRDIDRDEERLRRISEELHRRIEELIKRLS

SEQ ID NO: 25018 - protein, 60 aa, Artificial Sequence
  Synthetic
VEDVVRDAKRLLDEHHDLARKIVEDLRRLLEDLHRKSKKSVEDNERLLKRMEEILRETER

SEQ ID NO: 25019 - protein, 56 aa, Artificial Sequence
  Synthetic
SELEEVARRVEKLLEKHKEDLKRLLEKSEEDLRRAEEEVKRLLEEIREELDRLRKR

SEQ ID NO: 25020 - protein, 55 aa, Artificial Sequence
  Synthetic
EEIKKVRKKVEDVHEESKRLNEENRRRTKEVSDKIREIIKEIRKEIKKASDELEK

SEQ ID NO: 25021 - protein, 56 aa, Artificial Sequence
  Synthetic
DELERAVEEVEKRLREHLERIKRLLEESRELLKRHEKLLEDVLRRIRELLKRAEDR

SEQ ID NO: 25022 - protein, 55 aa, Artificial Sequence
  Synthetic
ELIKRVKERVKEAHKRSRELNERNRRETEKMHKKSRDLLRKIREEVDRMSDKLRK

SEQ ID NO: 25023 - protein, 56 aa, Artificial Sequence
  Synthetic
SEEELLRELEKKLRELRRKVDETLRDLRRRLKELEEDHRRTLEESERHLREVEKKL

SEQ ID NO: 25024 - protein, 55 aa, Artificial Sequence
  Synthetic
EKLDRRVEELIKEIEELLREVEKLVEDLIRTIKKLNDDLREDNKRLAKEMEDRAR

SEQ ID NO: 25025 - protein, 61 aa, Artificial Sequence
  Synthetic
SAVEDLEREVRKLIRDLEDLIRRLEERNKRIAEEIEKLNEELNRENKRIADEIRRIKDERG

SEQ ID NO: 25026 - protein, 56 aa, Artificial Sequence
  Synthetic
EEALERLKRELRKLAEELKKVLKRSRDHLKEVKRRHDENIKRSDDHLKRVADEARK

SEQ ID NO: 25027 - protein, 61 aa, Artificial Sequence
  Synthetic
SVAEELEKDIRRIEEEIKELLERHRELNERIVREIEDLNRKLNEMNKRVVEELRKVKRDRG

SEQ ID NO: 25028 - protein, 56 aa, Artificial Sequence
  Synthetic
DRVLKKLEKRLRELEEEAKKLLKESKEHVDEVRKRHEENIRRSEEHLRRVLEELRR

SEQ ID NO: 25029 - protein, 60 aa, Artificial Sequence
  Synthetic
SVVEELERRIEEIAREIEELNERHNRKNKEIADRIRDLNRRLNEANKKIVREIEEIKRRD

SEQ ID NO: 25030 - protein, 56 aa, Artificial Sequence
  Synthetic
SRVLDKLRKELDDLRRRHEENVDRSRKHLEEVRKEHEENIKRSERHLEEVKKEAER

SEQ ID NO: 25031 - protein, 61 aa, Artificial Sequence
  Synthetic
SVVETLEKRVRELIETLERLIERLDRENKRVAEEIKRLLDEHDKTNKEIVERIRDIKRREG

SEQ ID NO: 25032 - protein, 56 aa, Artificial Sequence
  Synthetic
SRVLRKLEEELRKLEEKLRKLLKDSEDHLREVLERAKRVLDDSRRHVDEVRREAEE

SEQ ID NO: 25033 - protein, 61 aa, Artificial Sequence
  Synthetic
SVMEDLERRIREIIKEIEKLLEDLKRENRRVAEEIERLNREHNELNKRIAEEIERIKRRRG

SEQ ID NO: 25034 - protein, 56 aa, Artificial Sequence
  Synthetic
SRVLKKIEDELKKLEDKAREVLKRSRDHLKKVEDDHRENVRRSEEHVKDVLRRFEE

SEQ ID NO: 25035 - protein, 61 aa, Artificial Sequence
  Synthetic
KVLEDLDRDIKRIIDEIRRLNEELNREIEEIKRRIKRLNEEHNERNKRLAEEARRIKDERG

SEQ ID NO: 25036 - protein, 56 aa, Artificial Sequence
  Synthetic
DEVLKRLEEKLERLREEHERNAREIRKELEKLEKEHRENVERSRRHVERVEREFET

SEQ ID NO: 25037 - protein, 61 aa, Artificial Sequence
  Synthetic
SVVERLKEIAEEIIRRIEELNKEHNKRNREIAETIERLNREHNELNKTLVREMKEIKRDKG

SEQ ID NO: 25038 - protein, 56 aa, Artificial Sequence
  Synthetic
SEVLKKIEEDLRRLLRKHEENSKESEKHVEEVEERHRRNAEDSKRHVEKVKEEVDR

SEQ ID NO: 25039 - protein, 59 aa, Artificial Sequence
  Synthetic
STEEVLKEIRDRLEELKREAKKVNDDTRERLKELEERNRRANEESKRRLEELERRVEER

SEQ ID NO: 25040 - protein, 59 aa, Artificial Sequence
  Synthetic
ERLLRELRRKLKEVEDTIRELNERLRKRIREIEEEVRESNERLRKKLREILEEIKETEK

SEQ ID NO: 25041 - protein, 59 aa, Artificial Sequence
  Synthetic
SVVEEIDKIIKRIADRVRKIIEDLERLNKEIADLLRRIIEELKRLNDRIREEVDRLRRR

SEQ ID NO: 25042 - protein, 56 aa, Artificial Sequence
  Synthetic
EKVLEDVERKLERLKREVRRVLEESRKRLKEWKDRAREVLEESKRSLEEISRRLRE

SEQ ID NO: 25043 - protein, 59 aa, Artificial Sequence
  Synthetic
SADETLRKVVEEVARKSEKLNKELEKVNKDLARAVEELIEELKDVITKIEERAKRLKDR

SEQ ID NO: 25044 - protein, 56 aa, Artificial Sequence
  Synthetic
ERVLEEIRERIERLNKRNKEVLDRSEESLRRLAEKLRRVIERVEEKLRKIEEDLKT

SEQ ID NO: 25045 - protein, 61 aa, Artificial Sequence
  Synthetic
DKEDAIRTAEKRIRDSERENEKVDEDYRRELKRSEDKNEKADKEYKRRIEELVRRLLETRG

SEQ ID NO: 25046 - protein, 56 aa, Artificial Sequence
  Synthetic
EDTLRKLVDDIEERNRRIIEELKRHLDKLREDNERVIEELKRHLEEVAREVERRRK

SEQ ID NO: 25047 - protein, 56 aa, Artificial Sequence
  Synthetic
SEKEEAEKLLREHHEKIKRLKEESKRINDENRKRIEELKRRSREINKELEEKVRRN

SEQ ID NO: 25048 - protein, 56 aa, Artificial Sequence
  Synthetic
EDTVKRIEDELKKNLDDLRRVLEKSKDDNRKLLEDLERELRESKKDARRLLEEVRK

SEQ ID NO: 25049 - protein, 56 aa, Artificial Sequence
  Synthetic
SKEEELEKLLREHHEKIKRLKEESKRINDRIRRTVEELIKESEKINRDINDTVRKN

SEQ ID NO: 25050 - protein, 56 aa, Artificial Sequence
  Synthetic
EDSVERIKRELERNLDDLRRVLKESEDDLREILRRLKEVLEESERDLERVEREVRK

SEQ ID NO: 25051 - protein, 59 aa, Artificial Sequence
  Synthetic
SELEELLERLERLIEENRRELEELIRELKEESDRTREELKRLIDRLKEKIDRVLKLKED

SEQ ID NO: 25052 - protein, 56 aa, Artificial Sequence
  Synthetic
KDVLKEARERLRKLHEETKEAKKDLDRILDENEKEVKEVKKRLEDLLKELRDRLRK

SEQ ID NO: 25053 - protein, 57 aa, Artificial Sequence
  Synthetic
SELEEVLKRIREEAERLMRRNEETLRRVKKTIEDLLRRNEKRLEDVKREADEIEKRK

SEQ ID NO: 25054 - protein, 55 aa, Artificial Sequence
  Synthetic
ERVKEEIERIEKRVREVHEEVNKRIEDLRREYRKEHKRVEDEIRRILREVREKRR

SEQ ID NO: 25055 - protein, 56 aa, Artificial Sequence
  Synthetic
SEKEEVKKESEKLSRDTKKRSDEVHKEIKRLTDETERELREVEKEIERLAEELRRQ

SEQ ID NO: 25056 - protein, 59 aa, Artificial Sequence
  Synthetic
EKVLEDELRENKKENKDLKERHDRTLEEVERTNRKVKEELRRVLRRVEESVREVAERAT

SEQ ID NO: 25057 - protein, 61 aa, Artificial Sequence
  Synthetic
SKEETIEKRVEELKRENDEKVERIKREIEDLIRRNKELLERIKKEVRELLKELKDRAEKKG

SEQ ID NO: 25058 - protein, 60 aa, Artificial Sequence
  Synthetic
DRELDKALEDIERRIREHNKELDDELRKVREDSRRHLEKLKRELEEIREEARRITEELKK

SEQ ID NO: 25059 - protein, 60 aa, Artificial Sequence
  Synthetic
EEKELLDKLKEDADRIKKELEDTLRELKKKHDDVNDRNRKHHEEVRRRAEKIKDKLRRDK

SEQ ID NO: 25060 - protein, 55 aa, Artificial Sequence
  Synthetic
EEVRKRLDDLEREIKKIIDEIDERHRRLTEENKRSLDRDREELEKLKEEIKRTAD

SEQ ID NO: 25061 - protein, 58 aa, Artificial Sequence
  Synthetic
DEAEKIKEDAKRLIEENDEIVRRIEEEMKKSHKENREILKKIKEDVDRSHEDLRRRSG

SEQ ID NO: 25062 - protein, 56 aa, Artificial Sequence
  Synthetic
EEVLKDLRRRSEEHKKKLEDDLRRHEKKSRDHKEKLKELLERHKRRVEEVRKRETK

SEQ ID NO: 25063 - protein, 60 aa, Artificial Sequence
  Synthetic
SREELMEELERLLERLIREIEKASRENEERVKELKREIEESTKRNKETAKKLLDELTRSN

SEQ ID NO: 25064 - protein, 55 aa, Artificial Sequence
  Synthetic
DELRKTLEDIRRRVEEAKERHRRILKTIKERSEKLTREHRKVNEDIEEKLRRAKK

SEQ ID NO: 25065 - protein, 61 aa, Artificial Sequence
  Synthetic
SERETVERVLDRLREELEKIKKELEDVNRESKKEVERLLRRNEELHKKVEKDARDILRKKG

SEQ ID NO: 25066 - protein, 55 aa, Artificial Sequence
  Synthetic
EELKKTLDKILEDAKEEVREDRKRNEKLNRELEERSRRNEEDLRRLLKKLKDEAD

SEQ ID NO: 25067 - protein, 60 aa, Artificial Sequence
  Synthetic
DEKETIEERRKEIEKIIKDLEKNVRDHEKRIEEIIKEIRDNTEKLKKEAEDLLRRIRKEG

SEQ ID NO: 25068 - protein, 55 aa, Artificial Sequence
  Synthetic
RELEETLRRLDERTKKVIKEAEDVHRRLRERLRKIEKEHEDTLRELKKRLDDEAR

SEQ ID NO: 25069 - protein, 61 aa, Artificial Sequence
  Synthetic
SAEDRLREADERYERELRRLKRELEEVIKEYRKAIEELKKELEDVLRRFREELKRLEEEKG

SEQ ID NO: 25070 - protein, 58 aa, Artificial Sequence
  Synthetic
EEVREIIERLKESLKRNEEDVRRLIRRLKEELKRNKEEVERLKKELEDILRELADRAR

SEQ ID NO: 25071 - protein, 61 aa, Artificial Sequence
  Synthetic
DAERELKKVEDEYEKRIRDLERDLRRVLEEYERAIEELKKELDDVLREAEKALEDLLRKKG

SEQ ID NO: 25072 - protein, 59 aa, Artificial Sequence
  Synthetic
GEEVKEIKKELEESLKRNEDKVRELKRRLEELLKENEKKVRELIRRLEEELRRLAERTR

SEQ ID NO: 25073 - protein, 61 aa, Artificial Sequence
  Synthetic
SAEEELKKVDDDYEREIRRLEKELEDVLRDVDRDHRRLEEELKKVIRDIEEALKDLLRKKG

SEQ ID NO: 25074 - protein, 58 aa, Artificial Sequence
  Synthetic
EEVREIKERLRKSLEDNERKVKEIIDRIREDLKENRDRVRKLIKDLDDELKELAKKAK

SEQ ID NO: 25075 - protein, 60 aa, Artificial Sequence
  Synthetic
DEEREIEERIKRILEDLKRNLEDNERKIRKIVKDNRENNKRNEDKIRRILEELKRAKEEG

SEQ ID NO: 25076 - protein, 55 aa, Artificial Sequence
  Synthetic
ERVRKLEKDLEKALEEIRRRYEELLKRLKRENEESKKTYDKLIEELRRAAREIKR

SEQ ID NO: 25077 - protein, 60 aa, Artificial Sequence
  Synthetic
DEKERIEEEIRRILRELEELTERNEKKIRDIVREIRKNSEENRRKIEKILEELEELKKEG

SEQ ID NO: 25078 - protein, 55 aa, Artificial Sequence
  Synthetic
EEVEELLRRLRKRLEDLERRNKELLEELKERLERAEKRNRDLLKELEDALERIRK

SEQ ID NO: 25079 - protein, 60 aa, Artificial Sequence
  Synthetic
DEEEEIEKKLRKNIRDAEEKTKRNKERAEDNLRKARENSKRNEEDIRRKLKRLKELKEEG

SEQ ID NO: 25080 - protein, 55 aa, Artificial Sequence
  Synthetic
ERVDRLKKELERMHRKLDKENRDIEKRVREEHRRLTERNRKLLEDLEEALERIRT

SEQ ID NO: 25081 - protein, 60 aa, Artificial Sequence
  Synthetic
SEEEEIERRLRDNIRKAEENTRRNKEKIDRILEEMRENSKENKRRIEEILDELRKLKEEG

SEQ ID NO: 25082 - protein, 55 aa, Artificial Sequence
  Synthetic
ERVDELKEKVERDHERLRKENEDLLRELRKRLDELRRENEKLLRELEEALDRIRK

SEQ ID NO: 25083 - protein, 60 aa, Artificial Sequence
  Synthetic
SELERVREEIRRLERENEETLREVEEKIRKLLEENREALERVEERVRRVKEELKEVRRRQ

SEQ ID NO: 25084 - protein, 59 aa, Artificial Sequence
  Synthetic
DDVRRDIERLDEEYERRHKDVNRKLKRLDDEYEKATRDVRRRLEELTKELRDEAEKVRK

SEQ ID NO: 25085 - protein, 56 aa, Artificial Sequence
  Synthetic
SERERVDRLEERYEEESRRVEEELRRLLKRYEDFHRELRKRLEDIVREVRKTLKEL

SEQ ID NO: 25086 - protein, 56 aa, Artificial Sequence
  Synthetic
TREIEKRVERLLEENEERLRRVRKEIKKALDENREILKEVEDRARKILEELRRKAK

SEQ ID NO: 25087 - protein, 59 aa, Artificial Sequence
  Synthetic
SELEEVKRRVEEIKKKLKEDLDDHKRRNEKHIKELEDRLEEHRREIEELVRKLEELKRR

SEQ ID NO: 25088 - protein, 59 aa, Artificial Sequence
  Synthetic
EEVRKALKELEDDLRRVLEEIKRAHKKSKEDNKRVLDDLTEKHKRSEEELRDVLRDLER

SEQ ID NO: 25089 - protein, 60 aa, Artificial Sequence
  Synthetic
SSLEELEKRNRERIEELERTLRELEERSRELNERLKRELDEHKKRIDELLEELRRLKEEN

SEQ ID NO: 25090 - protein, 59 aa, Artificial Sequence
  Synthetic
EEVRRALEELEKSHDEVRERIKRRLDESKERNKRALEKIKRDHEESEERLRRALDRTRK

SEQ ID NO: 25091 - protein, 60 aa, Artificial Sequence
  Synthetic
SSLEEVKKENEKLIKELKEELDKIRKENEEHIEKLERELERVKREAEKIKKKLEELKREN

SEQ ID NO: 25092 - protein, 59 aa, Artificial Sequence
  Synthetic
KEVKDALEELKRSHRKVAKEIKEAVKESRKKNEEVAKKIKKALDELKRELDEALKEAKR

SEQ ID NO: 25093 - protein, 60 aa, Artificial Sequence
  Synthetic
DEVETLEERVRRLKKELRDELKRNEDKVRKLKRELEESLKENAKKVEEVERDLERVKREG

SEQ ID NO: 25094 - protein, 59 aa, Artificial Sequence
  Synthetic
DEVRREIERLKRELERVIREYREAIERLKRDLKRAIDKYREDIKRLEEKLRRVDKELEK

SEQ ID NO: 25095 - protein, 59 aa, Artificial Sequence
  Synthetic
SEVERVREENKRSEEKLKKLLEDSRRNLEENRKRLEELLRKSEENLERLKRELDELRKQ

SEQ ID NO: 25096 - protein, 55 aa, Artificial Sequence
  Synthetic
EDLRRNRETNEELRDRVRRTHEKLEREAEKVHEDVRRRHKELEDEVREVLKELRR

SEQ ID NO: 25097 - protein, 56 aa, Artificial Sequence
  Synthetic
SDEELIKRIREELERLLKELRDTIKEVEDRNRESLEDLDRVHKRIKEEIERLEKDL

SEQ ID NO: 25098 - protein, 60 aa, Artificial Sequence
  Synthetic
SEELAKKLKDELRRAKDKVEEIKKRIRDTLEDNRKKAEELKRKNEEDLRRFEKKAEDVRK

SEQ ID NO: 25099 - protein, 56 aa, Artificial Sequence
  Synthetic
SKEDKAREDVKRTIEELKDRNRKLNDKIRKTIEDLERRNEELNKENKDLVDELRDG

SEQ ID NO: 25100 - protein, 56 aa, Artificial Sequence
  Synthetic
EEVLRELREEIEKLEKEHRDNVRKLERDLDRLRKKHEDNKERLERHTRRVEEEKRR

SEQ ID NO: 25101 - protein, 60 aa, Artificial Sequence
  Synthetic
STEEDVRKIVDDARRNLEENKRRIEKIVKELEDKLRENEKKIRKILEDIRRLLEKFKRDD

SEQ ID NO: 25102 - protein, 56 aa, Artificial Sequence
  Synthetic
EDIMRDLRRRLERIAREYKRLLDELKKRLDDIKKTYEDLLRRLREEIERAEEKARR

SEQ ID NO: 25103 - protein, 60 aa, Artificial Sequence
  Synthetic
DEEEEVRKILEEIKKELDDNERRIRKNIRDAEETLRENEKRIRDILKEIEDLLKELKDRD

SEQ ID NO: 25104 - protein, 56 aa, Artificial Sequence
  Synthetic
EDILEKLRRDIERADEEYKRLEEELRRKHDEIRKTYEKLLKELEEAIERVEREAEK

SEQ ID NO: 25105 - protein, 55 aa, Artificial Sequence
  Synthetic
SSKDLLEELRRTVEEVRKRSDDLSRESEEATRRVRKEHDRINKEVEDELRRVRED

SEQ ID NO: 25106 - protein, 56 aa, Artificial Sequence
  Synthetic
EDIVREMRKRLEELLRENEKRNEELLRRLKELLDRSRERVREIEERLRELLEEVRR

SEQ ID NO: 25107 - protein, 57 aa, Artificial Sequence
  Synthetic
DAEKLKRDYEEKSRRVKETLDDLVRRYREEHRRVNEELRKLLEDLKKTVEDVEKEEG

SEQ ID NO: 25108 - protein, 60 aa, Artificial Sequence
  Synthetic
SERLEREIRKLEEENKRTLERVKEKIERLLEENEKVLKEVRDKVKTIKDRLRKLVEEIRR

SEQ ID NO: 25109 - protein, 60 aa, Artificial Sequence
  Synthetic
SVEDEVRKIKRRLEEALERSEKKVRDMVRRNKEFLERAKRRVEEVVKENERALEEVKRRG

SEQ ID NO: 25110 - protein, 56 aa, Artificial Sequence
  Synthetic
EEILRRVRKTVKDVEDTLKELNDRLEKIHREVKKELDRLLKELDDRHRKVAEDLKK

SEQ ID NO: 25111 - protein, 59 aa, Artificial Sequence
  Synthetic
SVEELLRKLEEVLRKIREENERSLKELRDRAREIVKRNRETNRELEEVIKELEKRLSGA

SEQ ID NO: 25112 - protein, 59 aa, Artificial Sequence; identical to SEQ ID NO: 14436
  Synthetic

SEQ ID NO: 25113 - protein, 57 aa, Artificial Sequence
  Synthetic
DEVEKVLEEIKRALDDLRKKVEESKREIKEALKAVEKHTRDSDTANKRTLAEIERGV

SEQ ID NO: 25114 - protein, 55 aa, Artificial Sequence
  Synthetic
ERVVEEVRRVLEELRRRLEKVTEDSRRAIERLAREDARVSKKSIDVNKKLDDDVR

SEQ ID NO: 25115 - protein, 60 aa, Artificial Sequence
  Synthetic
DAEELVRELEERIKRSHERLEELLREVKRLIERSHEELKRLNEEVLRELDRVLDEVAKRG

SEQ ID NO: 25116 - protein, 55 aa, Artificial Sequence
  Synthetic
KDSARELERIVKENAELAERVFREVEKIVRENTKLAEDSVRELKRLVEELKKRAK

SEQ ID NO: 25117 - protein, 58 aa, Artificial Sequence
  Synthetic
SAADEVVERMKELVATVKRENDEVVKELKKLVKELEDDNRRVVEESKKSVEDLARRVG

SEQ ID NO: 25118 - protein, 56 aa, Artificial Sequence
  Synthetic
EDLVREVEKRVRDIVEESRKLAEETRKAVEDIIEKSKRIAEDTLEKNKEMVERLER

SEQ ID NO: 25119 - protein, 55 aa, Artificial Sequence
  Synthetic
SESDEVIRDLARLLDELARHVDDSVRRMDEVVKRSTREADELAKRLDELVKEVEK

SEQ ID NO: 25120 - protein, 56 aa, Artificial Sequence; identical to SEQ ID NO: 15500
  Synthetic

SEQ ID NO: 25121 - protein, 55 aa, Artificial Sequence; identical to SEQ ID NO: 25119
  Synthetic

SEQ ID NO: 25122 - protein, 56 aa, Artificial Sequence; identical to SEQ ID NO: 15500
  Synthetic

SEQ ID NO: 25123 - protein, 55 aa, Artificial Sequence
  Synthetic
SESDDVIRKLRELLEELRTHVEKSIRDLRKILEDSTRHAKRSIEELERLLEEVRK

SEQ ID NO: 25124 - protein, 56 aa, Artificial Sequence; identical to SEQ ID NO: 15502
  Synthetic

SEQ ID NO: 25125 - protein, 55 aa, Artificial Sequence; identical to SEQ ID NO: 25123
  Synthetic

SEQ ID NO: 25126 - protein, 56 aa, Artificial Sequence; identical to SEQ ID NO: 15502
  Synthetic

SEQ ID NO: 25127 - protein, 60 aa, Artificial Sequence
  Synthetic
DREREVKKRLDEVRERIERLLRRVEEESRRVAEEIRRLIEEVRRRNKKVTEEIRELLKGL

SEQ ID NO: 25128 - protein, 55 aa, Artificial Sequence
  Synthetic
EELREELKKLERKIEKVAKEIHDHDKEVTERLEDLLRRITEHARKSDREIEETAR

SEQ ID NO: 25129 - protein, 60 aa, Artificial Sequence; identical to SEQ ID NO: 25127
  Synthetic

SEQ ID NO: 25130 - protein, 55 aa, Artificial Sequence; identical to SEQ ID NO: 25128
  Synthetic

SEQ ID NO: 25131 - protein, 57 aa, Artificial Sequence
  Synthetic
SEVDEAVKNNEEDAKESRRVVEEAVKRDEDIARDIERAAREVVERDKEIVDEVRRGV

SEQ ID NO: 25132 - protein, 60 aa, Artificial Sequence
  Synthetic
SKETKDLLDENSKRSNEISREVKKDLERTVRENKKIVDEVAKALEDTVDKNRRIVEEVTT

SEQ ID NO: 25133 - protein, 60 aa, Artificial Sequence
  Synthetic
SEAEELLKRLEDRAEEILRRLEEILRTSRKLAEDVLRELEKLLRESERRIREVLEELRGI

SEQ ID NO: 25134 - protein, 59 aa, Artificial Sequence
  Synthetic
KEVVDEIKRIVDEVRERLKRIVDENAKIVEDARRALEKIVKENEEILRRLKKELRELRK

SEQ ID NO: 25135 - protein, 57 aa, Artificial Sequence
  Synthetic
SRAETVLKEVTDKIKKLADSSDELLRRNKENIDELKKSSEELLRRLTKAIEEIEKGS

SEQ ID NO: 25136 - protein, 56 aa, Artificial Sequence; identical to SEQ ID NO: 16914
  Synthetic

SEQ ID NO: 25137 - protein, 57 aa, Artificial Sequence; identical to SEQ ID NO: 25135
  Synthetic

SEQ ID NO: 25138 - protein, 56 aa, Artificial Sequence; identical to SEQ ID NO: 16914
  Synthetic

SEQ ID NO: 25139 - protein, 57 aa, Artificial Sequence
  Synthetic
DEVRELLERNRRLLEEIKKTVKDLIRANEELLKRIEDDAKRLIDRNEELLDELEKGL

SEQ ID NO: 25140 - protein, 59 aa, Artificial Sequence
  Synthetic
SEELEELRRVVEESDETIKRLLEEAKESVDRSLDRIRKLLEDVRRSVERSAKRIDEKRK

SEQ ID NO: 25141 - protein, 60 aa, Artificial Sequence
  Synthetic
STEEVLDEIRKLHKTLTEDIKRVLREIEELHRRTIEENKEVLDKIAEDYKRVIDDVRTKD

SEQ ID NO: 25142 - protein, 56 aa, Artificial Sequence; identical to SEQ ID NO: 18130
  Synthetic

SEQ ID NO: 25143 - protein, 60 aa, Artificial Sequence; identical to SEQ ID NO: 19323
  Synthetic

SEQ ID NO: 25144 - protein, 62 aa, Artificial Sequence
  Synthetic
EDSERLVREVEDLVRRLVRRSEKSNEEVKRTVEELVRRMEESNDRVRDLVRRLVEELKRAVD

SEQ ID NO: 25145 - protein, 59 aa, Artificial Sequence
  Synthetic
SEAEKAKETIDRLADRVRKLLEEIKRSLDDSRRKSKETVEENEKTLDRMRKEVDAAKRG

SEQ ID NO: 25146 - protein, 56 aa, Artificial Sequence; identical to SEQ ID NO: 19650
  Synthetic

SEQ ID NO: 25147 - protein, 59 aa, Artificial Sequence; identical to SEQ ID NO: 25145
  Synthetic

SEQ ID NO: 25148 - protein, 56 aa, Artificial Sequence; identical to SEQ ID NO: 19650
  Synthetic

SEQ ID NO: 25149 - protein, 56 aa, Artificial Sequence
  Synthetic
SEVEELIKRLAKVLKELVDKVRKVIEDTKELLERLKRRSEDHIRKLREVLKEAKDQ

SEQ ID NO: 25150 - protein, 59 aa, Artificial Sequence
  Synthetic
EELDRRIEKVLKEIEEKIREVIKEWERVHREVEELLKRLIDENRKVLDEIRKLLEEKSK

SEQ ID NO: 25151 - protein, 56 aa, Artificial Sequence; identical to SEQ ID NO: 25149
  Synthetic

SEQ ID NO: 25152 - protein, 59 aa, Artificial Sequence; identical to SEQ ID NO: 25150
  Synthetic

SEQ ID NO: 25153 - protein, 59 aa, Artificial Sequence; identical to SEQ ID NO: 19801
  Synthetic

SEQ ID NO: 25154 - protein, 59 aa, Artificial Sequence
  Synthetic
DKALEEAKRVLAENNEVIKDIKRALDELLKELEKSVRESEERLRRLLEEVKRVIEEVAT

SEQ ID NO: 25155 - protein, 59 aa, Artificial Sequence
  Synthetic
SEAERLEARARELLRANEELMDDLRAKAEELLKRNDRLVKEIEKKVREVLAAIEELKRR

SEQ ID NO: 25156 - protein, 59 aa, Artificial Sequence
  Synthetic
KRLEELLRRLNEEHKRISDELRKLLDEALEAHRELSRRLEEELERLLREIERLVEEVTR

SEQ ID NO: 25157 - protein, 56 aa, Artificial Sequence
  Synthetic
SVDEVLKEIEDALRRLKEEVERVLKENEDELRRLEEEVRRVLKEDEELLESLKRGV

SEQ ID NO: 25158 - protein, 59 aa, Artificial Sequence
  Synthetic
EKAIRDVAKEIRDRLKELEEEIEEVTRRNLKLLADVEEEIRRVHEKTRRLLETVLRRAT

SEQ ID NO: 25159 - protein, 60 aa, Artificial Sequence
  Synthetic
DDLERAREEVADLIRKHEEKTRRILEESRRLNERHRELSARILDEIRKLAERIEELIKRE

SEQ ID NO: 25160 - protein, 59 aa, Artificial Sequence; identical to SEQ ID NO: 20434
  Synthetic

SEQ ID NO: 25161 - protein, 57 aa, Artificial Sequence
  Synthetic
KEVEDAVKELEDLLRANEDKTRSIVEDMRASNKDLEDHSRASEEEVRKLLDDLRRAG

SEQ ID NO: 25162 - protein, 56 aa, Artificial Sequence
  Synthetic
IKTLLDRVRKLAEEDAERLDRLRRESEELNERVRRVDKKLLEEIRRKAKKVEDDTR

SEQ ID NO: 25163 - protein, 57 aa, Artificial Sequence; identical to SEQ ID NO: 25161
  Synthetic

SEQ ID NO: 25164 - protein, 56 aa, Artificial Sequence; identical to SEQ ID NO: 25162
  Synthetic

SEQ ID NO: 25165 - protein, 56 aa, Artificial Sequence
  Synthetic
DEEEDLERAIKKLLDENRELLKRIAEELRRLLEELRRLTEESADRLRRLLKELKDR

SEQ ID NO: 25166 - protein, 56 aa, Artificial Sequence
  Synthetic
AETLLRELEKLSRDNKELLKKIEKEIRDLIKEDKERNIELSERLRKLVEELKKKAT

SEQ ID NO: 25167 - protein, 56 aa, Artificial Sequence; identical to SEQ ID NO: 25165
  Synthetic

SEQ ID NO: 25168 - protein, 56 aa, Artificial Sequence; identical to SEQ ID NO: 25166
  Synthetic

SEQ ID NO: 25169 - protein, 57 aa, Artificial Sequence
  Synthetic
DDAERILREMERLLEENKEISDEIAKELKRLLDENRKLSEDVVKALEDLLRDLERRS

SEQ ID NO: 25170 - protein, 59 aa, Artificial Sequence
  Synthetic
KDTLRELARSIRKLSAENKERLKELLRELKKLSDENKERIKKLLSDAEKIIEDVARRAK

SEQ ID NO: 25171 - protein, 60 aa, Artificial Sequence
  Synthetic
SSEERLRAVIEDLKRLAEESRKRHKELIDELAKAVERIERRHKKLLDEIKAVVDDIRRGV

SEQ ID NO: 25172 - protein, 56 aa, Artificial Sequence
  Synthetic
ADTIIEEVKRVLEELARSTEEVEKRVRDAIEELERSSEELARRIKEVLKRLEEETR

SEQ ID NO: 25173 - protein, 60 aa, Artificial Sequence
  Synthetic
DEARELVKELEDLIREITKTVRRLLEESEELIKRIDDAVDDLRRADEDLNREIKEEIEKG

SEQ ID NO: 25174 - protein, 56 aa, Artificial Sequence
  Synthetic
ERILRELEERVKELEKEAREILKRSEDETDKLREKAERILEDLERANRRTMDEARR

SEQ ID NO: 25175 - protein, 60 aa, Artificial Sequence; identical to SEQ ID NO: 25173
  Synthetic

SEQ ID NO: 25176 - protein, 56 aa, Artificial Sequence; identical to SEQ ID NO: 25174
  Synthetic

SEQ ID NO: 25177 - protein, 59 aa, Artificial Sequence
  Synthetic
DEIRKVVKEITDLLKASNDKNRKVVEEIRDLLRKSKKLADELVERLRALVEDLRRRIDK

SEQ ID NO: 25178 - protein, 59 aa, Artificial Sequence
  Synthetic
SEDLKRVEERAREVSRRNEESMRRVKEDADRVSEANKEVLDRVREEVKRLIEEVRETLR

SEQ ID NO: 25179 - protein, 59 aa, Artificial Sequence; identical to SEQ ID NO: 25177
  Synthetic

SEQ ID NO: 25180 - protein, 59 aa, Artificial Sequence; identical to SEQ ID NO: 25178
  Synthetic

SEQ ID NO: 25181 - protein, 57 aa, Artificial Sequence
  Synthetic
STAETVEKKVEEVIRENEKSMRESEEKVDRSTKRIEDVLRRLEETIRKTSDDIAKGV

SEQ ID NO: 25182 - protein, 59 aa, Artificial Sequence
  Synthetic
REDATRVIEEAKRILDEARKLNEETIRRSEELVRRIERVIEEIIKRSEKLLEDVARESK

SEQ ID NO: 25183 - protein, 57 aa, Artificial Sequence; identical to SEQ ID NO: 25181
  Synthetic

SEQ ID NO: 25184 - protein, 59 aa, Artificial Sequence; identical to SEQ ID NO: 25182
  Synthetic

SEQ ID NO: 25185 - protein, 57 aa, Artificial Sequence
  Synthetic
STAETVAEEVERVLKHSDDLIKEVEDVNRRVEEEIKRVIRELEEENERLVAEVRKGV

SEQ ID NO: 25186 - protein, 59 aa, Artificial Sequence
  Synthetic
EEAAREIIKRLREVNKRTKEKLDELIKHSEEVLERVKRLIDELRKHSEEVLEDLRRRAK

SEQ ID NO: 25187 - protein, 57 aa, Artificial Sequence; identical to SEQ ID NO: 25185
  Synthetic

SEQ ID NO: 25188 - protein, 59 aa, Artificial Sequence; identical to SEQ ID NO: 25186
  Synthetic

SEQ ID NO: 25189 - protein, 59 aa, Artificial Sequence; identical to SEQ ID NO: 21345
  Synthetic

SEQ ID NO: 25190 - protein, 56 aa, Artificial Sequence
  Synthetic
AETIERVVRELLEENKEVLRKTEEAVKRSTETNKRLLEASKEVADRLRERIKEAAK

SEQ ID NO: 25191 - protein, 61 aa, Artificial Sequence
  Synthetic
SRVEEIIEDLRRLLEEIRKENEDSIRRSKELLDRVKEINDTIIAELERLLKDIEKEVREKG

SEQ ID NO: 25192 - protein, 59 aa, Artificial Sequence
  Synthetic
EDKARKVAEVAEKVLRDIDKLDRESKEAFRATNEEIAKLDEDTARVAERVKKAIEDLAK

SEQ ID NO: 25193 - protein, 61 aa, Artificial Sequence; identical to SEQ ID NO: 25191
  Synthetic

SEQ ID NO: 25194 - protein, 59 aa, Artificial Sequence; identical to SEQ ID NO: 25192
  Synthetic

SEQ ID NO: 25195 - protein, 61 aa, Artificial Sequence
  Synthetic
SEVDEIIKELERLLAEIARENERIIRESRKLADEVRKRNEDAIRKLEELVARLADAVRRKG

SEQ ID NO: 25196 - protein, 59 aa, Artificial Sequence
  Synthetic
KDEVTKVKKVADDVLAEIKKLDDETRRVIEDTNKKIADLDKATRDVVRKVLEEVKKLEK

SEQ ID NO: 25197 - protein, 59 aa, Artificial Sequence; identical to SEQ ID NO: 21407
  Synthetic

SEQ ID NO: 25198 - protein, 59 aa, Artificial Sequence
  Synthetic
SEKLKELRDVIAEVAKRIDELDEYTRESIRRAKKEIERLNRETKKVIEEVVKRIEEERK

SEQ ID NO: 25199 - protein, 59 aa, Artificial Sequence; identical to SEQ ID NO: 21407
  Synthetic

SEQ ID NO: 25200 - protein, 59 aa, Artificial Sequence; identical to SEQ ID NO: 25198
  Synthetic

SEQ ID NO: 25201 - protein, 59 aa, Artificial Sequence
  Synthetic
DAVEEAEKLIRKVIADSEKLLRDLADLNAKSIRRSEKLVEDDRRANEDVIRKLEELRRN

SEQ ID NO: 25202 - protein, 59 aa, Artificial Sequence
  Synthetic
EELLRRIKKLLDEIKKAIEDSSREIKRLLEESERVMKRSSEDIKRTLDDTRRVVEEVRR

SEQ ID NO: 25203 - protein, 59 aa, Artificial Sequence; identical to SEQ ID NO: 25201
  Synthetic

SEQ ID NO: 25204 - protein, 59 aa, Artificial Sequence; identical to SEQ ID NO: 25202
  Synthetic

SEQ ID NO: 25205 - protein, 56 aa, Artificial Sequence
  Synthetic
SSDEVLKEIEEIIRRLEAEVRRVNAEVNASTEDLAREVEEVLRATNELIEELERRV

SEQ ID NO: 25206 - protein, 59 aa, Artificial Sequence
  Synthetic
EEALSKAIKDVRDIVKKVKDELKEWRDRNKELVDRLSEELKEWLKDVERVLKELTDKDR

SEQ ID NO: 25207 - protein, 57 aa, Artificial Sequence
  Synthetic
SEADDVLKKLAETVKRIIERLKKLTDDSRRLVEEVHRRNDKLSKESAEAVRKAEERG

SEQ ID NO: 25208 - protein, 55 aa, Artificial Sequence
  Synthetic
EELSAEVKKLLDEVRKALARHKDENDKLLKEIEDSLRRHKEENDRLLEKLKESTR

SEQ ID NO: 25209 - protein, 57 aa, Artificial Sequence; identical to SEQ ID NO: 25207
  Synthetic

SEQ ID NO: 25210 - protein, 55 aa, Artificial Sequence; identical to SEQ ID NO: 25208
  Synthetic

SEQ ID NO: 25211 - protein, 59 aa, Artificial Sequence; identical to SEQ ID NO: 22001
  Synthetic

SEQ ID NO: 25212 - protein, 59 aa, Artificial Sequence
  Synthetic
EDKVERVVREVEKLHEEDRKRLEESTRSVRKLLEELKRELEKSTRSVKALVDELRERVR

SEQ ID NO: 25213 - protein, 59 aa, Artificial Sequence; identical to SEQ ID NO: 22001
  Synthetic

SEQ ID NO: 25214 - protein, 59 aa, Artificial Sequence; identical to SEQ ID NO: 25212
  Synthetic

SEQ ID NO: 25215 - protein, 59 aa, Artificial Sequence
  Synthetic
SEAEEIRRRLEEISRRSVEHLRKVLEEIKRISERSKRHLDRVLEENARRLEELAELLKR

SEQ ID NO: 25216 - protein, 56 aa, Artificial Sequence
  Synthetic
EEVLRELEELLKESEERIKRIEEEIKKIIDKSREDIKRVLEEIERLNAKAADDLRK

SEQ ID NO: 25217 - protein, 60 aa, Artificial Sequence
  Synthetic
SEVDDVLRRLEELIKTLEDINAKSLEDIKKLIDDLAKILEDALRKHEKLIRELREAKKGI

SEQ ID NO: 25218 - protein, 56 aa, Artificial Sequence
  Synthetic
KEALDRMREEIRRLEEESRKSDETIERLIRELRRRVEEVLKTSTDLIRELEEEVKK

SEQ ID NO: 25219 - protein, 60 aa, Artificial Sequence; identical to SEQ ID NO: 25217
  Synthetic

SEQ ID NO: 25220 - protein, 56 aa, Artificial Sequence; identical to SEQ ID NO: 25218
  Synthetic

SEQ ID NO: 25221 - protein, 59 aa, Artificial Sequence
  Synthetic
SDAEELLKRVADLLKASLESLEKILRDSKELMDRWRKKLEDLLRESEELVDRAEKILRR

SEQ ID NO: 25222 - protein, 55 aa, Artificial Sequence
  Synthetic
ERVREELKKLLTRVEEEHRKVLETDKKILKEAHKESKEVNDRDRELLERLEESVR

SEQ ID NO: 25223 - protein, 57 aa, Artificial Sequence
  Synthetic
DAAERAKEKLDKILEDLRDVVRASKENLDRLHAENAETLERSKANLDRLLEKVKKDG

SEQ ID NO: 25224 - protein, 59 aa, Artificial Sequence
  Synthetic
ERDIERILRELEAVLKKLTDESERLNREVERVSRDTKKKSKELNEELKAVLDEVKRKAD

SEQ ID NO: 25225 - protein, 60 aa, Artificial Sequence
  Synthetic
SEIETVRREIEKILDDLRRTVKRIEDEVRKIHEDLRRSLEDSKRNIEEILKDLERAARRD

SEQ ID NO: 25226 - protein, 59 aa, Artificial Sequence
  Synthetic
KEDIDKLLKELRDLVEKIKKDLKELLERYEEIVRRIKELLKDLNREAEEVVRRLKEELR

SEQ ID NO: 25227 - protein, 57 aa, Artificial Sequence
  Synthetic
KELEDVIEEVKKLLKTVNEESRRVAEEVRKLIREVSEELTEVIRRVERLVEEVAKGV

SEQ ID NO: 25228 - protein, 56 aa, Artificial Sequence
  Synthetic
AETVLRSAEDIVAKNRKLAEEVLRRVKKIVEENRKIASEVLDDVRKLVEDVLARAS

SEQ ID NO: 25229 - protein, 60 aa, Artificial Sequence
  Synthetic
SKLEEVEKAVRKVIEDSRRVNEEVNRRSEEVVRELEKVHREVNDASRRVVEKARRVLKGS

SEQ ID NO: 25230 - protein, 58 aa, Artificial Sequence; identical to SEQ ID NO: 22670
  Synthetic

SEQ ID NO: 25231 - protein, 60 aa, Artificial Sequence; identical to SEQ ID NO: 25229
  Synthetic

SEQ ID NO: 25232 - protein, 58 aa, Artificial Sequence; identical to SEQ ID NO: 22670
  Synthetic

SEQ ID NO: 25233 - protein, 56 aa, Artificial Sequence
  Synthetic
SAEEVKEELKRIATKLKEEIKENIRRLEESVEKIAKELAENIKRLEDILRDVKRGL

SEQ ID NO: 25234 - protein, 56 aa, Artificial Sequence
  Synthetic
GEELVERLRRVVEEVRERLKDSSRELRKINEDSRKAVEDSSAEVAKVVEELERRDT

SEQ ID NO: 25235 - protein, 57 aa, Artificial Sequence
  Synthetic
SEIERVKKRLEELLAEVEESTRRLEERLKRLLEEAKRSSEEVEKELRRLLEAVRRGL

SEQ ID NO: 25236 - protein, 56 aa, Artificial Sequence
  Synthetic
ADDVLARVEELAKRAHDENERLIREVEELVRAHNKRNKELVDEVKRLVEKVIEEER

SEQ ID NO: 25237 - protein, 57 aa, Artificial Sequence; identical to SEQ ID NO: 25235
  Synthetic

SEQ ID NO: 25238 - protein, 56 aa, Artificial Sequence; identical to SEQ ID NO: 25236
  Synthetic

SEQ ID NO: 25239 - protein, 60 aa, Artificial Sequence
  Synthetic
SDVDRVLEEIRKLLEDLKRHSEKVSEENEDLLRANTELNKRVSEDNERLLEELKRLRERG

SEQ ID NO: 25240 - protein, 59 aa, Artificial Sequence
  Synthetic
EEAKKKLDEVLERAKRTIDRLLETSDRSLEKVEADLRRLNEELDRSLERAERTIRELAK

SEQ ID NO: 25241 - protein, 60 aa, Artificial Sequence; identical to SEQ ID NO: 25239
  Synthetic

SEQ ID NO: 25242 - protein, 59 aa, Artificial Sequence; identical to SEQ ID NO: 25240
  Synthetic

SEQ ID NO: 25243 - protein, 55 aa, Artificial Sequence
  Synthetic
STEDVLRKIKEDVKRVIDDNRRILDEVRRTSKRVLDDLRANLKHIAEEVERVLRG

SEQ ID NO: 25244 - protein, 56 aa, Artificial Sequence
  Synthetic
SKELLEKAKAVVDEIKRLAEESLKRLEDLSRDHKRRAKELNDEIAKVVDELAKRAT

SEQ ID NO: 25245 - protein, 60 aa, Artificial Sequence
  Synthetic
SAEELLREVAELVKRVDEDLRRLLEEVRASNEEVIRRLEEILKRIEEENRKVVEELRRGG

SEQ ID NO: 25246 - protein, 59 aa, Artificial Sequence
  Synthetic
EETVKRLLDELRELLERLKRTIEELLKRNRDLLADAEEKARRLLEENRKLLKAARDTAT

SEQ ID NO: 25247 - protein, 59 aa, Artificial Sequence
  Synthetic
SEDEDLDRVAEKLAREHKKSVEEIKRVLKSADEESKKLVRDTERVIEEIKREVEEARRG

SEQ ID NO: 25248 - protein, 55 aa, Artificial Sequence
  Synthetic
EEVLKKLAEIVRRVKEENRKVNEEVEKRLRELEEENKKVIEDLKSTVEELVERLR

SEQ ID NO: 25249 - protein, 59 aa, Artificial Sequence; identical to SEQ ID NO: 25247
  Synthetic

SEQ ID NO: 25250 - protein, 55 aa, Artificial Sequence; identical to SEQ ID NO: 25248
  Synthetic

SEQ ID NO: 25251 - protein, 60 aa, Artificial Sequence; identical to SEQ ID NO: 23529
  Synthetic

SEQ ID NO: 25252 - protein, 56 aa, Artificial Sequence; identical to SEQ ID NO: 23530
  Synthetic

SEQ ID NO: 25253 - protein, 57 aa, Artificial Sequence
  Synthetic
SKEDRLREELKKLLARLAEEIERLKRALEESNKDLKRTIDASEKHLRDVNEDVKRGG

SEQ ID NO: 25254 - protein, 59 aa, Artificial Sequence; identical to SEQ ID NO: 24672
  Synthetic

SEQ ID NO: 25255 - protein, 57 aa, Artificial Sequence; identical to SEQ ID NO: 25253
  Synthetic

SEQ ID NO: 25256 - protein, 59 aa, Artificial Sequence; identical to SEQ ID NO: 24672
  Synthetic

SEQ ID NO: 25257 - protein, 60 aa, Artificial Sequence; identical to SEQ ID NO: 24699
  Synthetic

SEQ ID NO: 25258 - protein, 59 aa, Artificial Sequence
  Synthetic
RETAERARETLKRLLDENRDRSKKVKEEIRRILEDLTRTTERVKREIAKLLKELEDTAR

SEQ ID NO: 25259 - protein, 60 aa, Artificial Sequence; identical to SEQ ID NO: 24699
  Synthetic

SEQ ID NO: 25260 - protein, 59 aa, Artificial Sequence; identical to SEQ ID NO: 25258
  Synthetic

SEQ ID NO: 25261 - protein, 58 aa, Artificial Sequence
  Synthetic
SELEEVLRRIEALVRKAHKENEDVLREIERLVRTAHRLNKKVDDDSAKIAEDLKRGGR

SEQ ID NO: 25262 - protein, 58 aa, Artificial Sequence
  Synthetic
EAVRRLKEILERLKEEVRRSLEELRKEVERLKKEVEDSLRELKKSLEEWVKSLEEATR

SEQ ID NO: 25263 - protein, 58 aa, Artificial Sequence; identical to SEQ ID NO: 25261
  Synthetic

SEQ ID NO: 25264 - protein, 58 aa, Artificial Sequence; identical to SEQ ID NO: 25262
  Synthetic

SEQ ID NO: 25265 - protein, 56 aa, Artificial Sequence
  Synthetic
SKEEELEKLLREHHEKIKRLKEESKRINDRIRRTVEELIKESEKINRDINDTVRKG

SEQ ID NO: 25266 - protein, 56 aa, Artificial Sequence
  Synthetic
EDSVERIARELERNLDDLARVLKESEDDLAEILRRLKEVLEESERDLERVEREVRK

SEQ ID NO: 25267 - protein, 59 aa, Artificial Sequence
  Synthetic
SEAEEAAERAKRAAKEAVERAKRAVERNEEAARRAAEKAREATERAERAARRAADKARK

SEQ ID NO: 25268 - protein, 60 aa, Artificial Sequence
  Synthetic
IKDAADKLAEAAKRAVDISKKAADDLKRLAKEDNEIAREAARRLAEAAKEAVKLVDDVTR

SEQ ID NO: 25269 - protein, 56 aa, Artificial Sequence
  Synthetic
SEKEKAAEDLRRAIEEAKKRSEEAAKELEDALRKAEKEARDSAETLKEAAKRAADA

SEQ ID NO: 25270 - protein, 59 aa, Artificial Sequence
  Synthetic
KDAATEAKKAADTIAKLIEDNAKRALEAAREIAKLIEKSAKEALEAAERIARLIEEAAN

SEQ ID NO: 25271 - protein, 59 aa, Artificial Sequence
  Synthetic
SVEEAARRAAKALKDAAKKLLEANEKAARAWKELAKELIKADEKALKILEEAARKARRD

SEQ ID NO: 25272 - protein, 57 aa, Artificial Sequence
  Synthetic
AEEAAKEAIRIAEEALRRSAEAAERAARIAEDAARKSRKAAEDAAKIAKEAADRARK

SEQ ID NO: 25273 - protein, 62 aa, Artificial Sequence
  Synthetic
SEEDRLRELAERARRLAKRNRELAKEIIDEIRKLIRDAREAAKKSAEKAKRLIDDARRVAGK

SEQ ID NO: 25274 - protein, 56 aa, Artificial Sequence
  Synthetic
IEEAAKANEEAIKASEEAVDEAARALEEAAEASKRANEKADKALEDAVRAAEEATR

SEQ ID NO: 25275 - protein, 61 aa, Artificial Sequence
  Synthetic
SEKEDVLRRIREAHERNKRLLERVAEEIKRIVEESRKLLEDVRKKAEDAARRAEEALRKEA

SEQ ID NO: 25276 - protein, 56 aa, Artificial Sequence
  Synthetic
KEALLKAAKEALEALEEALRLIAKATEEAARAAKEALDLILEADRKSAKAAEEALR

SEQ ID NO: 25277 - protein, 61 aa, Artificial Sequence
  Synthetic
SEREEVAKRATDAHEENERLLREVEKRIKEALERNEELLKRVSDKAREAAKKLEDALRRRA

SEQ ID NO: 25278 - protein, 56 aa, Artificial Sequence
  Synthetic
KEALRRAAKKALDAAEEALELIRKASKEAADAAREALKLILEADKKSLEAAREALR

SEQ ID NO: 25279 - protein, 60 aa, Artificial Sequence
  Synthetic
SEREEIEEIKKRVDRTLEEYERKVEDIRRKLTELKDESDKKVKDVRRKLKETEDRVREEG

SEQ ID NO: 25280 - protein, 58 aa, Artificial Sequence
  Synthetic
EELRELIERLVRIAEEVSEEDERVLRSLEDILRKVVEENERLLERLKRILEELIRRTR

SEQ ID NO: 25281 - protein, 58 aa, Artificial Sequence
  Synthetic
SEDEELKKELEKLLKELEEKLEKYRDDLRKDKERLKEKLDRYRERLRELMEELKDLLD

SEQ ID NO: 25282 - protein, 59 aa, Artificial Sequence
  Synthetic
EDVLRDIVRRVVEVLRKNLKIVEEIIRKIEELLEKNLRLVEEILRRIARLLEEVLEKTR

SEQ ID NO: 25283 - protein, 60 aa, Artificial Sequence
  Synthetic
SDAEVIEELVRLHRKLLEDILKLLKELVDIHRETLRRIEEIVERIVRLIEALLDKIRKEG

SEQ ID NO: 25284 - protein, 59 aa, Artificial Sequence
  Synthetic
KEALERLLERLKEIVDRIKEELDRLLKRSEDSIREIEERVKRLLEESKRVVDEIRERLK

SEQ ID NO: 25285 - protein, 57 aa, Artificial Sequence
  Synthetic
SKEKKILDRLRELLKESRDLNRRVKETLKKLLEDSKRLLDEIRKRLKELLDELEKEN

SEQ ID NO: 25286 - protein, 55 aa, Artificial Sequence
  Synthetic
EAVKRLKEVLDEVAELVKTLLEVNRKILEDVDKLIEEVLKLNDDILREVVKLAED

SEQ ID NO: 25287 - protein, 61 aa, Artificial Sequence
  Synthetic
SEKEKLLEDIADIARKILKLLKEHLDKLRKLLEEIRRLLEEHSRVLRELIERILDALRRKK

SEQ ID NO: 25288 - protein, 55 aa, Artificial Sequence
  Synthetic
KDLERELKRVKEISRKLEEELKELKERVKRDSEKMNEDLDRLLEDAERRIRKTRE

SEQ ID NO: 25289 - protein, 59 aa, Artificial Sequence
  Synthetic
SEEDKVLEELKRLLEELLRKHEEVLKEIKELLDKIIKKHEESLRRIKKLAEEIKERAKK

SEQ ID NO: 25290 - protein, 59 aa, Artificial Sequence
  Synthetic
KTLTEELKRIEDKLEELIRRSKDELDKIVREAEKIIEESKRRLEKLLRELERIIEDAKR

SEQ ID NO: 25291 - protein, 60 aa, Artificial Sequence
  Synthetic
SELEELVKRIEKTLRDLRRKNEELRKEVEEVEREDRERLERAAEDLERVEKKVEDEVRRR

SEQ ID NO: 25292 - protein, 57 aa, Artificial Sequence
  Synthetic
IEKTIEDARRLLEKILKLHRENSEESRRLIEDINRVNRELIDEVAELAKKILRRVEE

SEQ ID NO: 25293 - protein, 61 aa, Artificial Sequence
  Synthetic
RDEELLERVERLLRELLDTNRRKLEEVEKELRRLLETNKKTLDDVRRLLKELLDVLETREV

SEQ ID NO: 25294 - protein, 55 aa, Artificial Sequence
  Synthetic
DDLRELKKRIEDLLKEDKERLEKIARDIERDLERYRRDLKRLEDELREDIERARR

SEQ ID NO: 25295 - protein, 58 aa, Artificial Sequence
  Synthetic
REEEVLRRLREIIKRLLDKNRKVNEDLVRLIKRVLDKNREVLKRLRDLIRELLEVVRN

SEQ ID NO: 25296 - protein, 60 aa, Artificial Sequence
  Synthetic
DEDLERALKKVKDELERIVRENEDADRKIKEEVDRLSEENEKVNREIKKELDDVVEETKK

SEQ ID NO: 25297 - protein, 56 aa, Artificial Sequence
  Synthetic
EEDERLTKRVEEIKRENRELLRRLEEEVKELERKSEKIVRDLKEKVDRAKEKLDSN

SEQ ID NO: 25298 - protein, 57 aa, Artificial Sequence
  Synthetic
DKDVLTELKRILDELLKLVEKLIRRNLRLLEELLRLVREILRTSNEILEEILKDARR

SEQ ID NO: 25299 - protein, 60 aa, Artificial Sequence
  Synthetic
SELDTLVELIKRILEEITRVNKELVDEVRKLLEEIVRINERSVRTIEKILRDIAELIRRG

SEQ ID NO: 25300 - protein, 60 aa, Artificial Sequence
  Synthetic
EEELEKELRRLKKELEEVVRKSREDLERLKKELEKIVKESEDELKKVEEKVKKLADDARR

SEQ ID NO: 25301 - protein, 58 aa, Artificial Sequence
  Synthetic
TEEEVLRKVEKLIKDLLDVLRDLLRASEEVVREALRVLEELIEENKRVIEELSRALSD

SEQ ID NO: 25302 - protein, 60 aa, Artificial Sequence
  Synthetic
ERKLRRDLTETKKELEKRHEDLRRELEKLLRDYKRELEEIERRLEEIEKTLKRRADETRR

SEQ ID NO: 25303 - protein, 58 aa, Artificial Sequence
  Synthetic
SDLERLEKEIRDLLDELRRLTEELEKRSRDILKRLKEILEELKRRIERLLDELRRRRG

SEQ ID NO: 25304 - protein, 58 aa, Artificial Sequence
  Synthetic
DSVRELIEVLKKALEDVRRVLRAIEEIVRRSVELNEKHSRELRRVLKELLELVAKAAE

SEQ ID NO: 25305 - protein, 55 aa, Artificial Sequence
  Synthetic
SEEEELRKLAKKIEEVIKTSRDKLDKSRKELEKVIRDIERRLRELRRELEELVRR

SEQ ID NO: 25306 - protein, 57 aa, Artificial Sequence
  Synthetic
REDVLREIEKLLEEILRALRKLLKDLLDLHDEVLKADEKLLKRLREIVKKVLEEVRK

SEQ ID NO: 25307 - protein, 55 aa, Artificial Sequence
  Synthetic
SEEEKLRELRKRLEDTVRRSKEELEKSTEELKDVIKKSEEKLEELKRRLEEMKRR

SEQ ID NO: 25308 - protein, 57 aa, Artificial Sequence
  Synthetic
SEKLLTDAARILDDVVRVDRELLRLVLELHKRLVRADEKLLTDIRELARRVLEETRK

SEQ ID NO: 25309 - protein, 59 aa, Artificial Sequence
  Synthetic
DEDERLRELRDRVRRSEEEDERRNKRHEERVKELEDEDKERNERHRKRLKEITDRLKER

SEQ ID NO: 25310 - protein, 55 aa, Artificial Sequence
  Synthetic
EDLLKVVRDSLEILKELIRTVLKAIEESLRILEELIERLKRHIETILRLAAETTT

SEQ ID NO: 25311 - protein, 59 aa, Artificial Sequence
  Synthetic
DEEELEKEIKKLLEEATKKHEDVKREIKERLEKLRRDHEEAEKRVRDELRRLEEELERR

SEQ ID NO: 25312 - protein, 55 aa, Artificial Sequence
  Synthetic
EDLIRVLKKLIEDLERLLTKNRRLLEEIVKILTKLLKDNRDLLRRILRKVEETAK

SEQ ID NO: 25313 - protein, 57 aa, Artificial Sequence
  Synthetic
DEARRIKEIVDRAVEIWRRLVEEIKRIVKEVLDKWRKLIRELIELVRKALEDLRRTN

SEQ ID NO: 25314 - protein, 58 aa, Artificial Sequence
  Synthetic
DELKRLEDDVRKKLKDLEDKLRKLRKELEETHRRLAETIRRIAEELERLHRELKRESK

SEQ ID NO: 25315 - protein, 57 aa, Artificial Sequence
  Synthetic
SKDERLRKVLEDVERLLREVLKKHRKVIDDLRELLKRVVEIHRRVLEEILKRLEEEG

SEQ ID NO: 25316 - protein, 59 aa, Artificial Sequence
  Synthetic
DEVVERIRRTLEEIERRLRKTDKDLEKDLRELKKDLDRTDEELKRKVEKLKRELKETSK

SEQ ID NO: 25317 - protein, 61 aa, Artificial Sequence
  Synthetic
DEKDRLEEEVRKLLKEAEDELRRLKRENEKLNRELKETLKRVKEESERLLRKLREDVRKDG

SEQ ID NO: 25318 - protein, 57 aa, Artificial Sequence
  Synthetic
LEEVLEELDRLNKEVLKAIEEAAKKLEDLNRRVLEVLEDILRKLKEIVDEALKVLRK

SEQ ID NO: 25319 - protein, 59 aa, Artificial Sequence
  Synthetic
KEEELLERLREVLKTDLDLLRDLVRTLKEDLDKDARLLEELVERLKKLLDKIKRLLEEE

SEQ ID NO: 25320 - protein, 56 aa, Artificial Sequence
  Synthetic
ERVKREIRKDLDKIRREIEKIVKESEESNERSLEKIDRILEESKRRNERLKRELDR

SEQ ID NO: 25321 - protein, 60 aa, Artificial Sequence
  Synthetic
SKKETIRKLIEENKDIIRKLAEKLKRLLEESERIAEEALRLIKELLERIERALRRVAKDI

SEQ ID NO: 25322 - protein, 55 aa, Artificial Sequence
  Synthetic
KELEKLLEDLEREIRRLKKRLKELSDRLEEKIRKIKRELDDLSRRLREKIERTRK

SEQ ID NO: 25323 - protein, 60 aa, Artificial Sequence
  Synthetic
DDEKRLKDRLREALKRNEELLDRLRRRVEEILDRNRKLLERVRRELERVLKELEDLIRRG

SEQ ID NO: 25324 - protein, 56 aa, Artificial Sequence
  Synthetic
ETVLRELVEELERVVRRILELLKRLSDASKRVVEEILELLRRLSEKTAKAVDDTRT

SEQ ID NO: 25325 - protein, 56 aa, Artificial Sequence
  Synthetic
DDERRLETLIRLSRELIERVRKLLRDIIRTSKELIEEVLETVKRILDKIEELAKEV

SEQ ID NO: 25326 - protein, 55 aa, Artificial Sequence
  Synthetic
EKISRKVEELEKEIRRLIEELKKKNEEVEKKIREIMKELDERSERLRRELDRTRD

SEQ ID NO: 25327 - protein, 60 aa, Artificial Sequence
  Synthetic
SKEDELRKELEEVVKRIEDALRKLKERSKRVAKRVKKLLDDLKKESEEVVESLREKLEKE

SEQ ID NO: 25328 - protein, 59 aa, Artificial Sequence
  Synthetic
ESVRKLLEELRRLHERIIKIIEEILELLRRVHKEVAKDVRRLARELEELVRRLVETLRR

SEQ ID NO: 25329 - protein, 58 aa, Artificial Sequence
  Synthetic
SAEEILDTVAELIKTHLKIVREVLKTVRDLNRRSLDLIRRILERMRRLVERLVRLIRN

SEQ ID NO: 25330 - protein, 56 aa, Artificial Sequence
  Synthetic
EKRLREVEEEVERRLDTVRRELEEVEKESDRLLEELEKKSEDFERDIRRLLKEAKT

SEQ ID NO: 25331 - protein, 56 aa, Artificial Sequence
  Synthetic
SKREEIEKLLEDLKRDNKRVLDRLREVIKDNEDKNEKAVRDARELLERLKRELEEG

SEQ ID NO: 25332 - protein, 55 aa, Artificial Sequence
  Synthetic
EALKRLEEVAKELLKLIEEVLKENERSNREILRLIAELVKRNARVNEELLEIARR

SEQ ID NO: 25333 - protein, 61 aa, Artificial Sequence
  Synthetic
EKDDRIREKVKEIERRNDKALDDIRRRVEEIKRENDEVLDRIRKELEDLKKEVEEVAKRTG

SEQ ID NO: 25334 - protein, 59 aa, Artificial Sequence
  Synthetic
EELKKLLDKLLEDLRRIVKKLEELLKKNDDELRKIVKEVKDLLKRNHDELERIVREARR

SEQ ID NO: 25335 - protein, 61 aa, Artificial Sequence
  Synthetic
SKEEKIERDVDEIRKENEEVLRRIRKKVRDIERENDEILRKIEEDLRRIEKDLERVAKERG

SEQ ID NO: 25336 - protein, 59 aa, Artificial Sequence
  Synthetic
EDLRELLRKVLESLRRIVERVDRTLKDNDRKIEEIVRELKELLKKNNDALRKIVEDAKR

SEQ ID NO: 25337 - protein, 59 aa, Artificial Sequence
  Synthetic
SREEVFELLLDVLRKIVELIKDLAKKNIDVLKKLMELIDELVKINEKSLEDLLRLIREG

SEQ ID NO: 25338 - protein, 56 aa, Artificial Sequence
  Synthetic
EKELEDEARRLKKEYRDEVERLKKEIREIIERYKDALRKLEREIEDITRRLKERAD

SEQ ID NO: 25339 - protein, 62 aa, Artificial Sequence
  Synthetic
SKLEDLLRRAEELLKDIVRANERLLEEIRKLLKEIVKANEDLLRKVKRLLEEAVEMAIRERG

SEQ ID NO: 25340 - protein, 56 aa, Artificial Sequence
  Synthetic
EEIVTRVRKKVEELKEEVKRINDEVRKKVRDLEETSKRILERVEDLVRELKERARR

SEQ ID NO: 25341 - protein, 59 aa, Artificial Sequence
  Synthetic
SKEDKARELEKRLRDNLKKLEEVVRELAEVLKRNLEKLRRLAEELLRALKRLLDKLRAG

SEQ ID NO: 25342 - protein, 56 aa, Artificial Sequence
  Synthetic
EDLVRDIRRELKELEERARKILRDDERDLRALEKRIRDIIREDREELERLKERARK

SEQ ID NO: 25343 - protein, 60 aa, Artificial Sequence
  Synthetic
KREDILKKLEDIIRDIIDKLRRILEKVKRLNEDIIREIKRLLDESLKTLEDLLKRIADKS

SEQ ID NO: 25344 - protein, 58 aa, Artificial Sequence
  Synthetic
EEIKRLKEELERRHRRLEEEVERVARELEKRHRDLERDIRRVAEELKKLLKKLRDDRR

SEQ ID NO: 25345 - protein, 57 aa, Artificial Sequence
  Synthetic
REKEELSEEIRRRLDELRKLLEEYEEEVKRLLTRLRDKLRRYKEEVERLLRKLKEDN

SEQ ID NO: 25346 - protein, 55 aa, Artificial Sequence
  Synthetic
KEAVDLVRDVLRRVEKVNRELLELIKEVADRVRERNKELVELIDRLLERLKRADK

SEQ ID NO: 25347 - protein, 60 aa, Artificial Sequence
  Synthetic
SEEETVERLLEEARKRHEEIIKKAKELLDRAREEHERIIREAEKLLEEIKKRVDELVRDG

SEQ ID NO: 25348 - protein, 56 aa, Artificial Sequence
  Synthetic
RKTLLREIEKLLKTLEDILRDLLRLVEKTLKELEEILKDLVDKARENLKRLRERIR

SEQ ID NO: 25349 - protein, 57 aa, Artificial Sequence
  Synthetic
SKEEEIVKEVEKIVEKLLEVNRRALERIEEIVRKNLKVNRELVEEIERIVEELIRTG

SEQ ID NO: 25350 - protein, 56 aa, Artificial Sequence
  Synthetic
EEMLRRVLKKIEEVIRRAREEHEKSTRELEEVIKELKKRHEDVTREAKKVIDDLKR

SEQ ID NO: 25351 - protein, 56 aa, Artificial Sequence
  Synthetic
SEKEELKRLLDKLLKELKRLSDELKKTIDKILKILKEVSEEVKRTADELLDAIRRG

SEQ ID NO: 25352 - protein, 59 aa, Artificial Sequence
  Synthetic
EDELRKVEEDLKRLEDKLKKLLEDYEKKVRELEETLDDLLRKYEETLRRLEKELEEEER

SEQ ID NO: 25353 - protein, 56 aa, Artificial Sequence
  Synthetic
SRVERLEKLLEEHKRLVEDLIRLLDELAKKHDEDVRRLIERLKELAERLKRLLERS

SEQ ID NO: 25354 - protein, 56 aa, Artificial Sequence
  Synthetic
KRDVDRIREEIKKLIEDVRREIKRVEDKHKKDIDRVKEKLDRVRDRHEKMAEDSKR

SEQ ID NO: 25355 - protein, 60 aa, Artificial Sequence
  Synthetic
REKEELLRLLKEIAERILDILRKALELLDRVVELDNRTSKELLELSAELVKRILEAVRDG

SEQ ID NO: 25356 - protein, 60 aa, Artificial Sequence
  Synthetic
EEEKKRLLDDLRRILREYEERVKKLNDEHKKLEKEIKDKVKRILDEIRRTLDKILKELRK

SEQ ID NO: 25357 - protein, 60 aa, Artificial Sequence
  Synthetic
KDEERLVKKIRDSLRKYEDLLRKLVERIRDLLRRYEEELRKLLTEIEKTLEDVRDVLRRK

SEQ ID NO: 25358 - protein, 58 aa, Artificial Sequence
  Synthetic
DLLEMLRRLVERLKRLIERVLKLNRELVKKLLELLEEALRRNRRLVEDILKIADEARK

SEQ ID NO: 25359 - protein, 58 aa, Artificial Sequence
  Synthetic
SDEDRKRKKLEDVERRLEKLLREYEEKVRRVLEELRRLLEENKRHVEELEKRLRDRAK

SEQ ID NO: 25360 - protein, 56 aa, Artificial Sequence
  Synthetic
LEEALERLRRLLEELLRINERIIELIRELLEDNRRILEEILKLIKDLLRRAERIVD

SEQ ID NO: 25361 - protein, 56 aa, Artificial Sequence
  Synthetic
SEEEDLEREKRRLDKYSEDDRRRAEKVLRELEEEVKKSRKRLEDAKRRLDEEVRRN

SEQ ID NO: 25362 - protein, 59 aa, Artificial Sequence
  Synthetic
EEVLRILKTLVKELEDILRELLKINEDLVRRLERILRELLKSNDNLVKELEKLLEKARR

SEQ ID NO: 25363 - protein, 63 aa, Artificial Sequence
  Synthetic
EKKERIREALERAVRTLEKLLEDDKRELDKARREVRELLRRDKEELDKVVERVERELDRARER

SEQ ID NO: 25364 - protein, 58 aa, Artificial Sequence
  Synthetic
RKLEEILRLLEEALRRNSETLEEILRKLEEILKRNRKTLEDLLKLVKEILDEIRERLR

SEQ ID NO: 25365 - protein, 59 aa, Artificial Sequence
  Synthetic
SLTERVLDLARDLIRILLEIHKRALKLIAELVKKLLKIHEDVLKLSEELVEELLEIVAR

SEQ ID NO: 25366 - protein, 60 aa, Artificial Sequence
  Synthetic
EDTLRRVLERIREEVERVKEKHRRLLEELKKLLEELRKRSKDLLEDIKRKVRELEEKTRR

SEQ ID NO: 25367 - protein, 60 aa, Artificial Sequence
  Synthetic
REDEELTKRVEKILRDAERLVRKLHRENREILKTLKRLVEELEKENRKVLKDAEDLVRKE

SEQ ID NO: 25368 - protein, 56 aa, Artificial Sequence
  Synthetic
ARELLKELKRIVKKSLDELRKLLKKLEDIVRESNERLKEVLKKITDLIRKVLEDIR

SEQ ID NO: 25369 - protein, 58 aa, Artificial Sequence
  Synthetic
SEEDKIAEELKETLKRYRDRLEEIRKELEDKLREYEKRLEDLARELEKKLRKLEARDV

SEQ ID NO: 25370 - protein, 55 aa, Artificial Sequence
  Synthetic
EDVRRVVRELLRKLEDILRESEETNKETLEKIDEILKESERTNREVIRKLKETTD

SEQ ID NO: 25371 - protein, 56 aa, Artificial Sequence
  Synthetic
SAEETLRRITEESKRVLEEITKKYEDLERESREVLRKLREDLDRIKRELEDVLTKG

SEQ ID NO: 25372 - protein, 60 aa, Artificial Sequence
  Synthetic
RERLARLLKKLADKLIRVLEEILKINEELNRKIIKFARENLERNRRVNKKVIEVLREAAR

SEQ ID NO: 25373 - protein, 56 aa, Artificial Sequence
  Synthetic
SEDEKLKKEVDDVLERAKRLLDRLREANEDVLRKAKEDLDRLLKSNREILEELRKI

SEQ ID NO: 25374 - protein, 56 aa, Artificial Sequence
  Synthetic
ERVLERLLKALKEHSDELKKVVEELLKLLEEHLREVEKLVRELLADLKRLLDKTRK

SEQ ID NO: 25375 - protein, 61 aa, Artificial Sequence
  Synthetic
SKIEELLTKLAELLKEVIDELRKNLKRLEETVDENLKTMEDLLRKLEEVVREVLDIATKKN

SEQ ID NO: 25376 - protein, 55 aa, Artificial Sequence
  Synthetic
DEVRKRLDERAERLEKEVEEVKKENDERAKRSAEEVKKLLDKLDEALRRLEEEVR

SEQ ID NO: 25377 - protein, 61 aa, Artificial Sequence
  Synthetic
SEDDELIKKIKKLAEEIIDEIRKLIEKSKEILKRLLDELRKLIEKSKKLLKETLDKLRKDK

SEQ ID NO: 25378 - protein, 56 aa, Artificial Sequence
  Synthetic
EEALKELEKKTRDLEDEIRKVKDDVKRRHDELKEEIERVLDELRKVLKRLEDEARK

SEQ ID NO: 25379 - protein, 61 aa, Artificial Sequence
  Synthetic
KTEEILKRVKEILDELAKELRDIIRESLRTIEELLDELRRILEESERTLEELVKTIKDEVK

SEQ ID NO: 25380 - protein, 59 aa, Artificial Sequence
  Synthetic
DEVKRRLEEKERRIRTRYEELRRRLRKRVKDYEDKLREIEKKVRRDAERIEEELERAKK

SEQ ID NO: 25381 - protein, 57 aa, Artificial Sequence
  Synthetic
EELEDVLRRIEEVLREIIRLLEEHHDMVRRAVERIKRLLEDHHKKVEDILREIKRRI

SEQ ID NO: 25382 - protein, 59 aa, Artificial Sequence
  Synthetic
EKVKKELKDLARKAEKLSEDVRRELEETVKDLRRKSKEVEDRLDKLTEEIRRTLEEKRR

SEQ ID NO: 25383 - protein, 59 aa, Artificial Sequence
  Synthetic
KDEERLTKTAKESLDHNKELLDRIRKKSKEVLDHNKELLDRIREEIKRLLEELDRLKRE

SEQ ID NO: 25384 - protein, 56 aa, Artificial Sequence
  Synthetic
VEEVIKEVKKMLERALEELREVNDRDRRANERALRILEALNEEDKRATKRVLERKK

SEQ ID NO: 25385 - protein, 60 aa, Artificial Sequence
  Synthetic
REKEELLKLIKRVIELLKRVLEEHLRLVEDVIRRLKELLDSNEKIVREVIEDLKRLLDEV

SEQ ID NO: 25386 - protein, 59 aa, Artificial Sequence
  Synthetic
EDLLRKAKKVITEVREKLKRNLEDVRRVIEDVKRKSRRILEEARRLIEEVERELEKIRK

SEQ ID NO: 25387 - protein, 58 aa, Artificial Sequence
  Synthetic
SKVERILRLIEELLRLLREALRKIHRINEELIRTLEEVLREIHRINEDLNRKLREATG

SEQ ID NO: 25388 - protein, 59 aa, Artificial Sequence
  Synthetic
EELKDRVREELDRSRKKLRKLEEEMRRKLKRSREELKKLEEDLRRELKKLREELERIRR

SEQ ID NO: 25389 - protein, 57 aa, Artificial Sequence
  Synthetic
SRKERIKRALEEHIRKLKEITDEVRKTNEELLELTRRILEEAKKANEELVKKIREAL

SEQ ID NO: 25390 - protein, 56 aa, Artificial Sequence
  Synthetic
EEALKELEEKLDRYRRKLEDLLRKYAKKLEDYKRKVKKLEEENEELLKRIEKEMEK

SEQ ID NO: 25391 - protein, 56 aa, Artificial Sequence
  Synthetic
SEKEELEKRLRKKLEEIKELVERYKRRLEELLRRHREELKEIEKRLEDLERKIEEL

SEQ ID NO: 25392 - protein, 55 aa, Artificial Sequence
  Synthetic
EEVKKIIEELLRLAEEVLRRNKRLIEALLELHEDEFRKVEEIIKELSEEAKRASK

SEQ ID NO: 25393 - protein, 57 aa, Artificial Sequence
  Synthetic
REKEKIREALETNLRLLEELIKRLKEILDTHNELLRRVIETLERLLKELLELLEEAG

SEQ ID NO: 25394 - protein, 56 aa, Artificial Sequence
  Synthetic
KEDLERLRRKVEELEDRLRRLLEKLKRDSDELMRELERILDRYRRESEELDRRLAE

SEQ ID NO: 25395 - protein, 58 aa, Artificial Sequence
  Synthetic
SELERLRKILDDLRKKVERVAEEHKRANDKLAEEIRRVLKTHREMNERAIEEVKRTVG

SEQ ID NO: 25396 - protein, 55 aa, Artificial Sequence
  Synthetic
REVDKRLRELLEEHKKLVDDLDKRARKVHKEHKDKVDKLREELEKTLRDIKRETD

SEQ ID NO: 25397 - protein, 60 aa, Artificial Sequence
  Synthetic
DSDEIVKTLLEKLRRILKEVEEIARENHKRDRDANREINKLVEDIARRLEEVAERLREVI

SEQ ID NO: 25398 - protein, 59 aa, Artificial Sequence
  Synthetic
EKDLRRLRKDIERLKEEVKRALDELRKKYKKIEDDNRRLVERIRRELKKILDELDEKRQ

SEQ ID NO: 25399 - protein, 58 aa, Artificial Sequence
  Synthetic
SEIEKVLEINRRVLKELERIVKKVLDIDKEAAELLRDIIRRVLEIIKKVIDDIIRTRG

SEQ ID NO: 25400 - protein, 59 aa, Artificial Sequence
  Synthetic
KDLEEKLRRVLEELKRLVDDLRRLIDEIKKRYERMVEELKKEIERVLRENEEAVKDLER

SEQ ID NO: 25401 - protein, 59 aa, Artificial Sequence
  Synthetic
SEEEELEKIAREVLRELKEILEELDDIYRRVTDRLRKLLERLKKEYEEVKKELEDLKRR

SEQ ID NO: 25402 - protein, 56 aa, Artificial Sequence
  Synthetic
EELVDRLIKLLDENLKRSEEVIREIIELARKNAEDSRRVIKKIIELLREMLKDARR

SEQ ID NO: 25403 - protein, 62 aa, Artificial Sequence
  Synthetic
DSERELEKVLKDAKEKLDRSLEEVKKVTRETEKRIEEIDKEVKEVLEEADRRVKKIETDKER

SEQ ID NO: 25404 - protein, 56 aa, Artificial Sequence
  Synthetic
ERLIREIKRIIERVIEILKDIAKEILDLDRESVRLDTEVLKKLLDIIREVVKEAKK

SEQ ID NO: 25405 - protein, 62 aa, Artificial Sequence
  Synthetic
DEEREVRKVLRRAEELLRRSLKKAEEVTRETRKRIKELLDELRKVLERAERELRRIRREKER

SEQ ID NO: 25406 - protein, 56 aa, Artificial Sequence
  Synthetic
DRLIEEIKRILEEIIKLIADLARRVLKIDEESVKLDEDNLREVLKILEDVVRDSER

SEQ ID NO: 25407 - protein, 56 aa, Artificial Sequence
  Synthetic
SEEEEIKKDLERLIDKLRRTSKRLIDDYRRVLEELERTIKRLLEELEELIDELRRR

SEQ ID NO: 25408 - protein, 59 aa, Artificial Sequence
  Synthetic
EKVERALERILELLKRVIEELERLAEEVLRLSKRVAEENKKLLEEILRILEEIIRRAKK

SEQ ID NO: 25409 - protein, 62 aa, Artificial Sequence
  Synthetic
SKEEELEKLVRKVEEDLKRLEEESERIKKEIKDTLRKIRKRSEDLKRKVKELLRRLEEEARR

SEQ ID NO: 25410 - protein, 60 aa, Artificial Sequence
  Synthetic
VDEALEMLKRLLDKALKVHEDVLRKLVELVDEVLKVHEESLRKLLTLAKKVLEVLRKITK

SEQ ID NO: 25411 - protein, 60 aa, Artificial Sequence
  Synthetic
DDERRKLEDLERMVEELKRKSDKLLKEIREEVERLERETRKLLEELKRKVDELREDLRRN

SEQ ID NO: 25412 - protein, 55 aa, Artificial Sequence
  Synthetic
EDLEKAERLVKDILRLNEEHTKELEDVVRDLLRKLEKHTRDLEKLVKDALDKVKT

SEQ ID NO: 25413 - protein, 60 aa, Artificial Sequence
  Synthetic
SEKEELLKRLEDVLRRIKERLDELRRRYKKALDELREESKRLIEKLDKVLREIEELIKRK

SEQ ID NO: 25414 - protein, 59 aa, Artificial Sequence
  Synthetic
EEILRLLLELLEESIRVAREVNRLLLRLLEKNKELVEEVLKRLLDLLKKIIDIVREVIT

SEQ ID NO: 25415 - protein, 62 aa, Artificial Sequence
  Synthetic
SKIDEALKKLRKILEDAIKLNKELNDTTREILKEIIKLNREVLEKIRRILKELVDLILKDLK

SEQ ID NO: 25416 - protein, 55 aa, Artificial Sequence
  Synthetic
EELRRVVEKVRKELEDDKERYKRLEEEVRRLLEEMKRRSEDLERKVEEILRRLTE

SEQ ID NO: 25417 - protein, 58 aa, Artificial Sequence
  Synthetic
SEKELLEDLRRKAKEVKDRHEELLRDLERTLKKLKDEHDKKLKDLRDELRRVEKKLDD

SEQ ID NO: 25418 - protein, 55 aa, Artificial Sequence
  Synthetic
KELLKEVKDLLRKLEKVVRDSLELLKRLLEDIEKRVRDSNRELKRILDDIEKKAK

SEQ ID NO: 25419 - protein, 57 aa, Artificial Sequence
  Synthetic
DKEEELLKKLEEVLKKAEDLIRESNKALKELLDEAVKIVEDSLRELERTLRDIERKV

SEQ ID NO: 25420 - protein, 55 aa, Artificial Sequence
  Synthetic
EDLRETEKDLRRLSEEHKRLLEELRDKARRLTERHEKALKEIEDELRKIKDEARR

SEQ ID NO: 25421 - protein, 59 aa, Artificial Sequence
  Synthetic
DEEEKIREDLERTLREYERELRRAKEELKETLKRYEEELREVKEDLDRTLEEVDDLLRR

SEQ ID NO: 25422 - protein, 60 aa, Artificial Sequence
  Synthetic
KKTLLRDLKEALKTLIKLIREILEDNLRVLRRIIELIETLLEDNRRVLEEIIKLIEEATT

SEQ ID NO: 25423 - protein, 59 aa, Artificial Sequence
  Synthetic
STKEEVERIVEELRRAHEKSLRDVKKILDDLAKIHDDSLEDARRIIEKLDRILEEIKDR

SEQ ID NO: 25424 - protein, 56 aa, Artificial Sequence
  Synthetic
DKLLEDVKEEIRKVKERIEDLLRRSRELLERLRKRLDDLLADSERKIDEVTKRTRK

SEQ ID NO: 25425 - protein, 58 aa, Artificial Sequence
  Synthetic
DELEKVERLLEEIEKIIEDLIRRVEELVRRILEFNKTTLKRNEELVRELEKLVEETTG

SEQ ID NO: 25426 - protein, 59 aa, Artificial Sequence
  Synthetic
KEVVRKLEEDLRRVRERSKKLVREHEKFLEDLEETIKEEKRRVDEELKRIKEEIKETRR

SEQ ID NO: 25427 - protein, 56 aa, Artificial Sequence
  Synthetic
SEKERLMRLLDKLKDLNRRLVERIKELLDKALELHKKLVKELRELLERLKELVERA

SEQ ID NO: 25428 - protein, 59 aa, Artificial Sequence
  Synthetic
EETVRRLREALKKLEDDLRKIERDAEREYKKLKDELEELTERYRREIRKLKEELKKDRK

SEQ ID NO: 25429 - protein, 56 aa, Artificial Sequence
  Synthetic
SKREELKELLERLLKLDRDTLEELKRLLDELKKTNDDTLEILKRLLEEVLRVIRET

SEQ ID NO: 25430 - protein, 59 aa, Artificial Sequence
  Synthetic
KDRVREIERRLEELRKRLEKVERDLRDRHRKVKKKLDDVIEKVKRRHDELRKELEDAER

SEQ ID NO: 25431 - protein, 59 aa, Artificial Sequence
  Synthetic
KDEEEVEKEIRRLLEKVKDVLRRSLEELERLLREIKEVLEKLEREDEENIERIKRELER

SEQ ID NO: 25432 - protein, 60 aa, Artificial Sequence
  Synthetic
RETLIREIEKILRRLNELNRRLLREVERILERLLELHKRLLDELLRIAERLMRLVEEVKK

SEQ ID NO: 25433 - protein, 56 aa, Artificial Sequence
  Synthetic
SEAEDLEELIKELAELLKDVIRKLEKINRRLVKILEDIIRRLKEISKEAEEELRKD

SEQ ID NO: 25434 - protein, 59 aa, Artificial Sequence
  Synthetic
KDEAERRRRELKDKLDRLREEHEEVKRRLEEELTRLRETHKKIEKELREALKRVRDRST

SEQ ID NO: 25435 - protein, 57 aa, Artificial Sequence
  Synthetic
DEVEKLKKLLKELEELNREVVDTVKKLLDELVKLNRDVLREVRELLKKLIDALEKTG

SEQ ID NO: 25436 - protein, 59 aa, Artificial Sequence
  Synthetic
EELRRELKKLEEEIERALERIRRRSEETADRIRRTLEKLREKSERKRREIEDTLRKDRK

SEQ ID NO: 25437 - protein, 59 aa, Artificial Sequence
  Synthetic
SLLEKVKKVIERLLEIHKKLLEELKRLIEKVLRITRENLEEVKRLIKRAVEILRRIAEE

SEQ ID NO: 25438 - protein, 60 aa, Artificial Sequence
  Synthetic
EEEVTRKIEELRKKLTKLIRELEETLKEVKKRNEDALRRLEKESKDLAERVRRLIEELEK

SEQ ID NO: 25439 - protein, 60 aa, Artificial Sequence
  Synthetic
SDKEEIKRRVEKTARDLETEHDKIKKRLEDTVRDIKRELDELLEKYERVLRKIEKTLREG

SEQ ID NO: 25440 - protein, 60 aa, Artificial Sequence
  Synthetic
EKRLIEEVVRLLRENLDVVRRILEALAKLIKELLEALEEVLRRNKELIRELLRVLDEALK

SEQ ID NO: 25441 - protein, 60 aa, Artificial Sequence
  Synthetic
DEEERVKKLLTDLRRLLRKLHEESKKLLDELRKKLRELRRRSEEKLREVERRLREAEKKL

SEQ ID NO: 25442 - protein, 59 aa, Artificial Sequence
  Synthetic
EELLRVLEELVRTLKKLLDENLKMVERLIRELEKVLDDHERKVRRLIEELLEVLDRDAK

SEQ ID NO: 25443 - protein, 60 aa, Artificial Sequence
  Synthetic
DEDRIIEEIARLLEELLRELLELIKKLIETNRRLNEEHERAVRELARLLEELLDRLVKKV

SEQ ID NO: 25444 - protein, 59 aa, Artificial Sequence
  Synthetic
EKIKKEIERELEELRRMIKRLHEDLERKLKESEDELREIERRLEEKIRRLEEKLERKRR

SEQ ID NO: 25445 - protein, 59 aa, Artificial Sequence
  Synthetic
STEEKLRELVKRLEELLRDLERLLRELEKSNRDLNETALRLVEESDKLLEELLEKLARN

SEQ ID NO: 25446 - protein, 59 aa, Artificial Sequence
  Synthetic
KDTVKRLKEDLDKARKDHEKKLEDLERLLKRNEERLRKMKKELEDKVERLRRELEKKRK

SEQ ID NO: 25447 - protein, 59 aa, Artificial Sequence
  Synthetic
DEEEKIRTTLDLLRKLLKVLREILEELIRSNKELNERLLRLVEDSDRLLEELLKKLEDD

SEQ ID NO: 25448 - protein, 59 aa, Artificial Sequence
  Synthetic
EEKVRDTEKKLRDLREKHKEIAKELERLLRENRRRLEELKREAKKVLDELRKRLEDERR

SEQ ID NO: 25449 - protein, 59 aa, Artificial Sequence
  Synthetic
SEKEEVEKRLKDLEEESERLLKEVRDTLKRLEEESKKLIDELRRKLEELRKEVKELVDR

SEQ ID NO: 25450 - protein, 56 aa, Artificial Sequence
  Synthetic
DKALTKVVDDVLRVLERVIERLLRLNKESLKELERILEDLRRLNKKTLDVLREVTR

SEQ ID NO: 25451 - protein, 59 aa, Artificial Sequence
  Synthetic
KEKEEVEKKLKEAEEEHRRLNREVEEDLKRAKRESERLLEEMEKKLDELEERVERLLRE

SEQ ID NO: 25452 - protein, 56 aa, Artificial Sequence
  Synthetic
REVLEKLVRDALRTLREVLDRLRRLNEELLEVLRRVLRELERLTRELLKVLRDALK

SEQ ID NO: 25453 - protein, 60 aa, Artificial Sequence
  Synthetic
SEAEEVARRIKELVRELEKLLRDSEETIKRLIDKNRDLLRRIAETIDKLIKDLRDLLRRI

SEQ ID NO: 25454 - protein, 60 aa, Artificial Sequence
  Synthetic
DEDVRRALERVEKLLREILERLKRHSEELAELARRLLDENRRIIEEIIKLIEDILRELKR

SEQ ID NO: 25455 - protein, 61 aa, Artificial Sequence
  Synthetic
DLERLVEELARLLKEALDTLARHSERLIKLAREILETLRRHSERIAELIERILRELMERRG

SEQ ID NO: 25456 - protein, 59 aa, Artificial Sequence
  Synthetic
EELKKKLEDISREIKKSLEEVEERLRRISDDVRRSLEELKRILDEIEREIERRLREAKR

SEQ ID NO: 25457 - protein, 60 aa, Artificial Sequence
  Synthetic
SDEERLRKEIRDRVEELRKRLDDTEEEYDKRIRDLRRKIKEVEDRYREKIKRLEEKLRRG

SEQ ID NO: 25458 - protein, 60 aa, Artificial Sequence
  Synthetic
KDTVLRILKELMDRDEEILRRILKLIKELLDESKKTVRRVLELLKELLRKILKLVEEITR

SEQ ID NO: 25459 - protein, 56 aa, Artificial Sequence
  Synthetic
SKKEILKEVLRRILKLIRELIETIKKVLKRSLDLNKELIDINKEALDRILKLLTDI

SEQ ID NO: 25460 - protein, 59 aa, Artificial Sequence
  Synthetic
KRRLKKLADELKEILDRLREKNKEIADRAKELHDEVRERLKEIAKRLKDVLRDARERVR

SEQ ID NO: 25461 - protein, 60 aa, Artificial Sequence
  Synthetic
REMEEVLKRNLDAARRVLETLKRILDRLKELNERSLRSLRDILRELLDIAREVLDLRRAG

SEQ ID NO: 25462 - protein, 56 aa, Artificial Sequence
  Synthetic
IEKVRKDVEDLAKELEDRLRDVERESRRLLEELRETLERALRRVKELHDELREAIK

SEQ ID NO: 25463 - protein, 56 aa, Artificial Sequence
  Synthetic
SRKEELLRILRRILEIAEEIIRDLKKWLDDDRELVREILELIKRLNEDNNRLIREA

SEQ ID NO: 25464 - protein, 58 aa, Artificial Sequence
  Synthetic
DELRRLEEALKESKRLVEEVLKRIEDVLRESKKLADEIRKKIEDLVRELEEELERVAR

SEQ ID NO: 25465 - protein, 60 aa, Artificial Sequence
  Synthetic
SKEEKKKELEKKAREIKRRLEENKREYKEKVDRLKEELRRLLEEIREKVKRLEERIRRAI

SEQ ID NO: 25466 - protein, 56 aa, Artificial Sequence
  Synthetic
KDLVKELEDVLKELLDLLREILKTVKRVNEDSVRSAEKLIEDLERMIRELLKEARK

SEQ ID NO: 25467 - protein, 56 aa, Artificial Sequence
  Synthetic
DERERIEEDLKRLRDTLDTKEEESRRRIRELEEDLKRKIEESRRRIEKLKRRMEED

SEQ ID NO: 25468 - protein, 55 aa, Artificial Sequence
  Synthetic
EILDRLRKVLEELARRDRKILEDLERAVRELDKLDRDILRTLLRVAEELLRRREK

SEQ ID NO: 25469 - protein, 61 aa, Artificial Sequence
  Synthetic
DKLEEILKLLKEVIKTLLRLSEDLNRLNRELVRTVLELLKRVVELLKRVLEEVRKKVRDAN

SEQ ID NO: 25470 - protein, 59 aa, Artificial Sequence
  Synthetic
DKVERDVRRIKEKIKRILDDLRRRVEELKKKNKEDLEKYDEDIRRLEEEIKRLLEEARR

SEQ ID NO: 25471 - protein, 56 aa, Artificial Sequence
  Synthetic
REEKELLDEIRKRVKESEDRLEKLLRDYEKELRRLEKELRDLKRRIEEKLEELRRR

SEQ ID NO: 25472 - protein, 56 aa, Artificial Sequence
  Synthetic
KDALSRLLEELLRVVDDLIRVLKELIDKSRKVIEELLELLKRINEENLKVLAEIIK

SEQ ID NO: 25473 - protein, 59 aa, Artificial Sequence
  Synthetic
SRKEKLLKESEEEVRRLRRTLEELLRKYREVLERLRKELREIEERVRDVVRRLKEVLDR

SEQ ID NO: 25474 - protein, 56 aa, Artificial Sequence
  Synthetic
ERLVKTLIEDVERVIKRILELITRVAEDNERVLERIIRELTDNLERHLKIVREIVK

SEQ ID NO: 25475 - protein, 61 aa, Artificial Sequence
  Synthetic
SEKEKLREIIKRHLRSVEEVLRLLAKILKDLTDASEENLRLLKELLRRLLEVIRKLVEDVK

SEQ ID NO: 25476 - protein, 56 aa, Artificial Sequence
  Synthetic
EDALRKLKKKLEEIEKTVKDSIDKLRELLEELERRVRKIAEENKRLLEELVREVKK

SEQ ID NO: 25477 - protein, 60 aa, Artificial Sequence
  Synthetic
KDEERLEDELRELTERMREKLKEHEERVRELSKEVKRKAEDSEEKLKKDLKEVEDTLRKK

SEQ ID NO: 25478 - protein, 55 aa, Artificial Sequence
  Synthetic
EELLERIERIIRTSKKLLTEALEIIREIIKRSKDSNRDLHRDLEAILRRIEEAKK

SEQ ID NO: 25479 - protein, 61 aa, Artificial Sequence
  Synthetic
SDEERLVAELERLIEISLRILEELLEVLRRLVEESLRLLEELVKVAEEIIERLLRLLEETV

SEQ ID NO: 25480 - protein, 55 aa, Artificial Sequence
  Synthetic
ERLKKTADEIKKRLDKVRKDSDDLAEEIKRILKRVEDESRDTARKVKKVLEDAKR

SEQ ID NO: 25481 - protein, 59 aa, Artificial Sequence
  Synthetic
SKEDEVLERLKRAIERSIKIVEEIVKRNVETNERSERILRELAETLRRVLDTIRKLLED

SEQ ID NO: 25482 - protein, 56 aa, Artificial Sequence
  Synthetic
EEELKRRLEEIERKLKEVLDRLKKKHDDDNKENKDVLDEVRKRHKELLDKLREKRK

SEQ ID NO: 25483 - protein, 57 aa, Artificial Sequence
  Synthetic
DEEEKVLRILEELLKEHKRVLEELLELVRRIIERHKEVLKRVLKLVEDLIRRIKEAN

SEQ ID NO: 25484 - protein, 56 aa, Artificial Sequence
  Synthetic
EEAAKEVEKRLEEVKTDLRRLARESEETLRRVEERLEELKERSERELKRVEEEIRR

SEQ ID NO: 25485 - protein, 56 aa, Artificial Sequence
  Synthetic
SEEEELKRILDENHESLKDLLREIKEILRANHETVKKLLETIKEILDTVLKILRDV

SEQ ID NO: 25486 - protein, 55 aa, Artificial Sequence
  Synthetic
EELLETLKRLIRELVKRLEKILDDDRKLIDRLVRRLEEILKEDKRRIEEALERLR

SEQ ID NO: 25487 - protein, 60 aa, Artificial Sequence
  Synthetic
SELERAEELIKKLLKLHEDVLRRLTEVDDELLEIHDRVLKRLKEVDDELLKLIRDMLRRA

SEQ ID NO: 25488 - protein, 58 aa, Artificial Sequence
  Synthetic
EEAKDIREKLERLLRKSEELVRKSLKELKELLDKSKKLLEDSKRRLEEILKEIKDDSR

SEQ ID NO: 25489 - protein, 60 aa, Artificial Sequence
  Synthetic
DEEDEVEKLIREAIELNKRILEEIKELIERIVRRNKEILREAKEAIERLIKIARDLTKDK

SEQ ID NO: 25490 - protein, 56 aa, Artificial Sequence
  Synthetic
EEKLERIARELKKLLEEVERRSRKAIEDLKRELKRVMDRSREAERKLRELLKETKR

SEQ ID NO: 25491 - protein, 58 aa, Artificial Sequence
  Synthetic
SEDEVLKKIEDELREVEKKLEDVLREIKRRHDELKKRLDEKLERLRRRHEELKEALDR

SEQ ID NO: 25492 - protein, 60 aa, Artificial Sequence
  Synthetic
EEEVKRDLKRILDRLLEVNTKSIEDLKRILDKLLEVNRRNVDEIRRILDELRKVIERVTK

SEQ ID NO: 25493 - protein, 60 aa, Artificial Sequence
  Synthetic
DETERVKEVLDRSLKLNEDLLRKIDEILKRLFEINKEVIDIIRELLERLVRIAREVLEKN

SEQ ID NO: 25494 - protein, 55 aa, Artificial Sequence
  Synthetic
EEVEKRIKKLLDDLEKVAREIRKKHKELLEELEKVAREVMDAHRRLLEDLKRTDD

SEQ ID NO: 25495 - protein, 59 aa, Artificial Sequence
  Synthetic
SLKEIVKEIIDRASELLKRLLERSEDSLRTASELLRKILEDSRRSLRTIARLLEELLRT

SEQ ID NO: 25496 - protein, 55 aa, Artificial Sequence
  Synthetic
REIEKEIRRILEELKRKHDEIEKKIRELEREIKRKHEELEDRIRKIERDLDRRTK

SEQ ID NO: 25497 - protein, 58 aa, Artificial Sequence
  Synthetic
SLRELVEKILRDAAKLIERLLKLSEEVLKRIEELLEELLRLSERSLRELLRLLEELLR

SEQ ID NO: 25498 - protein, 55 aa, Artificial Sequence
  Synthetic
KDIKKELDDIVRDVKRKHDKLREELKKIVEDAERAHRDIDRKIREILKELKERTD

SEQ ID NO: 25499 - protein, 57 aa, Artificial Sequence
  Synthetic
REEELRKKIEDELRDLKRKLEDLLRRYEEKLREAEKKLKDLLRRYEERVREIKKELS

SEQ ID NO: 25500 - protein, 60 aa, Artificial Sequence
  Synthetic
EDELLRVLEKVIEDNLRIVEELIRRLEEVLKRHEDLVRTLLDLLKRVLEAVKKLLDEAVT

SEQ ID NO: 25501 - protein, 60 aa, Artificial Sequence
  Synthetic
SSEELLKRIVDEDERVLEEWRRVLEEIKDLSKRVVDLLDKVLKEIEKIVDEVTRRLERDG

SEQ ID NO: 25502 - protein, 55 aa, Artificial Sequence
  Synthetic
KDLLETIKKRVEEIRRTLEKIKRDYDKAIEEIRRKLERKLEEYKEVIDDLRRKTK

SEQ ID NO: 25503 - protein, 59 aa, Artificial Sequence
  Synthetic
SSDELLEEIIKEIARLIEELLEILRENLERSEESLRRVLRAIDDNLRRVERLIEALARG

SEQ ID NO: 25504 - protein, 56 aa, Artificial Sequence
  Synthetic
KKAMDEELEKIRRDHERLKKEIEDRLRELKDKHRRAFEELKKMLDDIKRKVDEAKR

SEQ ID NO: 25505 - protein, 59 aa, Artificial Sequence
  Synthetic
DEEEILREILRVAEELSRLNEEVNKRVLEVLERLSRMNEKLLKEVKDVVDRLIELRRRK

SEQ ID NO: 25506 - protein, 60 aa, Artificial Sequence
  Synthetic
DKEVKRRIEKALRDIEELIERILRRNEEVKREIERLDEENRRRNKEALERIRRLIEETKR

SEQ ID NO: 25507 - protein, 59 aa, Artificial Sequence
  Synthetic
KDEEELKRRVEKVIRDLERKLKDLEEDHRRVLEELKRELEETKRRLDKVIEEIERVLRR

SEQ ID NO: 25508 - protein, 60 aa, Artificial Sequence
  Synthetic
KERLIRVLEEILRLVLRLHEEVVRLVRRLLEESHRILRKIVELLREILEDLKKILDDIRR

SEQ ID NO: 25509 - protein, 56 aa, Artificial Sequence
  Synthetic
DEEDEIRKRLKELLDDVKRRLDELRRESERLLKEVDDLLRESKKRLEDEKKKLEER

SEQ ID NO: 25510 - protein, 55 aa, Artificial Sequence
  Synthetic
KEVLERLEKIVRRNEEVNDEVRELVTRLNETSNRAARELLELAKRIIEEIKKAVK

SEQ ID NO: 25511 - protein, 57 aa, Artificial Sequence
  Synthetic
SKLETIKELLERLHELNERAVRELKKTLEDLHRDNARLIEELIRKNERLLEALREKV

SEQ ID NO: 25512 - protein, 55 aa, Artificial Sequence
  Synthetic
EDADRDVKRLKEESEELLRRSKKRADDLKREVERLLEESRRRLDELLKELKDRSK

SEQ ID NO: 25513 - protein, 61 aa, Artificial Sequence
  Synthetic
SRLEEIKKLLEKVMELIRRIAEELLRINEKVLEVLERIVRTILRLNEEHLKDVRDIARKLK

SEQ ID NO: 25514 - protein, 55 aa, Artificial Sequence
  Synthetic
TEIRKRLKELRDKNEELKKKVEEMIRRLEEESKKTKKRVEEILKRIEEEVREKAR

SEQ ID NO: 25515 - protein, 57 aa, Artificial Sequence
  Synthetic
SREETLRERIERIKRKSEEDVERIKRTLDREREENEETVRRIKETVDRLREEVEREL

SEQ ID NO: 25516 - protein, 58 aa, Artificial Sequence
  Synthetic
RELDRVEEIIRRIVKKLEEILRDLKRRAEDHIRRLTELIERSLKIVRDLAEDIRRAIE

SEQ ID NO: 25517 - protein, 59 aa, Artificial Sequence
  Synthetic
DADELLRRLAEEVERVIREAEDLLRRWKETIKKVLDDLKRLLDELKKRNEDVIRELTKT

SEQ ID NO: 25518 - protein, 56 aa, Artificial Sequence
  Synthetic
KDDLEDILRKNLDRLRKLLERLREILRENLEALKKTLKRLEDVVREILEDLKRERK

SEQ ID NO: 25519 - protein, 59 aa, Artificial Sequence
  Synthetic
TEKELLEELEEDVKRVIEELERLLREWKEELRRVLEESERLLRELRERNKRELEDIRRI

SEQ ID NO: 25520 - protein, 56 aa, Artificial Sequence
  Synthetic
LEEVTRILERNLKELERNLRDLDRTVKTNERLLRELLKKLRDIVRTILELLERKTK

SEQ ID NO: 25521 - protein, 57 aa, Artificial Sequence
  Synthetic
SEKEDVRRKLEEDREKHERDLRRIEEELRRTIEESERRLKEVKKRLKELIDDVRRRD

SEQ ID NO: 25522 - protein, 60 aa, Artificial Sequence
  Synthetic
KEELKKAVETILEELVRIADKLIDIHREILEKLLRVAEKLLEVSRRALDKLKKLIDKTDK

SEQ ID NO: 25523 - protein, 56 aa, Artificial Sequence
  Synthetic
DKAEVLREALKLLKDLLEELIKIHEESLKRILDLIDTLVKVHEDALRKLKELLERS

SEQ ID NO: 25524 - protein, 55 aa, Artificial Sequence
  Synthetic
EEIDRELKRVVEELRRLHEEIKERLDDVARRSEEELRRIIKKLKEVVKEIRKKLK

SEQ ID NO: 25525 - protein, 59 aa, Artificial Sequence
  Synthetic
REKEEIERTLEELKRILDELVKDDKKSLDRLREIMERSVRIAEETLRKLRETLELKARG

SEQ ID NO: 25526 - protein, 56 aa, Artificial Sequence
  Synthetic
KDEVLKRLDDLIKEWRDVLEKLLRDLRELLERSKKRLRKVREDLKRLLEELERRAD

SEQ ID NO: 25527 - protein, 56 aa, Artificial Sequence
  Synthetic
STREKAKKVLDTLRRDNEDMKRVVEKILRALKRTNERAEKLAREITEEIKRILKEV

SEQ ID NO: 25528 - protein, 56 aa, Artificial Sequence
  Synthetic
EDLLRKLEEELRRIKEKLRKALEELEREHRELEKELDKLHDESRKEHERIEEELRR

SEQ ID NO: 25529 - protein, 60 aa, Artificial Sequence
  Synthetic
DKERVLEDVKRRAKELEELLKEVEDRYEEDLRRIEETLKDTERRYREKLEKIKEELKRTV

SEQ ID NO: 25530 - protein, 59 aa, Artificial Sequence
  Synthetic
EKIKRIVEKIIKEHRDVLERLKRIIEEITRSDRESLERLKEILKELIRILKELADRERK

SEQ ID NO: 25531 - protein, 60 aa, Artificial Sequence
  Synthetic
KSEDVVRELIKLHRELNDKARKVIETILERNRELVETAERVIRRLIKLLEDALRILKKSS

SEQ ID NO: 25532 - protein, 56 aa, Artificial Sequence
  Synthetic
EEELRRLEEEIRDIVRRLRKRVEEYRKELEDLEKELADEVKKYEDEVKRIREELRK

SEQ ID NO: 25533 - protein, 60 aa, Artificial Sequence
  Synthetic
STEELLREIEEIIRRILEIADKTSKEWADLIKRILELIKRNLEELRKLVREVLEEVRKEG

SEQ ID NO: 25534 - protein, 56 aa, Artificial Sequence
  Synthetic
KDTIDKLRKRLKEIKDRTKELLDRIREEIRELRERNKEIVKDIERRLRELKDRIRK

SEQ ID NO: 25535 - protein, 57 aa, Artificial Sequence
  Synthetic
SKKELVREVVKELHELNKDVLRVLTEIVERVKELDKRVLEVLRRIVEEVERLAKEAG

SEQ ID NO: 25536 - protein, 59 aa, Artificial Sequence
  Synthetic
KDRLREIEERVRKILEEIDKLLDDLRKAYDRILERIERLVRELSRKHKEVADKITELVK

SEQ ID NO: 25537 - protein, 60 aa, Artificial Sequence
  Synthetic
SEDERVTRLKEELERLLDELRKRYEKLREEIRRVLEDLKKKYDELKEELDKMLRDLERRG

SEQ ID NO: 25538 - protein, 55 aa, Artificial Sequence
  Synthetic
EELLRELERVSREDERLVKEAADELRRILDTDRKLLKEVVDTLERVLRRILKETR

SEQ ID NO: 25539 - protein, 61 aa, Artificial Sequence
  Synthetic
SEEERVEELLRRIEKLLKESEEDVERLKKRHEEENRRLKEEVKRLMDELREILRRLEEETG

SEQ ID NO: 25540 - protein, 58 aa, Artificial Sequence
  Synthetic
KDVDKLVEVLDRVLRRVRELLEELAETNRESIRRYERLSEKNAELVTEIIERLRRTVK

SEQ ID NO: 25541 - protein, 56 aa, Artificial Sequence
  Synthetic
SKMEKLLKDLREALEKVKRRYEELERRLDEVLKEHEEIVKRLLEELEKVLKRIEEG

SEQ ID NO: 25542 - protein, 59 aa, Artificial Sequence
  Synthetic
ERVEELIERLIRIIERLLREVIKSHEKLVRTIERLIEESIRVNEELLEVIERLLDRARK

SEQ ID NO: 25543 - protein, 57 aa, Artificial Sequence
  Synthetic
DLERVVEDIVDKAKRLLDKNLEVLKRIVDEVLRLLERLLRESRKVVKRVKEIIEELV

SEQ ID NO: 25544 - protein, 59 aa, Artificial Sequence
  Synthetic
KDLLTELEKKLRKLKRDSEKVVDDLKKELERIKREVKRLIEENRRTLKDIKRAVDEARK

SEQ ID NO: 25545 - protein, 57 aa, Artificial Sequence
  Synthetic
DEDELVEEIERRLREIEKRLRDVMEESKRRLEEILRELKRIIDESRKRLDDLRRRLK

SEQ ID NO: 25546 - protein, 59 aa, Artificial Sequence
  Synthetic
ERIEKILEEILRLSRESLRKLKKILEELLKVSEDSLRDLIRILEDLLRLLKDLLEKLKK

SEQ ID NO: 25547 - protein, 59 aa, Artificial Sequence
  Synthetic
SEDEELEDLKRKLRRALERYEDRLREIKRRLDEKLKEIKRDYDRLKKELDDLLREIERR

SEQ ID NO: 25548 - protein, 55 aa, Artificial Sequence
  Synthetic
EVVKELLDLVREIIKRLKEIHEEILRLIETVLEDLERANRRLLDLARKILEDARK

SEQ ID NO: 25549 - protein, 60 aa, Artificial Sequence
  Synthetic
SKEEKLEDLIRRIKERLEEALRRNKKTADEIRKELKKATDRNRKRAKELRERLREVLRRT

SEQ ID NO: 25550 - protein, 55 aa, Artificial Sequence
  Synthetic
EVVEELLRLLEELLEHNREVIEKLVDLIRELLRHDKEVTEEILRLIEELLKEVEK

SEQ ID NO: 25551 - protein, 56 aa, Artificial Sequence
  Synthetic
SERELIERWLELHKEILRLIRELVERLLKLHREILDTIKKLIRELLELLEDIARKL

SEQ ID NO: 25552 - protein, 59 aa, Artificial Sequence
  Synthetic
DDERRTLTELLKRMEDILEKVERTLKKLLDDSKRMAEEVKKTLKELLERSEKVAEDVRK

SEQ ID NO: 25553 - protein, 60 aa, Artificial Sequence
  Synthetic
SEDELIRRIREELKRLEKEHEDMVRELEKKHKKLKEELDRAIEEIERRLRELKERVEREG

SEQ ID NO: 25554 - protein, 55 aa, Artificial Sequence
  Synthetic
DELVKEIKRLLEELLRLLERLVRSSRRLNEELLRLSEKLIRDAERLARELLEAAR

SEQ ID NO: 25555 - protein, 56 aa, Artificial Sequence
  Synthetic
KKEEDLRREVEEVKEEIRELIERSRESVRRILKEIKDLIRKSKESIDKILEDLKRK

SEQ ID NO: 25556 - protein, 59 aa, Artificial Sequence
  Synthetic
EEVLRVVEELLKLLKEHLEENVRILRRILELLRRHHDTNRKIVKRILELLRRVLESIRK

SEQ ID NO: 25557 - protein, 60 aa, Artificial Sequence
  Synthetic
SVEEILRELLRVLEEILKRIADINEKLLRVSRKIVEDLKRLLDEALRVLRRAVEEIEKEG

SEQ ID NO: 25558 - protein, 58 aa, Artificial Sequence
  Synthetic
ERLREILEELERVLEKVMRDLRRILREYEEVLKEAREEYRKILEELRKVLKEVDDRLR

SEQ ID NO: 25559 - protein, 57 aa, Artificial Sequence
  Synthetic
SELEKIDRLLEKVLRENKRALDELVRLLEELIKTNRDALEKLREINERNIERLREEV

SEQ ID NO: 25560 - protein, 59 aa, Artificial Sequence
  Synthetic
KKVLEDLERHLEESKKTVERLVRELRKTHRKVEEDVKRLIEELRRLHEELRKRLEDDDR

SEQ ID NO: 25561 - protein, 56 aa, Artificial Sequence
  Synthetic
REKEELIKLIRDILEKLREHSRTIVELLETILRVVREHSKRIEKLLRELLDILRRQ

SEQ ID NO: 25562 - protein, 60 aa, Artificial Sequence
  Synthetic
EKEVEDLLRKAVEDIEKLIRENEKLLEDVLRTIRKLIRENEELLRDIVEKIKRLADEARK

SEQ ID NO: 25563 - protein, 59 aa, Artificial Sequence
  Synthetic
SEEEEVKKVVDEIKKVLDELRKANEDSARRLREVLEELRKRNEESKKEVKDLLEELKRV

SEQ ID NO: 25564 - protein, 60 aa, Artificial Sequence
  Synthetic
TDTKVKELIEIVDELLEIDDRILEEIERTVRKVIDLNRKVLEDIEELVKEAIKVLEEIAK

SEQ ID NO: 25565 - protein, 59 aa, Artificial Sequence
  Synthetic
DEEEELRELKERIERTIEKLKEDTKKLKKELEDRIRELKRKTKELLDDMKRLIKEVKDK

SEQ ID NO: 25566 - protein, 55 aa, Artificial Sequence
  Synthetic
EDIIRLVRDLIRLNREHLRDLEEAVREIIKLLREHLERLERVVDRMIRELRKAAK

SEQ ID NO: 25567 - protein, 57 aa, Artificial Sequence
  Synthetic
SEEEELDKLRRELEELAKESTREVKELLRELREMLERHKKRLKEIKDKLDEDIKRED

SEQ ID NO: 25568 - protein, 58 aa, Artificial Sequence
  Synthetic
DELERLKDLLRTLIKKLEDLLENLRRLVERVIESLRRLVEKDEEINKRTIKELRRAIE

SEQ ID NO: 25569 - protein, 60 aa, Artificial Sequence
  Synthetic
DEERIVDKILKVIRESAEALRKIVEDVLRVLEELMRRHKKNVEELDTIVEDLLRKVRERV

SEQ ID NO: 25570 - protein, 56 aa, Artificial Sequence
  Synthetic
EEVLREARRRIREVERHNKKVHDDARKRLRDLVEELKRLHRELEEKLRRIIEEIDR

SEQ ID NO: 25571 - protein, 61 aa, Artificial Sequence
  Synthetic
SEDEKVRKLLRDLAEEIKRLLETYDRKLKEIAKRIEDTLREYRERLEELKRRLEELVRKKN

SEQ ID NO: 25572 - protein, 59 aa, Artificial Sequence
  Synthetic
EELVREIRRTLETILRLNEELLKRIRDVLREIIELNREVIERLREILERLADLIRRRAE

SEQ ID NO: 25573 - protein, 60 aa, Artificial Sequence
  Synthetic
SELEKLARLLEEILELLRELHRKTAEALKEILELLDRHLDDLRRAVKEILEDLDKDLEDE

SEQ ID NO: 25574 - protein, 56 aa, Artificial Sequence
  Synthetic
DDKAKKVREKLEELLRRLKEKNDDLRRKLERLARELEKLHEEVKKRLKELEDEARR

SEQ ID NO: 25575 - protein, 60 aa, Artificial Sequence
  Synthetic
RELEKLAEVLERIVRALETHLKLIADVLREILRLLDEHLKIIKKVVRDILRELDEVLRRR

SEQ ID NO: 25576 - protein, 56 aa, Artificial Sequence
  Synthetic
SDTLEKLRRRLEDRRRKLKEANDRVREVLDRLRKELEEIDKRLEDVLKKLREDLER

SEQ ID NO: 25577 - protein, 60 aa, Artificial Sequence
  Synthetic
SKKELLEEVVRRAIELLKRHLEKLKRILEEIVRLLEEHLEKVERVLEAILRLLDDLLRRV

SEQ ID NO: 25578 - protein, 56 aa, Artificial Sequence
  Synthetic
KDKLKEIEDELRRLLEELRRLDKKIKDRLRELKKDLDEANRRIKETLKKLLREVEK

SEQ ID NO: 25579 - protein, 56 aa, Artificial Sequence
  Synthetic
SDLEELEKLIRRLLKINEDLIRIIEDLIRKSLTLLKRIVDLIRELIREIEEIIRRT

SEQ ID NO: 25580 - protein, 55 aa, Artificial Sequence
  Synthetic
EEIRKRVRDLEEKVKKLLRDLEEESRRVAEKVEEDLKRVEEESRRTAREVEEKER

SEQ ID NO: 25581 - protein, 60 aa, Artificial Sequence
  Synthetic
SKEERADELLKDLERKVDKLRREHEELLKELKRKVDELRKEHKKLLDTLREEVRRIEEKV

SEQ ID NO: 25582 - protein, 59 aa, Artificial Sequence
  Synthetic
EDVLREITRLLEKAKRIIEESLREITELVKEIEKIIKESLDAARRLLEEIKKILEELAR

SEQ ID NO: 25583 - protein, 59 aa, Artificial Sequence
  Synthetic
SIEELARKLVKENRRLATEANKILKDIVKTNRDSIRKVREILKELVERLRDLIRKVRRD

SEQ ID NO: 25584 - protein, 55 aa, Artificial Sequence
  Synthetic
EDLKRELERAKRELERLLRELDEEHERMKKKVKDEIRRLKKESEEVKKEVKDTED

SEQ ID NO: 25585 - protein, 59 aa, Artificial Sequence
  Synthetic
DEEEITRKLEETIRRLEEEIDKIIKDLLRMLEENNKEIKKVIEKVLETSRRILSALARN

SEQ ID NO: 25586 - protein, 56 aa, Artificial Sequence
  Synthetic
EEVLREAEKRIRDSAEEVKRILEEHKERLRELVKKLERVKETVRKKIEELREEAKR

SEQ ID NO: 25587 - protein, 56 aa, Artificial Sequence
  Synthetic
SELEKDLKDAEEIIKELEEINKRLLEEIRRIVERITKINRDLLETVKRLIEELIKE

SEQ ID NO: 25588 - protein, 56 aa, Artificial Sequence
  Synthetic
EERLKEIEERIRRTEEDVKRKHDDVRRELDEEDDRYKRELDKVRKKLKEKADRIRD

SEQ ID NO: 25589 - protein, 56 aa, Artificial Sequence
  Synthetic
SKLEDLLRKVEEIIKEIERINEELLKRVAEIVETLLRENKKLLEEIKEILKRLIED

SEQ ID NO: 25590 - protein, 56 aa, Artificial Sequence
  Synthetic
ERKLDKIRKDLERVVREYEEKLKEVRKRLRELVERVKEKHKRIEEELRKTAKEVRD

SEQ ID NO: 25591 - protein, 59 aa, Artificial Sequence
  Synthetic
SSKELVEKLKELIKDHLRVADEVIKKLEELIRRHLRKVEEIARRLEELIRELADELRRA

SEQ ID NO: 25592 - protein, 55 aa, Artificial Sequence
  Synthetic
RRLDRLEEKVEKDLRKLARELEDVNRRLEEELRRLEKRSEDLNRRIREEIKKDAK

SEQ ID NO: 25593 - protein, 61 aa, Artificial Sequence
  Synthetic
KDDEILRKLLEILERLLKLSEEVLRELLRLLEELLRLSKESLKRLSRLLEEALKTLVEEEG

SEQ ID NO: 25594 - protein, 59 aa, Artificial Sequence
  Synthetic
ERLKAVVDRIEKAIKKVTEDSRRLVKRIETELRELVKRSKDLAREVEKRLKEVVEEAKR

SEQ ID NO: 25595 - protein, 59 aa, Artificial Sequence
  Synthetic
SDLERILDKVTKLAEDAKKLAKKSVDLHRDNIRRLKTTLKRILESLRKAIKRLKDALRR

SEQ ID NO: 25596 - protein, 55 aa, Artificial Sequence
  Synthetic
EELEELKRDLDRLFEKIRTDLKRLRDTNRKLFDDLRKEHEAVEDKVRRVAEELTK

SEQ ID NO: 25597 - protein, 56 aa, Artificial Sequence
  Synthetic
SEEDLVREVLRAIKRILELLTTLSKENLEVVKRIIEDLERVARENLRVIEEIIKKI

SEQ ID NO: 25598 - protein, 56 aa, Artificial Sequence
  Synthetic
ERIIEEIRRTATEVLKRNEAVVKKIRELIKRVTERNRKVLEEIKELVKRIKDELRR

SEQ ID NO: 25599 - protein, 56 aa, Artificial Sequence
  Synthetic
DKEREIDDIAEKLRRKYKKLREDLDRIEEELRERYERLKRKLDELARRLTKKARDE

SEQ ID NO: 25600 - protein, 55 aa, Artificial Sequence
  Synthetic
ERLEELLKEVVETLRRLLEELKRLSEEVLKKAKEVIDRIRRLSEEVVKSLRDAAK

SEQ ID NO: 25601 - protein, 61 aa, Artificial Sequence
  Synthetic
SEEEELDKLLKEYERVVREIEEKLDRVKRDIERLVEEITRDLRRVLEEYRKVVEELAKDEG

SEQ ID NO: 25602 - protein, 58 aa, Artificial Sequence
  Synthetic
DTARRIERLSREVIKKLEKALKELEDLVREVLRRLKEAVEEIHKLSRDVIKMLTDATR

SEQ ID NO: 25603 - protein, 59 aa, Artificial Sequence
  Synthetic
DDEERLKKVKEEIEEKAKRLKEDLERALKRYEDIIKKLEDDNRKVLERIRRKVEELKKN

SEQ ID NO: 25604 - protein, 60 aa, Artificial Sequence
  Synthetic
DELIRKALEELLRIAEEILRRDLRLLEENRRVVKESLDVLAELLERLLELLERILREVRK

SEQ ID NO: 25605 - protein, 60 aa, Artificial Sequence
  Synthetic
SERDVLRELLERIKKLLETLIRIVEELVRRSEETIKRLAELNRRLIEEIRRIVEEVKKDV

SEQ ID NO: 25606 - protein, 55 aa, Artificial Sequence
  Synthetic
EEVKKRVEELRREYRETLKRLRDESEKIAEELKRLLDELRRRLEELARELRERTK

SEQ ID NO: 25607 - protein, 58 aa, Artificial Sequence
  Synthetic
TEEEIIKEIVKLLRDLARLHEEVDRTNKRLLDELVRLHREVDERLTRLAEDLIRLAEK

SEQ ID NO: 25608 - protein, 56 aa, Artificial Sequence
  Synthetic
RKDLRKVVEELRRRIEELNRRHDKLAEDLRREIEELNKEHKRMLRELEKKIEDDRR

SEQ ID NO: 25609 - protein, 57 aa, Artificial Sequence
  Synthetic
DAEEILKEIHEIDKRTIDEIRKILKKLLEADKKSIDDIRRILKKLLEIVKRLIDLLR

SEQ ID NO: 25610 - protein, 56 aa, Artificial Sequence
  Synthetic
DKTLKKILDELRRKVKETDDRLRKLHEDLKRKVKELIDRLERLNEDIARLLKETRD

SEQ ID NO: 25611 - protein, 57 aa, Artificial Sequence
  Synthetic
KTEELLRELIKVLKETLDRLKRVLEKLAETNDKSLKELLKLLEELLKAIRDVLRRIL

SEQ ID NO: 25612 - protein, 55 aa, Artificial Sequence
  Synthetic
DEVVEELEKVARELADKLRRVLKESEDVVKRVKDELREVLDRSKKVLEELKKKRK

SEQ ID NO: 25613 - protein, 58 aa, Artificial Sequence
  Synthetic
SKEELVKEIDELNKRVNDLLEELLRKSEKLHKEILELLERLLREIIKLLRRILEIVER

SEQ ID NO: 25614 - protein, 56 aa, Artificial Sequence
  Synthetic
EDELRRLLEDIERKIERLLRELKKESEEIRKRIRELLEDNRDKSRKIKKAIEELKK

SEQ ID NO: 25615 - protein, 56 aa, Artificial Sequence
  Synthetic
KLEDAARIAAKAAEEWAEAHKRAAKINAEASEEWAKAHREAAKIAAEAAKRAADEA

SEQ ID NO: 25616 - protein, 55 aa, Artificial Sequence
  Synthetic
EDALRVIEKAAEDAERAAKESLDVAERALRESEKAAKESLEVLERALRDAKRAAD

SEQ ID NO: 25617 - protein, 55 aa, Artificial Sequence
  Synthetic
SALETAAKLAKEAADRWLEASKRAAELAKDAADKWLDASRRAAELAKKAAKEALD

SEQ ID NO: 25618 - protein, 60 aa, Artificial Sequence
  Synthetic
DTDLKRRAAKAAEDIKKAADELLKKSEDAAREIKEAADKLLEDSKRAAEEIKRAADEITR

SEQ ID NO: 25619 - protein, 57 aa, Artificial Sequence
  Synthetic
DEAEKLAKEAREAIKRYADASEKIAKEAREAIKKYLEASKRIAKELREALKELARRL

SEQ ID NO: 25620 - protein, 56 aa, Artificial Sequence
  Synthetic
KDAVREADEAAERAREKLERLSREAKKAAKDAKDKLKRLSDEAKKVARRLIEELKR

SEQ ID NO: 25621 - protein, 58 aa, Artificial Sequence
  Synthetic
SKDEKAIEALKRAADETRKAAEKSADAARRAAEKSEKAAREAAEALKRAVEEAARALG

SEQ ID NO: 25622 - protein, 55 aa, Artificial Sequence
  Synthetic
EAVLRAAEKAIKAAEEAARANKKAADEAIRANEEAAEANKRAADKAIKAIRDAAR

SEQ ID NO: 25623 - protein, 58 aa, Artificial Sequence
  Synthetic
DREDAARRVEKAAREIAEKNKKAARDIKELAKEAIKRTKEAAERVKRAAKRIAEAAEE

SEQ ID NO: 25624 - protein, 56 aa, Artificial Sequence
  Synthetic
KDAVKRALEELARAAEEAARADAEAAKKLAEAAERAARANIKALRDLAKAAKDAAR

SEQ ID NO: 25625 - protein, 60 aa, Artificial Sequence
  Synthetic
REEEAAREAAEAARRAAEIAIKANEEAARAAKRAAEISIKASEDAARAAEEAAKEAARSN

SEQ ID NO: 25626 - protein, 59 aa, Artificial Sequence
  Synthetic
EDALRRAKKAIEDAIKVLKEALDKSAKAIEEAIRVAKEANERSAKAIKDAIEVAERAAR

SEQ ID NO: 25627 - protein, 59 aa, Artificial Sequence
  Synthetic
SEAETLVERLKRLSERDERAARRLVEELKRLAEEDKRAAEELARRLEELARRAEDVARA

SEQ ID NO: 25628 - protein, 116 aa, Artificial Sequence
  Synthetic
EEAARAIKLAREAAKRAIDASKESADAAERAAKEAIKASKRSAELAEEAAREAIKALKDAAEEAAKRLRRAAEEALKINKRANEELERAAREALDLNRRANEDLEKAAEDALRTAK

SEQ ID NO: 25629 - protein, 59 aa, Artificial Sequence
  Synthetic
REAEELVKRLKELAEKDRRAAKRLVEEAEKIIRRARELSKKTVKKLEDLIERAKRLADA

SEQ ID NO: 25630 - protein, 56 aa, Artificial Sequence
  Synthetic
AEDAARRAEEAARRALKINEDAAREAERAAREALKINDEANKRLEEAARRALETAR

SEQ ID NO: 25631 - protein, 60 aa, Artificial Sequence
  Synthetic
KELEEILKTVEDLVRRAKELLRRIHEINRESIEDIRRLLKEIHDTNKRSIEKVDELLKRK

SEQ ID NO: 25632 - protein, 56 aa, Artificial Sequence
  Synthetic
ETEIRKILKESNDRLTEVIKEVEKVLRESDELLRDALKKIVDVLREVLKRLEDTVR

SEQ ID NO: 25633 - protein, 59 aa, Artificial Sequence
  Synthetic
EKEKEIKDAEDEARKAAEESKRKIDKADEDAKKALEELERSIREADKDAKRALDEERRE

SEQ ID NO: 25634 - protein, 57 aa, Artificial Sequence
  Synthetic
REDAARIAAKAAKDALKANEEAARILARAAKEALKILEDATRILKEAADRALDILRK

SEQ ID NO: 25635 - protein, 60 aa, Artificial Sequence
  Synthetic
SEVEEIEKVARRNLELIKRLLEKAERVAKKSLDLIKKAADDARRIAEETLKLIREAAEAG

SEQ ID NO: 25636 - protein, 62 aa, Artificial Sequence
  Synthetic
KEAEDLLREAAKRAEELIRRAEEAAKRLKEEWERLIRELKRALEEYAKEAKKLIKELEDRTR

SEQ ID NO: 25637 - protein, 62 aa, Artificial Sequence
  Synthetic
SKREEAEKAARRAEKLAREAREAARRSLERAKDLARRHEKLSRELLEEAKRLAEEVKETAKK

SEQ ID NO: 25638 - protein, 56 aa, Artificial Sequence
  Synthetic
IDEALKALKRAADLSADANRRALEALEKAARLSARAAEEALEALRRAAELARRAAE

SEQ ID NO: 25639 - protein, 57 aa, Artificial Sequence
  Synthetic
SAEDIIRESEKADKDALDEWRRLIKKLEDLIEELLKENERLIRKLEELIKKALEADK

SEQ ID NO: 25640 - protein, 56 aa, Artificial Sequence
  Synthetic
GEEAAERAKRAADEAKKASDEAAKEAREAAERALRAAEEAAKEAEKANRDALRSAK

SEQ ID NO: 25641 - protein, 61 aa, Artificial Sequence
  Synthetic
SEDEELAKEAKRAVEEAKKRLEDLLRRAEEAHRRAKKELDELARRAEEAHKKAKRDIDRDA

SEQ ID NO: 25642 - protein, 62 aa, Artificial Sequence
  Synthetic
EEIVRRADELAKRAEELNRRLAEEADKIAKKAKDLNERLLREARDIARRAKELIKRLLDARR

SEQ ID NO: 25643 - protein, 56 aa, Artificial Sequence
  Synthetic
SKAERVVDEARKTDEEVLREAEKVNRKVEEVIRRVLKRNEDVNREIARAIERVLRG

SEQ ID NO: 25644 - protein, 59 aa, Artificial Sequence
  Synthetic
EEVLRTAEEVVREALRLVTDAHRVNEEVIRDVLRLVERVHRVYEEVNRRNDELLKELTD

SEQ ID NO: 25645 - protein, 58 aa, Artificial Sequence
  Synthetic
KDEERLREILKKYKEDSERILREVREILERYRRAIEEILKRLEDILRKLEEDVRRELK

SEQ ID NO: 25646 - protein, 55 aa, Artificial Sequence
  Synthetic
TKALKTVRDVLELLRKILEEVRRLNEKLLEELKRLLDEVVEKNERLIKLLEKDAE

SEQ ID NO: 25647 - protein, 57 aa, Artificial Sequence
  Synthetic
DELETLEDVLRKIEDLLRRWLEKLEETLKRIIRLLETSLKLLEESIRRILRILERDV

SEQ ID NO: 25648 - protein, 58 aa, Artificial Sequence
  Synthetic
KKVRDVLREIEELLERHKRLLEKLARELRELAKRHREEIKKVLETLKKLAEELTRRVR

SEQ ID NO: 25649 - protein, 60 aa, Artificial Sequence
  Synthetic
SEKEELRRELEEHAKRSRDTVKRLEDENRRVLESLKRKVDTLRRINEETLREIRRLAREE

SEQ ID NO: 25650 - protein, 55 aa, Artificial Sequence
  Synthetic
EKLKRDLEDLKRKHDELRKRLKEELDELRRKHEKIKEELDRHLKELEDKLREARR

SEQ ID NO: 25651 - protein, 60 aa, Artificial Sequence
  Synthetic
SEKEKLTEILRRHERESERVVKELDEENKRHLKKSREIADTLRKLNEETLERIRELVKRA

SEQ ID NO: 25652 - protein, 55 aa, Artificial Sequence
  Synthetic
ETLKRELERLKEEHERLKEELDRHLKALEEKHREIRREIDEHLKELKRRLDEERR

SEQ ID NO: 25653 - protein, 60 aa, Artificial Sequence
  Synthetic
SEKEKLIEDLRRILKETEERLKRVKERLRELLDEYRRRSEDKLRELKKELEEEEEKIRRS

SEQ ID NO: 25654 - protein, 62 aa, Artificial Sequence
  Synthetic
DRLRKRIKETADRLREMLKRHRELLERSMELLRRALEEAKKVLDETEETARRLLKLAEDEER

SEQ ID NO: 25655 - protein, 60 aa, Artificial Sequence
  Synthetic
KEIEETLKELEDLNREMVETNRRVLEETRRLNKETVDRVKATLDELRKMLKKLVDDVRKE

SEQ ID NO: 25656 - protein, 55 aa, Artificial Sequence
  Synthetic
KKVEELEKALEEIKRRLKEVIDRYEDELRKLRKEYKEKIDKYERKLEEIERRERT

SEQ ID NO: 25657 - protein, 57 aa, Artificial Sequence
  Synthetic
SEEEDREREYEERHKKAEEDLRRAEEEYARELRREEERLKEEAKRLEKELRDARTKL

SEQ ID NO: 25658 - protein, 59 aa, Artificial Sequence
  Synthetic
EKAKKALDEAVKRVKEDIKRLEDSVKTADDKDRKAIRRAEETVRTHIRTNEEAVRREEK

SEQ ID NO: 25659 - protein, 56 aa, Artificial Sequence
  Synthetic
SELEETLKRLKETNKRLLKKVKELVDESLRLNEELLRRLREVIRKIKETIKEVLEE

SEQ ID NO: 25660 - protein, 55 aa, Artificial Sequence
  Synthetic
ERVDELRKRIRKTEEEIEDIKRRYEKRVRELKETLDRIVKELRDRYKKIREEIDT

SEQ ID NO: 25661 - protein, 59 aa, Artificial Sequence
  Synthetic
DIEDVLKKVLEKNLRVLREVHEVNKRVLDEIVKLLRELHRVNKRVLEIILRLLEALRRG

SEQ ID NO: 25662 - protein, 56 aa, Artificial Sequence
  Synthetic
DEDLKRIEDELRRTLEEHRKRLREVERELEKKVEEHERELRKYEEETKRLLREAER

SEQ ID NO: 25663 - protein, 61 aa, Artificial Sequence
  Synthetic
REEERLRELITDYKRKLDDLKRRSEDLLREYEKTLEDIRRESERTKKELRESLKRDLDREG

SEQ ID NO: 25664 - protein, 55 aa, Artificial Sequence
  Synthetic
EKVKRELEKHTKLLKEILDTVRDLNRKHSEEIRRTVEEVRKANRRLLEELKETRK

SEQ ID NO: 25665 - protein, 60 aa, Artificial Sequence
  Synthetic
SELEETLKKIKELAEISRKLADETRREIKKLIDDSRKLLEDTHRTNEEMVRRVETKAKDK

SEQ ID NO: 25666 - protein, 59 aa, Artificial Sequence
  Synthetic
EEKLREVRELLERYREDVRRLKKEYEELLREEDKKVKKKKEDYERILRKTKKELDERRK

SEQ ID NO: 25667 - protein, 59 aa, Artificial Sequence
  Synthetic
SEDEKAAEDLKKLAEESIRELEKALRDAARLHEEALKRLKKALDEAARLAERAIEEARK

SEQ ID NO: 25668 - protein, 55 aa, Artificial Sequence
  Synthetic
EELIKLIEDLLRLAAELAKKIAELAERHLRLLEEAARKHIELVERLIELAKRDTD

SEQ ID NO: 25669 - protein, 60 aa, Artificial Sequence
  Synthetic
SEDEELEKLLEEAKKLIEESSRRLDELLEEDRRVVKRIEEEVEKLLKEVKEEIDKIKKEV

SEQ ID NO: 25670 - protein, 54 aa, Artificial Sequence
  Synthetic
KVLEIVKEIIDRIRKLLKKTFDISDELLRKWEDLLRRNNDLSRRLLKEAEDKAR

SEQ ID NO: 25671 - protein, 60 aa, Artificial Sequence
  Synthetic
SEKEDLARKLRKLVEELTREYEELVKKLERLIEEIEKVSEESVRKLEKLLREISEEVRKL

SEQ ID NO: 25672 - protein, 59 aa, Artificial Sequence
  Synthetic
DELLRKLVELLVEVLRRLIRVNRELVKLLREVLERLLRILRESVKKLKRLIEKVIKDET

SEQ ID NO: 25673 - protein, 57 aa, Artificial Sequence
  Synthetic
KEEEDLLERVKRVLDELIEIVDRNHELNRRVVETSARLVERLLEEVERALETLEREI

SEQ ID NO: 25674 - protein, 59 aa, Artificial Sequence
  Synthetic
SRLVKKLDEIVKEVAKKLEDVVRRNEELWRKLVELNKESVRRLREIVERVARDLEETAR

SEQ ID NO: 25675 - protein, 59 aa, Artificial Sequence
  Synthetic
RRTEEVIKKIAKLIDELIETLKKIVEDSAKLIKELIDLLEEIIKRSADLIRELEKVSKR

SEQ ID NO: 25676 - protein, 56 aa, Artificial Sequence
  Synthetic
ERRIAERIRELLRESKKLVRDVVEEAKRLLKENRDSTRKIIEDIRRLLRKIEDSTR

SEQ ID NO: 25677 - protein, 59 aa, Artificial Sequence
  Synthetic
DKEDIIRRLARVLERHDEANREVVKEHDEVLEEHLDVHRRVVRSNIEVLRTLLELVEKL

SEQ ID NO: 25678 - protein, 56 aa, Artificial Sequence
  Synthetic
EKDIRKVIEDIERLHRESMEEVRKLVEEIKRLNKEVLKRSEELVEEAKRLLKEVAD

SEQ ID NO: 25679 - protein, 59 aa, Artificial Sequence
  Synthetic
DTKEVIEKLIRVLERAVKLLRELVDRDNRSLKKAVDLHREVVRKIIEVLEEAVRLLATV

SEQ ID NO: 25680 - protein, 60 aa, Artificial Sequence
  Synthetic
EEKLLREVERLVRELAKRLRESLKTVEDLVRELADTNRRSVKTVEDIVRDLERKAREVTR

SEQ ID NO: 25681 - protein, 60 aa, Artificial Sequence
  Synthetic
SKRELLERVIREAERVLKEWEDLLRELTETSDRVIRDVERLLRELLRKAEEVIKDILRKS

SEQ ID NO: 25682 - protein, 59 aa, Artificial Sequence
  Synthetic
EDLKRVLERLTRVAEEILELLEEVLKKSNRSLEKAVEANAEALDRLIEVLRELLDDLRK

SEQ ID NO: 25683 - protein, 60 aa, Artificial Sequence
  Synthetic
SKEELLKKVEDEARKVLEEWKEEVKRLIEESKRVLDDWRRLVDEVSKDIKRVIDEARKDS

SEQ ID NO: 25684 - protein, 59 aa, Artificial Sequence
  Synthetic
EDLKRVLEKLIKVIEKIVRLNEEALRKSNESLERIVKLNEEALRELIRVIERLVELVRK

SEQ ID NO: 25685 - protein, 55 aa, Artificial Sequence
  Synthetic
KEREEIDELVKELEKELRRLVRENEKLVEDNERTLKRLLEENKRLVEELVKRLRD

SEQ ID NO: 25686 - protein, 57 aa, Artificial Sequence
  Synthetic
KDEVVEIVIRVLEEILRLSEEALRIHIRVTREVLRLSKELIDEIRKVLREIADRIRK

SEQ ID NO: 25687 - protein, 59 aa, Artificial Sequence
  Synthetic
SKEELLKELLDRVRRVLTEIKKLLERLLRRSKEVIDDSERLVREVLKRVEDLAREIKAE

SEQ ID NO: 25688 - protein, 59 aa, Artificial Sequence
  Synthetic
KDALDKLRRLIDELARLLREVHERDKELIRDHLREVEEIAKEIARLIKRLAEEIREITT

SEQ ID NO: 25689 - protein, 60 aa, Artificial Sequence
  Synthetic
SERELAKRALERAKEAAEESKRLAKELLDRSRELAKRSKELADEVLKRAKKAAEEIKKKR

SEQ ID NO: 25690 - protein, 59 aa, Artificial Sequence
  Synthetic
KDAAREARKLLKDLLELAERAHKKDRDAIEEHLRLAEEASKRDKELLKELLDLIREIAR

SEQ ID NO: 25691 - protein, 56 aa, Artificial Sequence
  Synthetic
SKEEEVEKVLRKWEEILRRLIEENKRANDKIRREYEELVKEIRRVLEEIKEVAERL

SEQ ID NO: 25692 - protein, 56 aa, Artificial Sequence
  Synthetic
KDVVRKLIEVIERLLRVAEEVIRRILKVNTELMRVDERSIRESLKAIREVLKVLDT

SEQ ID NO: 25693 - protein, 60 aa, Artificial Sequence
  Synthetic
SKEELVDTVKKKLEEVLKKIDKLSRDVKEKLRRVIEELRKLSREVHETNREVARRLREEA

SEQ ID NO: 25694 - protein, 60 aa, Artificial Sequence
  Synthetic
EETVLRTLEKIIRDHNKAHKRVTDAVAKILEELIKLHDEVSRRLKDILRRLLELLDEVTR

SEQ ID NO: 25695 - protein, 60 aa, Artificial Sequence
  Synthetic
RKEELVDTVKKDLERVIETVRKLSEDVKEKIRRVLEDIDRLSKEVHETNKRVVEELEDKK

SEQ ID NO: 25696 - protein, 60 aa, Artificial Sequence
  Synthetic
EETVLRELVKLIRDHNRMHEEVVRRLKKIIEEALKLHDEVSRRVAELLREVIELLDRVAK

SEQ ID NO: 25697 - protein, 60 aa, Artificial Sequence
  Synthetic
DKEREVDEILRRVTKLLKELEKRSKEILDRVRELVREYKRKVEEILKRVEDLIRRLIKDK

SEQ ID NO: 25698 - protein, 55 aa, Artificial Sequence
  Synthetic
DELRKILKELEELLRTLNKELKEVVKELRELLKELHDRLREILEELKRLLEEIAR

SEQ ID NO: 25699 - protein, 60 aa, Artificial Sequence
  Synthetic
DEDELIRKLLEDLKDIVRKILELIERDLRDIERVVRRIVKVIRDDLKKIKEVVDDIRRRV

SEQ ID NO: 25700 - protein, 59 aa, Artificial Sequence
  Synthetic
SELADRIRKLIEDLERHTKKVLEDVKRAITELRKNSKDILEEVRKLIDELRKRIKEVED

SEQ ID NO: 25701 - protein, 56 aa, Artificial Sequence
  Synthetic
KAEEIAKIAVDAVRKIAELLRRASKINLDAIRKAAKLSKEASKINLDAIRKIAEEV

SEQ ID NO: 25702 - protein, 56 aa, Artificial Sequence
  Synthetic
RKALEKARKLAEDALRANKRANDEAKKLADEALKENRKALEDAKRLARKAAEDAKR

SEQ ID NO: 25703 - protein, 59 aa, Artificial Sequence
  Synthetic
SEEELLRRIRELLKKALEDNKDVLREIEELLRKVTEDNDRVLEEIRKLLEEVDEVVKRA

SEQ ID NO: 25704 - protein, 59 aa, Artificial Sequence
  Synthetic
DELRRVVEKIEKVLRDVVRALRELVRINARVLEEILRLIEELVRRNAEVLKRILELVAT

SEQ ID NO: 25705 - protein, 61 aa, Artificial Sequence
  Synthetic
SKEDELRKAEEDARRVVEEILDLNRESVEKSRRVAERVLRLNEDSVRKSRDVVRRIKEEVN

SEQ ID NO: 25706 - protein, 54 aa, Artificial Sequence
  Synthetic
VVRKLIEANEDHLRVNKEIVDRLIKANEEHLEVNRRAVEKLIEVLKRLLDVARK

SEQ ID NO: 25707 - protein, 60 aa, Artificial Sequence
  Synthetic
SEKEDLVRTIEEVVKTIEELVERHERKIDEIVKRSRELVRTHVEKIEEIVRRVEELVRRG

SEQ ID NO: 25708 - protein, 57 aa, Artificial Sequence
  Synthetic
LDTLAEEVKRVLKEHVDLVRKAARLDSETLKKHVDLVRTAAERVSEVMKELVELVRR

SEQ ID NO: 25709 - protein, 60 aa, Artificial Sequence
  Synthetic
SEIEELVKDIERIVREIKKLIDDHVRKLEKIIEDIERDMRRHEETVREVVRKIEDEVRRG

SEQ ID NO: 25710 - protein, 57 aa, Artificial Sequence
  Synthetic
LDSLAKKVSDVARKHLDLARRVIKLISEALKKHIRLVEKAMEDISRILEDLVRLVRK

SEQ ID NO: 25711 - protein, 60 aa, Artificial Sequence
  Synthetic
SKLEDAVRRIEEILRHIVRSLEEVVKDIEKILRDHVRMLREVVKRIEDVLRRVVELLRRA

SEQ ID NO: 25712 - protein, 56 aa, Artificial Sequence
  Synthetic
KDVLREVAERIRKVIERLKELLDRSRERAEDVIKKLRDLLKENERLIEEVRRRLEK

SEQ ID NO: 25713 - protein, 57 aa, Artificial Sequence
  Synthetic
SREEAVADVIRRLEEILEKNLRLLEEIIRRLLRILEHNLRLNEKAVEIIEDLIRKLL

SEQ ID NO: 25714 - protein, 56 aa, Artificial Sequence
  Synthetic
SRLADDLRRVVKKIVEDLEENLERIKDIIRRLVEELERSLEEIRRLIDRLVKEIRR

SEQ ID NO: 25715 - protein, 58 aa, Artificial Sequence
  Synthetic
SEEEAAREAERLLEEAARVAERIVRDSERLLDEAAEVARKAVEDSKKLLEDALRAARE

SEQ ID NO: 25716 - protein, 56 aa, Artificial Sequence
  Synthetic
REAAERVARRAERANEEALKEAEEVIKRAKEANKRALEEAKRVIDRADKALKEARK

SEQ ID NO: 25717 - protein, 59 aa, Artificial Sequence
  Synthetic
RDRDVLRKVKREIEELVRRIEKVSRDALKEVKRLLDENRKIAEDVLRLIERLLRKIRDT

SEQ ID NO: 25718 - protein, 59 aa, Artificial Sequence
  Synthetic
EEVVEELLRMLKRVAEEMKRVHDDLSRAVEKVVRDVVRVDKELLDELRRILRRLEEVIT

SEQ ID NO: 25719 - protein, 56 aa, Artificial Sequence
  Synthetic
SKDEELMRLLEELVERWRKIVEDLERDHRRLVKEIRELVERIRKKLEELVDRIRKN

SEQ ID NO: 25720 - protein, 58 aa, Artificial Sequence
  Synthetic
EEIRRILEELKRIVDDVLRIIARILKLLRDLTRRLAEVAKKVHKLLEELLRKLKEDTR

SEQ ID NO: 25721 - protein, 56 aa, Artificial Sequence
  Synthetic
KDAETLEKVLRDVLERADEIIKRLEDIYREIKKRLEAIIKEAEDINRKILEEIRRL

SEQ ID NO: 25722 - protein, 56 aa, Artificial Sequence
  Synthetic
VKRALEELKDLIDRNLKVLKDLLDATRKLIEENIRVLREILKRIKDIARELLEATK

SEQ ID NO: 25723 - protein, 61 aa, Artificial Sequence
  Synthetic
SSKEEVLELIKELVRSSKEVLERVVRLNEKSLRISVEVLDRIVELIEEIVRIVVRELEKKV

SEQ ID NO: 25724 - protein, 55 aa, Artificial Sequence
  Synthetic
RELLKEIKRIIEEIDRLVKESLKRHKDINDEIRELAKRTLDEIKEVIDRIRERLR

SEQ ID NO: 25725 - protein, 60 aa, Artificial Sequence
  Synthetic
SEEEDVIRDVKRRLEEILKTNADVIRDIEEILKEVKERNKRVVEELKDILRKVLEELRKK

SEQ ID NO: 25726 - protein, 55 aa, Artificial Sequence
  Synthetic
KEVVDLIREIVERLARAVEESLKLLKEIIDLLTESSKELVKLLEEILRTLKEAAR

SEQ ID NO: 25727 - protein, 56 aa, Artificial Sequence
  Synthetic
SDEERLEKVVKDVIEKVRRILEKWKKDIDKVVKELRRILEEWEKIIREVLDKVRRL

SEQ ID NO: 25728 - protein, 56 aa, Artificial Sequence
  Synthetic
ERLLKRVVDILKRLLELNATTIERLLRILEELLKLNKELAERVIRVLEKLLEEIKR

SEQ ID NO: 25729 - protein, 60 aa, Artificial Sequence
  Synthetic
KDMERVLTEHKKAVKELIELLERLLEEHERASRELIKLLRELLERHKRATDELIKLLREN

SEQ ID NO: 25730 - protein, 56 aa, Artificial Sequence
  Synthetic
VEEVVKRLEDVNRTLEEIIRKVEEEAKRVNEDLRKRIEDVVRTLEEVNKRLKEITK

SEQ ID NO: 25731 - protein, 56 aa, Artificial Sequence
  Synthetic
SELEEVAELLKRSKELIDEVEERIRRLATESLRFLDEVVRRIRELLTRLLKEVRDS

SEQ ID NO: 25732 - protein, 55 aa, Artificial Sequence
  Synthetic
ERLLKKTEDVVREILRLIEEVLRTHAEIIREILELIERLLELHKTLVDRLLERIE

SEQ ID NO: 25733 - protein, 56 aa, Artificial Sequence
  Synthetic
SVLETVKRLAEESSERIRKIVEDDKRVADDSSRKIKELIEEIKRRVKELLDRIKDL

SEQ ID NO: 25734 - protein, 56 aa, Artificial Sequence
  Synthetic
KEVVIRLIEELVKLLEDVLRRLLEVNETLVELNKRVWDRLVRINEELAEVALRVAT

SEQ ID NO: 25735 - protein, 56 aa, Artificial Sequence
  Synthetic
SVLETVKKLLEDSSEKIERIVEEDERVAKESSDRIRRLVEEDKRVADEILDLIEKI

SEQ ID NO: 25736 - protein, 56 aa, Artificial Sequence
  Synthetic
KDAVIKVIEKLIRANKRVWDALLKINEDLVRVNKTVWKELLRVNEKLARDLERVVK

SEQ ID NO: 25737 - protein, 59 aa, Artificial Sequence
  Synthetic
SIRELLKELEDVVREIIRDIRRLLEESRRVVERIERETKRLLDEIRDVARRIEETIRRL

SEQ ID NO: 25738 - protein, 59 aa, Artificial Sequence
  Synthetic
KEAVDELRRLLEELKKIVEDILRTLEKLNRELLEIDKRVADRLRELLRTLKKLIEEAAT

SEQ ID NO: 25739 - protein, 57 aa, Artificial Sequence
  Synthetic
SKEEAIKELLKKHKRITEDIIRMARELDREHEEITREIAERLRRLLKKLLDDVRREV

SEQ ID NO: 25740 - protein, 55 aa, Artificial Sequence
  Synthetic
ERAKRVLDKILDDVRRLVEEAAKLLDESVKKSTDIVRRVRKLLDDSLKEVAELAK

SEQ ID NO: 25741 - protein, 57 aa, Artificial Sequence
  Synthetic
KKEDDVRRLLKEHEDITREIIKLIRDLARKHLELNKRVIRALEKVLKDLEDEVRKDV

SEQ ID NO: 25742 - protein, 55 aa, Artificial Sequence
  Synthetic
ERVRRVLDRVVERVAELVREWKELLKRSLDEVREVVKRARDMLRRSVKTVKELVD

SEQ ID NO: 25743 - protein, 58 aa, Artificial Sequence
  Synthetic
DEVEDARKKLEDLERENRKVIKEIEDALRELVKDHDRVVEELRRRLRRLLEELKKLVD

SEQ ID NO: 25744 - protein, 60 aa, Artificial Sequence
  Synthetic
DEEMLKRVVDVLEDLVRTIEKVLRELSETLRELVRRLLELLRENNESVRRLIRILEEALR

SEQ ID NO: 25745 - protein, 60 aa, Artificial Sequence
  Synthetic
SEDEAAERLLREAKKILKRLEDAARESLKSAERILEELEKAARDSLRKAEKIIRDAKRKG

SEQ ID NO: 25746 - protein, 55 aa, Artificial Sequence
  Synthetic
KEAEKLATKLVEDSERAAREAKKLADENVKRSKEAAEEAKRLADRLVKEAEDDAR

SEQ ID NO: 25747 - protein, 59 aa, Artificial Sequence
  Synthetic
SEDEELLKRLDELLKEILKVIEELIRRLEKAHKENMDKIRDSARRLRELLRKLAEDERE

SEQ ID NO: 25748 - protein, 56 aa, Artificial Sequence
  Synthetic
EELVKEILERVDRLLRKSLERLREVLEESRRRLEEVLRALEEVIKRVRDLLRKLRE

SEQ ID NO: 25749 - protein, 57 aa, Artificial Sequence
  Synthetic
RKKEELARVLEESLEVNRKLVRDLAEVLRKDLEIIRELVKRLVEILKKILKVLADVI

SEQ ID NO: 25750 - protein, 59 aa, Artificial Sequence
  Synthetic
EETLRKVVEDLERLLREARRVVKEAVEKSRRSLEDLRRIIEEAIRRNEKILRKLKEIVK

SEQ ID NO: 25751 - protein, 59 aa, Artificial Sequence
  Synthetic
KEDELLRRIKEVIDKTLEDMKRLLKKHKELLDEILRLLAELVEENKKLIDEILKLVEDS

SEQ ID NO: 25752 - protein, 59 aa, Artificial Sequence
  Synthetic
EEAKELVRRLKRAVEESKKKLDELVKDVKRLADDSARDLRELVKRIAELVKKIRDELRD

SEQ ID NO: 25753 - protein, 63 aa, Artificial Sequence
  Synthetic
DAEEALKRAREVLKEAADLNRKAVEDARKILKDAADDNKRALEEAERVLRKALEDAKDARARN

SEQ ID NO: 25754 - protein, 56 aa, Artificial Sequence
  Synthetic
AEKAAEDAKRLLEEAEEASKKLIKAAEELLRELAKASKRALDEARKLIEEAEKAAR

SEQ ID NO: 25755 - protein, 61 aa, Artificial Sequence
  Synthetic
SEREDLLRLIEEVIRELIKLLETNLRLNEETIRTLIRLIKKDLDLNRRSVEELVKLLKERV

SEQ ID NO: 25756 - protein, 59 aa, Artificial Sequence
  Synthetic
SEAADEVRKKLAEDERLNDKSLEELKRILDKDREINRRVAEKLTRILETLRKIIEDVAR

SEQ ID NO: 25757 - protein, 58 aa, Artificial Sequence
  Synthetic
DDLERVLDELRRIIEEIKRRIDKILEDYERVLRDAKRLIDDVLREYRRIIEELKDLLD

SEQ ID NO: 25758 - protein, 59 aa, Artificial Sequence
  Synthetic
KDVLERIKRLLDELRRANEEVVRRVKKILDESLKENRDVVRELKKILDELLEIVAEAAR

SEQ ID NO: 25759 - protein, 57 aa, Artificial Sequence
  Synthetic
SKKERLKKLIKEHLDLLRRLLKELEDLIRKHLELLRRLLRRLKELLRELLKLIEELV

SEQ ID NO: 25760 - protein, 54 aa, Artificial Sequence
  Synthetic
RVEKEVRRALEKVERLIREIKRLVERSLEEVEKLIREIKKRVRDSLRKVKKESE

SEQ ID NO: 25761 - protein, 60 aa, Artificial Sequence
  Synthetic
DEIETVLKRLAELIKESLDLLRETLDELRKIIEESKKSLEDVLRRLKELIDRLRRLAEEK

SEQ ID NO: 25762 - protein, 60 aa, Artificial Sequence
  Synthetic
KDELLRRVEEILKRLLELIRRIIEEHRKILERLLETHEDLIRKHEEILRRLLKAADEERQ

SEQ ID NO: 25763 - protein, 60 aa, Artificial Sequence
  Synthetic
SEKEDVLRRVEEIARRVRDILRRNLEKVERIAEELKKINDDLLKEIERIIKELKEVLRDV

SEQ ID NO: 25764 - protein, 56 aa, Artificial Sequence
  Synthetic
IEEVLEILDRILKTARDVSKENLESLKRALELDRRTNERLEDLLREILELLRKDIQ

SEQ ID NO: 25765 - protein, 60 aa, Artificial Sequence
  Synthetic
SELEELRKLAEEAIEAAKRALDRLHKLSRELIEAAKEILKRLKKLSEDLIRAAEEAARRS

SEQ ID NO: 25766 - protein, 58 aa, Artificial Sequence
  Synthetic
EDAKRAKEIAKEAIERSKKIADEAREIAKRAIDKSKKIAEEAKKIADEVLKRAEDIAR

SEQ ID NO: 25767 - protein, 61 aa, Artificial Sequence
  Synthetic
RESEELIRLLRKIIELLEELVERIRDLLRKHLKLLEEVVELLKRNLDEILRLLEEVLREAN

SEQ ID NO: 25768 - protein, 58 aa, Artificial Sequence
  Synthetic
EKAKKLEELLRDLLRTVREIVKEVRELLEESLRTAEKLVEDIKRELDELRKRLKELVD

SEQ ID NO: 25769 - protein, 58 aa, Artificial Sequence
  Synthetic
DEERLVEEIIRTIKRVIELNEESLREIERVLEEVIKMDKRSLEEIKRVLDEILKLARD

SEQ ID NO: 25770 - protein, 60 aa, Artificial Sequence
  Synthetic
GEELERVLRELKKVLEELIKDNERVNDELRRVLEKLKERNRKVLEDIKRVLEELRDEVER

SEQ ID NO: 25771 - protein, 58 aa, Artificial Sequence
  Synthetic
SSEEIIRTLEKAIRESEEKLERLVRRDEEVVKDLRTKLRENLDRVRRMVEELVRMLES

SEQ ID NO: 25772 - protein, 60 aa, Artificial Sequence
  Synthetic
KDTLVKVLKEVLERHVEADEKAVRELAKVLEENVRLLEELVRVNKEVLRRILELVKELAK

SEQ ID NO: 25773 - protein, 57 aa, Artificial Sequence
  Synthetic
SKEEKLKDDVRRVLEDLDRVLKELEKLSEDNLRELKRVLDRITDLHRRILDELRKKI

SEQ ID NO: 25774 - protein, 59 aa, Artificial Sequence
  Synthetic
SKVAEDILRVLEKLVKVSREAIKLILELSEHHVRVSTRIARLLLDVARKLFEVIKEAER

SEQ ID NO: 25775 - protein, 57 aa, Artificial Sequence
  Synthetic
KKEDELEKMVRDVLEDLDRILREAEELSRKNNDDLRRVLDRLRRLAEEVIKRLEEKV

SEQ ID NO: 25776 - protein, 59 aa, Artificial Sequence
  Synthetic
SEVARVILEILKRLLKALKEAAEELKKISEHHLRVSEKVVRDLDRVVKKIVDVARRVAT

SEQ ID NO: 25777 - protein, 57 aa, Artificial Sequence
  Synthetic
SEKEKLLRDLEEVVRDVIRLSKESVDKLKETVDRLVEESRRTVEELRRIVDRVAKEV

SEQ ID NO: 25778 - protein, 58 aa, Artificial Sequence
  Synthetic
EIVKLLEDVVRELVEVLRKSTEVIERAVKKLVDILRESLKLIEDVVRRLVEIMEEIVR

SEQ ID NO: 25779 - protein, 61 aa, Artificial Sequence
  Synthetic
SEIEDVIRRLRKILEDLERVSEKLLREIKKILDEARRLNEEVIKEIKRVLEDAVRVFRDIR

SEQ ID NO: 25780 - protein, 56 aa, Artificial Sequence
  Synthetic
IEDLVREVERLIKRIEDSLRELEKTVRELLKRIKEASDKVREDVDRLIKELKEAAD

SEQ ID NO: 25781 - protein, 60 aa, Artificial Sequence
  Synthetic
SREEIVATLEDLARKILEVVKKLAKEIEDAWREIERKVREILKRLEELWREIEDVVRKKV

SEQ ID NO: 25782 - protein, 59 aa, Artificial Sequence
  Synthetic
RELVKELVELLEEILERNTRVIKEIIDLLRTVIRIHEKIVEDLIKLLEELLRRLEEATR

SEQ ID NO: 25783 - protein, 58 aa, Artificial Sequence
  Synthetic
KEKEDALKKLEDLARKSREDLERVLRKHKKILDKIEELLKRVLDEHKKIVDDILRKTG

SEQ ID NO: 25784 - protein, 59 aa, Artificial Sequence
  Synthetic
EELAREVERVIKELLDKSKEILERIERAIDELLKVSEEILKLSEDASEELLKILREFAK

SEQ ID NO: 25785 - protein, 58 aa, Artificial Sequence
  Synthetic
DEKEEALKTVERIIRDIVRRLRELLKEHEDIVREIERELKEVHEKHKRLVEKALEELG

SEQ ID NO: 25786 - protein, 59 aa, Artificial Sequence
  Synthetic
DRLADLIRRAVDRLRDISREILKRLVEVIERLLEVSEKILKLVEEVIRELLRVVEEAAK

SEQ ID NO: 25787 - protein, 59 aa, Artificial Sequence
  Synthetic
SVVEILAEVLKRLLDILRKLVDAIRDVVKKHVEVVEKLVRLHEEVLRRLVDILRKIAEV

SEQ ID NO: 25788 - protein, 60 aa, Artificial Sequence
  Synthetic
EEILRRLVEEAKRLVAESIKKLRDLVRKIREAHKEAIKRLEEIVRKVEEIVRKVIDELRK

SEQ ID NO: 25789 - protein, 62 aa, Artificial Sequence
  Synthetic
SDEEKLRRLLEEVRRLAKRVIDELERVLRESKRLAEENIEELDKALEEVKRLIDDVIKKLRD

SEQ ID NO: 25790 - protein, 60 aa, Artificial Sequence
  Synthetic
SETIERLLRELLKVLKEIVDRHRRIIERLLKASEDAVRELKKLIEETLRVLTDVVRRTET

SEQ ID NO: 25791 - protein, 56 aa, Artificial Sequence
  Synthetic
SLVDELRKSLERNVRVSEEVARRLKEALKRWVDVVRKVVEDLIRLNEDVVRVVEKV

SEQ ID NO: 25792 - protein, 56 aa, Artificial Sequence
  Synthetic
DEELKRVLEKAADLHRRLKDRHRKLLEDLERIIRELKKKLDEVVEENKRSVDELKR

SEQ ID NO: 25793 - protein, 55 aa, Artificial Sequence
  Synthetic
SKEERLREVAEKHKKDLEDIVKRVDEAAKETKRRLEEILKRLEEVLKKILDDLEK

SEQ ID NO: 25794 - protein, 55 aa, Artificial Sequence
  Synthetic
KEVLDILERAVEVVRRVIKALKEVLERHVDATREVIERVKRVNKRLLEAVREVVT

SEQ ID NO: 25795 - protein, 56 aa, Artificial Sequence
  Synthetic
SREEKLEELIKELERRLKDVLDRSRELNREIRKTTEEVIREVDRLLREIEKIVRDV

SEQ ID NO: 25796 - protein, 59 aa, Artificial Sequence
  Synthetic
EDTARLVREVAELIEKVVREIVKLIDEDLKKLERVVRENARLLREVVELLLKVVRDVAK

SEQ ID NO: 25797 - protein, 62 aa, Artificial Sequence
  Synthetic
DEKELLEEIIKKVEDLLRESRELWERLIKRVKELLKRSKETVDEILKRIKELLDELRKVAAE

SEQ ID NO: 25798 - protein, 60 aa, Artificial Sequence
  Synthetic
DKRLLDVIKEIVEKLIEVVRKLLEADKRIIEELIRVLEKIAEVDETIVKRLIEVLKKIAD

SEQ ID NO: 25799 - protein, 61 aa, Artificial Sequence
  Synthetic
SEEEDIERVLRELKKLHKDHLDLLREVVKRAEELLRRHLEILREVLKREKKLLKDVLRDAR

SEQ ID NO: 25800 - protein, 55 aa, Artificial Sequence
  Synthetic
DELLEEAKKLVKEVRELAEETLRRLARLVEDVKRLNDEAVKRLRELVRRIKEEVR

SEQ ID NO: 25801 - protein, 59 aa, Artificial Sequence
  Synthetic
RTEEILREIVDLLRRVAEENLRTLEELVELLDRVARRNLESLRELVRILEEVLKKLLKK

SEQ ID NO: 25802 - protein, 56 aa, Artificial Sequence
  Synthetic
EDVLRELDEVVRRVIERDREILRELKRLVEEVIRKNEDIVRKLEEAVERVLRKLKD

SEQ ID NO: 25803 - protein, 59 aa, Artificial Sequence
  Synthetic
SEKEEVIKDLRKVLEEVLRRHEELVERLKEVLRKVLEDHKKLVEDLKRVLDEVRRKLEN

SEQ ID NO: 25804 - protein, 57 aa, Artificial Sequence
  Synthetic
REELLRRLERIVEDIIRLLEESLKLAAEVIKTIIRLLEESLERLKRLVDDIVEKLRK

SEQ ID NO: 25805 - protein, 60 aa, Artificial Sequence
  Synthetic
SEKELLERLEEVERRLLEIVRRLLKRNRDVHEELLRIVEANLRRNKKVHEDLLEKVRKSV

SEQ ID NO: 25806 - protein, 59 aa, Artificial Sequence
  Synthetic
DKVVKELEDIVEELMEENKDSLRRLKEIVEELLEENRRVLEKLRKIVEDVARELEETAT

SEQ ID NO: 25807 - protein, 58 aa, Artificial Sequence
  Synthetic
SIEEVLREIVKLLREVLERLIRVDERLVEALKRVAEKNIEVLRRAVDALRKVLELLRR

SEQ ID NO: 25808 - protein, 57 aa, Artificial Sequence
  Synthetic
EETVIRRVEDVLRDLLRRLEEVVRRSTEEAKRLLKESRDVVRDVEKTLRELLEELRR

SEQ ID NO: 25809 - protein, 58 aa, Artificial Sequence
  Synthetic
SVEEVIRKAVTDLDRVLKTNIRVDERLIEMLKRVADENREVLEKIVRLLKEVLDLLRN

SEQ ID NO: 25810 - protein, 57 aa, Artificial Sequence
  Synthetic
EKEVVDKVKRVLDELRRDLERVVEESEKLARDLLRKSRDVVRRTRELLKKLLEEVET

SEQ ID NO: 25811 - protein, 64 aa, Artificial Sequence
  Synthetic
SRRETLEKLLKEIEDLIRESLERLEKLLEENRTLIDDDERRVRELARDIKELIKEIEERLRREN

SEQ ID NO: 25812 - protein, 55 aa, Artificial Sequence
  Synthetic
EEILKIIEELIKRLEKLNEDSNELMKELVKRNERLARENLKLVEELLRRIEETTR

SEQ ID NO: 25813 - protein, 56 aa, Artificial Sequence
  Synthetic
SEVERLRELVERWREELKKLLDELRKVVEEIARELKKINDELRKLVEDIAREARRE

SEQ ID NO: 25814 - protein, 56 aa, Artificial Sequence
  Synthetic
ERVIEELIRVLRKVVEDHADVTRRLVEVLRKVVKLIEEVLKKDEKVLRDIVDRLKT

SEQ ID NO: 25815 - protein, 57 aa, Artificial Sequence
  Synthetic
SEVEEVVRVLEKVLRLLRRLVEELHRLSERVLELITRLLKELKDLSREVIKRLEDAN

SEQ ID NO: 25816 - protein, 59 aa, Artificial Sequence
  Synthetic
KEKIDELRRVLERVEREHRRVIKKIRDVVEKVKRDHERVLREVEKVVREVRTELEKLRE

SEQ ID NO: 25817 - protein, 61 aa, Artificial Sequence
  Synthetic
SVEEELRELVKRVEKLVERLRRIVKEIIERSRDLVRKSREVVDRLKKELDELVKEVVREEG

SEQ ID NO: 25818 - protein, 59 aa, Artificial Sequence
  Synthetic
DEVIRRIAEVVKRLIDKLKELSDDNRKAVEDHERLVRKAIEELVREVEDILRRIDETAR

SEQ ID NO: 25819 - protein, 56 aa, Artificial Sequence
  Synthetic
SEKELLKEILDRIRELLEDDNRLLKRIVDEIRKLLEEWLRVHKEILERIKELLDRI

SEQ ID NO: 25820 - protein, 62 aa, Artificial Sequence
  Synthetic
EDMVRKIRKIIEELKRLLEDLRRDTRRVIEEAKRLLKEWRDRNKEVADTLKKLLEDLIRKIR

SEQ ID NO: 25821 - protein, 56 aa, Artificial Sequence
  Synthetic
REDEIVEDWRRLLEEAKRRSEEVAKEIRDRAREVTKESKRVADEWRRLLEEVKKRA

SEQ ID NO: 25822 - protein, 59 aa, Artificial Sequence
  Synthetic
EELVRVARDLVRLNEEVLRKSNRSVEELLKALARVLDRSNKSLEDLVELNKRVLDKLRT

SEQ ID NO: 25823 - protein, 59 aa, Artificial Sequence
  Synthetic
RKEDLVREWRELLRKILEDLEDLVRKWRKLLKKILDDLRELVRRVREELDKALRTVEKG

SEQ ID NO: 25824 - protein, 57 aa, Artificial Sequence
  Synthetic
LRDLVRKIIEIIEDILRLLEEVLRKNVKAVEEVLRLAIRVLEENIEAVEKVLEDVRR

SEQ ID NO: 25825 - protein, 58 aa, Artificial Sequence
  Synthetic
SEEELLREIEKILDEVRKLVEKLLEDNRRLADELIKLIKELLDRNLRLIERLLELLER

SEQ ID NO: 25826 - protein, 59 aa, Artificial Sequence
  Synthetic
EELREVLERALRKAKKIHEDLKRIVEDVRRRNDEILKDLERVLKEVEDKIRKILDELRK

SEQ ID NO: 25827 - protein, 59 aa, Artificial Sequence
  Synthetic
RDEDIKRELVRLVEEILRTSARLLDESIKSNKKTLDDIERVAREIVREIEELLKRIADG

SEQ ID NO: 25828 - protein, 55 aa, Artificial Sequence
  Synthetic
DELKKDIRDVLERVKRIAEELRELVERDIREDKRLLDELAKLWRDLLKMIEDLRR

SEQ ID NO: 25829 - protein, 61 aa, Artificial Sequence
  Synthetic
SEDELLEKIVRKLREAVKRIEEELRKSKREIERLVKEIKEKLEDSLRRVKETLDRIRETRK

SEQ ID NO: 25830 - protein, 56 aa, Artificial Sequence
  Synthetic
LEELLRLLKEVIERSIESLERLLELILRVLEYSVRSLEELLRRLLEVIKRIVDTTK

SEQ ID NO: 25831 - protein, 59 aa, Artificial Sequence
  Synthetic
DEDEIAEELKRLLREVEEKSKEIVRRMRELAREANKKSEDILRTLEKLLEELRRRVEEN

SEQ ID NO: 25832 - protein, 56 aa, Artificial Sequence
  Synthetic
IDEVVRRIERVIREVIKILARANKRLHDVVEEIIRLLEEVTDELRRVVEEVIRRTK

SEQ ID NO: 25833 - protein, 56 aa, Artificial Sequence
  Synthetic
DKEEEVRRLIEENLKKIEEVIRELEKIIRDNLRKLEEVVREIEEELETTLRLIETD

SEQ ID NO: 25834 - protein, 59 aa, Artificial Sequence
  Synthetic
EDLLRKLKELLETLKRRIDEIEKKLEEILKETKDLIRRLLEKLKRIDEELRKTLEDLRR

SEQ ID NO: 25835 - protein, 61 aa, Artificial Sequence
  Synthetic
DDIDEILRRLREEIEDARRKLEKILRELRERIKDYKRKTDELLKESRKRIREAEDRVRRDG

SEQ ID NO: 25836 - protein, 59 aa, Artificial Sequence
  Synthetic
DKVLEALLEKLLRSNEELVKIDRDLLRDLLRVLEELIKTVRDLLRELLRVLEEVAREIK

SEQ ID NO: 25837 - protein, 60 aa, Artificial Sequence
  Synthetic
REEETLRDIERLLRKLLEELKRTADELIDSHRKLIKKLKEILDRLRRSHEKLIETLRRRL

SEQ ID NO: 25838 - protein, 59 aa, Artificial Sequence
  Synthetic
EDVKRELREVVKEHKEDLDRIKKELKELLDRHTETLKRIVKKLRDLLEEIRKALEDLKK

SEQ ID NO: 25839 - protein, 59 aa, Artificial Sequence
  Synthetic
DEERVVEEAIRVLKEVLDLHRELIKRSIDVLKESLKVHERAVESLERVLKEILDLVRRG

SEQ ID NO: 25840 - protein, 56 aa, Artificial Sequence
  Synthetic
EEEVAERVKRIIEEVRKLAEDSRRKTEELIRRVKELAERTDETVRRVIEELRRRTK

SEQ ID NO: 25841 - protein, 59 aa, Artificial Sequence
  Synthetic
DEEDVARKLIEVLKELLKLVEDLIRTNIRVLEESLELHRRLIEEIEKVLKRILELLEEG

SEQ ID NO: 25842 - protein, 56 aa, Artificial Sequence
  Synthetic
REELAKEVKRVIEELKKLARESAEESKRIIRTIEELLREARKRAREVIEELKERTR

SEQ ID NO: 25843 - protein, 60 aa, Artificial Sequence
  Synthetic
DAEEVLRLLAEVLERIIELIKKVNEILIRVLREVIRLIEEVNELVREVLKRIIELIRRDI

SEQ ID NO: 25844 - protein, 55 aa, Artificial Sequence
  Synthetic
ERILEEIERLVREVEEIHERVLRRLKELLKKVREVHEEVLRRIERLAERVREALK

SEQ ID NO: 25845 - protein, 56 aa, Artificial Sequence
  Synthetic
SVREELEKVIREVIEEVERVLERIRDELRKSLERLKEVIKRIEDVHRDLIRRIREI

SEQ ID NO: 25846 - protein, 56 aa, Artificial Sequence
  Synthetic
IEEVLKTVEDISRRHRELLKRILDTSKRSIEETLKLAREILETLKRLLKELLDAAK

SEQ ID NO: 25847 - protein, 59 aa, Artificial Sequence
  Synthetic
DAEDEARRVIDEAVDRLRKAVEEIAEVARRHLEEVEEVVRKLEEIIRESLERVRRASEA

SEQ ID NO: 25848 - protein, 59 aa, Artificial Sequence
  Synthetic
DKEAEEVVRRVERLHEDVLRRLKEVVKRVKELHEEILDRLREILDRVRELARKVREDLR

SEQ ID NO: 25849 - protein, 56 aa, Artificial Sequence
  Synthetic
SEKERLSKIAEDLIRRLEEELERVERTHERLLRKLEELLKKIEKEYRDAMRKLETL

SEQ ID NO: 25850 - protein, 57 aa, Artificial Sequence
  Synthetic
IKEVLDDLKRVLERDLRAIKKIVKELKRILKENLDVLREIVERIKRVLEKILREVEK

SEQ ID NO: 25851 - protein, 60 aa, Artificial Sequence
  Synthetic
SREERLERVLERVKRAIDRYRDMLRRLLKTVEDLIRKYEEDLKRLLKEAKELIDKVKEEN

SEQ ID NO: 25852 - protein, 59 aa, Artificial Sequence
  Synthetic
EEIKKIIDRLREEIERILDELRRLNEELVETLRRVLETLRELNERLVKLLRDLLREEKK

SEQ ID NO: 25853 - protein, 60 aa, Artificial Sequence
  Synthetic
DEEEKMKKIEDVARRYKEEVKRVLDDLERLLRESEEEVERIVRKLEKLARDLEERVRELT

SEQ ID NO: 25854 - protein, 59 aa, Artificial Sequence
  Synthetic
KEVIDALKELLKVLEDLLREIKEALTRNLEKIDELLKLLHELSRRVIEELRKLLEDLKR

SEQ ID NO: 25855 - protein, 57 aa, Artificial Sequence
  Synthetic
REDEELARKAKEVLKETEDLLRKLEEEVKRVLEEIKRMNREVREKVKEVIKELRKRL

SEQ ID NO: 25856 - protein, 59 aa, Artificial Sequence
  Synthetic
KRLLDLLRDLLRLLKELLETLEKLNERTLKLLRDLLRKLKEALRRNLKLLRELVDEAAT

SEQ ID NO: 25857 - protein, 60 aa, Artificial Sequence
  Synthetic
SKDEIIKRIKDELEKLVRDVERLLRESERRIADLVRRVREILEESKRRVDELVKRVKETG

SEQ ID NO: 25858 - protein, 56 aa, Artificial Sequence
  Synthetic
VETILRVATEVVKESATVLKRILETLEEALKRNVRIIEEMLEILREVIERIARKLK

SEQ ID NO: 25859 - protein, 55 aa, Artificial Sequence
  Synthetic
SEEEILREIKRLLEEHLELNERILREIKKDNKRTLKELRDIVRELKEILERIKRR

SEQ ID NO: 25860 - protein, 55 aa, Artificial Sequence
  Synthetic
EELRKLLEDARRALERILRRLAKIVKEIKEKHEEVLRRLEKSVREIDERLRRARE

SEQ ID NO: 25861 - protein, 57 aa, Artificial Sequence
  Synthetic
SELERLERLLKEIVEVNRKALEDLRRVLEETVRRDREVLDRTRRKLEEIAEEILREL

SEQ ID NO: 25862 - protein, 59 aa, Artificial Sequence
  Synthetic
REDLKRLEDLVKRIEEELRRKLEKYERELRDLKRKLEELLKRYEEKVKELKRKLDEALK

SEQ ID NO: 25863 - protein, 57 aa, Artificial Sequence
  Synthetic
SEEEILRRIAEEIKRLIDEDLRLIEELVRKIKTVAKRDLELIARLVEKIEEVIRRSI

SEQ ID NO: 25864 - protein, 59 aa, Artificial Sequence
  Synthetic
EEELKTAEKIIEDIKKEIDDVHREVRRLLEEIKEDIDRVNEEVKKRLEDIIEKIRRAAK

SEQ ID NO: 25865 - protein, 59 aa, Artificial Sequence
  Synthetic
SIEELAEDIKKILDDALELLERLAKRAKEINDEILDELRKLVEKNKRDLDRALEKLRRE

SEQ ID NO: 25866 - protein, 58 aa, Artificial Sequence
  Synthetic
ERVRKLIRELEEELKDNRRLIEELVRRARKVNKRLRELVEEVIDRLRELLERIEEKIR

SEQ ID NO: 25867 - protein, 56 aa, Artificial Sequence
  Synthetic
SKEETLRKEAEDLLRRLEELTRRLEKKARELLERAKKLSRDLAEELKRLLKELREK

SEQ ID NO: 25868 - protein, 59 aa, Artificial Sequence
  Synthetic
ERLKRLVEELLKAVTDLSRKNKRILEELLKAIETLSDENKKILTEILDALRRLVEKIEK

SEQ ID NO: 25869 - protein, 60 aa, Artificial Sequence
  Synthetic
DEERKIVETLHRTSREVIKTLEKIVRDLKEVLKKNLELTERLIKRVHEVSREILRLTREN

SEQ ID NO: 25870 - protein, 59 aa, Artificial Sequence
  Synthetic
DRVKKELEDANREVNKKLEEVLREIRELHKRVLDRLDEVLRRVEEINKRVNERLDRTAK

SEQ ID NO: 25871 - protein, 57 aa, Artificial Sequence
  Synthetic
SEVEDLKRKLEEDLERHKKDVKRLKDEAERRLEEHKRLVEELERRIKKLLDELKDRN

SEQ ID NO: 25872 - protein, 55 aa, Artificial Sequence
  Synthetic
KDVLRDLERILTELAKALKDLIDNSRRTLEKLLKALRDLIRESKETLEEVLRRTD

SEQ ID NO: 25873 - protein, 56 aa, Artificial Sequence
  Synthetic
KEREEVKEKLDRLLEEVEKTVRELKREHDELLKEVEKLVRDLKKEHDELLKKVKDD

SEQ ID NO: 25874 - protein, 59 aa, Artificial Sequence
  Synthetic
KDRLDKVEELVKKLLEDTKRTVDRVRELVRKILKKSRETLEELERLIEKILRELEKDAR

SEQ ID NO: 25875 - protein, 56 aa, Artificial Sequence
  Synthetic
SERETVKRRLEELLKEVKRTLDKLKEEHDRLLEDVRRVVEELKREHDKLLKEVKDS

SEQ ID NO: 25876 - protein, 59 aa, Artificial Sequence
  Synthetic
DKRLEDISRLVKRLLDESRRVLRELEETIRKRAEESKRVLEEVKRLVEKLIRELRKEAE

SEQ ID NO: 25877 - protein, 59 aa, Artificial Sequence
  Synthetic
SEDEIIKKIIEDLRRVLKEVEEIHKEVEERLDKVLKEAEEMHKEVLKELDRVLDEVKRI

SEQ ID NO: 25878 - protein, 56 aa, Artificial Sequence
  Synthetic
ERLLEELIEELKDLIRRHIELLRRLIERLKELLKKHIEDLRRLLEEIEKLLEEARK

SEQ ID NO: 25879 - protein, 60 aa, Artificial Sequence
  Synthetic
SREDEVRKVVEKVLRDSKRSMKELRDVVTEVLKKSKEVLRELKEAVDRVLKKLKDISRDV

SEQ ID NO: 25880 - protein, 56 aa, Artificial Sequence
  Synthetic
EELVKELLEFLKRVLEKAERLVRKNLEDNKELLERLERLIEENLKLLEDLLRRTEK

SEQ ID NO: 25881 - protein, 59 aa, Artificial Sequence
  Synthetic
SEEEKLRELKEILDRTLKKIEDLIEESKRLNEEHVRLTREILDEIRRLLEELLRKLREA

SEQ ID NO: 25882 - protein, 59 aa, Artificial Sequence
  Synthetic
EEILKRIEDTLKRLKEELKRLVDEVRKHIEELLERSERLIRELRRTLEEILKRLKEKTD

SEQ ID NO: 25883 - protein, 63 aa, Artificial Sequence
  Synthetic
SAAELVLELLARVVKLLEEVLKRLIDLHRDVLKKIKDVLDRDHELHERVLRELVKVLREAERR

SEQ ID NO: 25884 - protein, 56 aa, Artificial Sequence
  Synthetic
REELEKRLRETLDEHRDLLRKLKEFLDRSLEDLERRVDEVRKELERVLEELKRKLK

SEQ ID NO: 25885 - protein, 57 aa, Artificial Sequence
  Synthetic
KEVEDIERVLRKALELSKKVSDDLERVLRELLKLSKEVIEKLVRVLEEILELLKREN

SEQ ID NO: 25886 - protein, 59 aa, Artificial Sequence
  Synthetic
EEDLRRVRELIKKVLKDLERVLKEAEDLHREVLEKLKDVVRRAAEMHEEVIRALKEVSR

SEQ ID NO: 25887 - protein, 59 aa, Artificial Sequence
  Synthetic
DEEELLREIKTILDESLKALEELIRKIMRILDKSLKDLEEIVREIKKTIDELLEKVRRS

SEQ ID NO: 25888 - protein, 55 aa, Artificial Sequence
  Synthetic
EEALDDLRRLVKELKDKLRKLLKDYKDLLKELKDEAKKLLDDYRRLIEELEKKAR

SEQ ID NO: 25889 - protein, 59 aa, Artificial Sequence
  Synthetic
SEKEKLDELRKLIEEIERELDRLLEDNKRAVEKVLRDLDRLLKKSEDDVRRVEEELDKD

SEQ ID NO: 25890 - protein, 59 aa, Artificial Sequence
  Synthetic
KDLAERIRKILDDLLEVHERVARAIEELLRELLEKNEEIVRTIKKLLKRLLDTLRKAAE

SEQ ID NO: 25891 - protein, 58 aa, Artificial Sequence
  Synthetic
SKLETVIRILEELVKVHEELLRIVKKILEELVRVHRRVSEENLRLWKELLDALREDKG

SEQ ID NO: 25892 - protein, 55 aa, Artificial Sequence
  Synthetic
EELLKRVEDVNRESRKVLEESLRRVEEALEKIERALRKSEEDIRRLMEDIKRVLK

SEQ ID NO: 25893 - protein, 60 aa, Artificial Sequence
  Synthetic
SREEKIEKLIRLVEELLERLRELLERNAELIKRLLDRLRELLKELERLNEELLKKLLEKV

SEQ ID NO: 25894 - protein, 55 aa, Artificial Sequence
  Synthetic
RELEELIKKVERDHERVIKEVEKLVKELLDRSEEIHKRAKELIKEVLDRVREAAR

SEQ ID NO: 25895 - protein, 60 aa, Artificial Sequence
  Synthetic
SREELLDRILEAIAKILEDLKRLIDENLRRLEEVVRELERIIDRNLKLIREILDELKKRG

SEQ ID NO: 25896 - protein, 59 aa, Artificial Sequence
  Synthetic
DEIIRKLDELLKEVEKVHKEVKDRIRKLLEDHKRSLDEVKKKLERLLERAKEVVEREKK

SEQ ID NO: 25897 - protein, 61 aa, Artificial Sequence
  Synthetic
SEREELLERIKEILKRVKDKLDEDLKRLKEILEKLKEKADRDLEELRRRIEEVREKLERTG

SEQ ID NO: 25898 - protein, 60 aa, Artificial Sequence
  Synthetic
SETAVRAIIRVLEKHLEAVRRVLEELLKVLAEHLETVRELIERLKRVLEEAIEVVERVAR

SEQ ID NO: 25899 - protein, 60 aa, Artificial Sequence
  Synthetic
DEERKLKELLDRLRENIRALRELIKDNLRLLKTLVDALEELLKDNLRLLRELAEEAARRL

SEQ ID NO: 25900 - protein, 59 aa, Artificial Sequence
  Synthetic
EKDVRELIKRVETALRESEEKLRRVAEELKKALDRSRKDLEEVVRRTEDLLRRLEEKLR

SEQ ID NO: 25901 - protein, 60 aa, Artificial Sequence
  Synthetic
SEEETVRRLLELLKENIEELRELLKRNLDLLRKLAEELKKLIEELARITERLAEKLAKDL

SEQ ID NO: 25902 - protein, 59 aa, Artificial Sequence
  Synthetic
EEEVRKLVEELRRAVKRVRDLLDELRRRLEEALRKSKRELETIEERTRRLLEDIKRDLD

SEQ ID NO: 25903 - protein, 60 aa, Artificial Sequence
  Synthetic
SEEEEIVKRLKELIKRNLELLDKTLKELKKTLEDIIRTLTELVKRAKEINKELIDRLREK

SEQ ID NO: 25904 - protein, 56 aa, Artificial Sequence
  Synthetic
REDIRRYEEKLRKLVEEVKKKLRDLEERLRRLVEKIRKLLEDSERRLRTMLDEIRR

SEQ ID NO: 25905 - protein, 61 aa, Artificial Sequence
  Synthetic
REKEEKVKKVREVVTELKRELDDMLRRVKEAHERLKKKHDDLLKEVREVHKRLKDRLDERG

SEQ ID NO: 25906 - protein, 59 aa, Artificial Sequence
  Synthetic
EEIKKTIEEIIKVLRELNDKLRRLSEDTIRVLEELNKEIARLLEKLVRDTKRLLDELTK

SEQ ID NO: 25907 - protein, 59 aa, Artificial Sequence
  Synthetic
SVKEVIKEVLDRVVKLIKDVIDALKTVLDRHLRLNRENIRALLEVLERILELLEELVRK

SEQ ID NO: 25908 - protein, 57 aa, Artificial Sequence
  Synthetic
LEKLLRKVRKIAKELADELRKLHREVKETHEDLKRKLDKLLKDIRKVVEDIKREVDR

SEQ ID NO: 25909 - protein, 60 aa, Artificial Sequence
  Synthetic
EKEELVEEILRRLKKMSERFSRVVEEILKLLEDSSRKVEEAIRRTIRELEKTLKRVEKDG

SEQ ID NO: 25910 - protein, 56 aa, Artificial Sequence
  Synthetic
SRELREAVKKVIADLEKILKDLRKLDKESLDKLREILKTLRDLDRKSLEELEEIRR

SEQ ID NO: 25911 - protein, 58 aa, Artificial Sequence
  Synthetic
SREEKLREDLDRVFRKNEEELKRVEKEVKKLLDDSKRKLDEVKKELEDLLEKIKRLLD

SEQ ID NO: 25912 - protein, 60 aa, Artificial Sequence
  Synthetic
DEELLRALKEVVRKVIEIVRRLLELHRETVKELARVIKEILRLHLESIKKLLDVVREVLR

SEQ ID NO: 25913 - protein, 59 aa, Artificial Sequence
  Synthetic
DEEEKVRRLKELLDRTLKKLKELVEEHDKILDELLKKLEELVRRHNKLLDDLLRRVEER

SEQ ID NO: 25914 - protein, 55 aa, Artificial Sequence
  Synthetic
EELEDTVRKLLETSKKLLDEAREVLERLHRRSEELLRRVEETLRRLEDEVRKITK

SEQ ID NO: 25915 - protein, 59 aa, Artificial Sequence
  Synthetic
DKEDKLRKIKELIRKLLETIKRLVEEHDKELDETLKKLEDLVREHDRLLDETLKRLEER

SEQ ID NO: 25916 - protein, 55 aa, Artificial Sequence
  Synthetic
EELERDLERLEKTSEDLLRRVKEEIDRLHERSKKLLDEARKKLEELLKTVKDIAK

SEQ ID NO: 25917 - protein, 60 aa, Artificial Sequence
  Synthetic
SEREELARDLDDLRRRLREAAEELKKKHEKLRRELEELAKELRKRHEELKKELDDAARRG

SEQ ID NO: 25918 - protein, 56 aa, Artificial Sequence
  Synthetic
EEVLKRILDKLMKVSEDVLRKLEDLLREVIELTKKVLDLLDELLKRVKKVLEEVMK

SEQ ID NO: 25919 - protein, 60 aa, Artificial Sequence
  Synthetic
DREKKVRDIEEDLKRVLDKLRRRVETSKEELKKVLKRDKENADELEKTLRDVVRELDRKI

SEQ ID NO: 25920 - protein, 56 aa, Artificial Sequence
  Synthetic
SEVAKELDEVIKRLLDNLKENTDRLKEVIDRNLKDLRDLAEELRRVIERLLEDARR

SEQ ID NO: 25921 - protein, 58 aa, Artificial Sequence
  Synthetic
DKEEVLKDIKRKLDDHRRRTDEIVERLERLLKEHEEKTRRLLEDVRKKLEELKEIIKR

SEQ ID NO: 25922 - protein, 56 aa, Artificial Sequence
  Synthetic
EEVLKRILDRIEELLRRLVKVNTDSLRELKRVVDELVKVDRESLRELERVLRELTK

SEQ ID NO: 25923 - protein, 60 aa, Artificial Sequence
  Synthetic
SKEEEIVRELEKILRDHLRKVERIVEDLEKLLDDHLKKIEELAKRLEEIIREAARKLEEK

SEQ ID NO: 25924 - protein, 59 aa, Artificial Sequence
  Synthetic
EEVKELLKRVEKLIDDVRKKVEDLHRELEKALRDIDRKVKRLNEELERLVEEVEEKVKT

SEQ ID NO: 25925 - protein, 57 aa, Artificial Sequence
  Synthetic
SESEELRRKLEELEKELRDVLTKDRKMLEDLKRRLDKLVKDSERRIRELKRRLDEKI

SEQ ID NO: 25926 - protein, 55 aa, Artificial Sequence
  Synthetic
REIVEELRKVIEDHERLVREILELLRKAIDDNHKLVRDLLERLKRALDETREDRR

SEQ ID NO: 25927 - protein, 58 aa, Artificial Sequence
  Synthetic
RETEETLKKLEKLLRKMLEVSKRLNEEDEKLLRTKRKLIEDLLRRVEELLEETRRVVS

SEQ ID NO: 25928 - protein, 56 aa, Artificial Sequence
  Synthetic
KDLVETLKRKLDKLLRDIRELAKDYKRKLDRLLEDVERLHRELKKELDELLKEVKD

SEQ ID NO: 25929 - protein, 59 aa, Artificial Sequence
  Synthetic
SELEKLLTDLERVIRKVVEDLRRLLEEHKKALDEDKKRDEDSNEELADAIRKVIEKLKR

SEQ ID NO: 25930 - protein, 56 aa, Artificial Sequence
  Synthetic
EEDTKRLLEKIHDDHRKLVEENERLLREDHKTLEDLIRKIKKLAEEILELTARETK

SEQ ID NO: 25931 - protein, 62 aa, Artificial Sequence
  Synthetic
DEREVLKEILDLVRRLLELALEILKRSLELLRRLAEEAKKVLDRSVELLRRLVREAKEAAKN

SEQ ID NO: 25932 - protein, 56 aa, Artificial Sequence
  Synthetic
DELVKEVEDRLRESEKKLERLLEDVERLLRENEERLRRLLEEVERLLRELAETLER

SEQ ID NO: 25933 - protein, 56 aa, Artificial Sequence
  Synthetic
SEKEEVEKRLKKVDEDTKRAVEEVKKAIEEVLRRHEEASKRVEEAIRRVLKELEDL

SEQ ID NO: 25934 - protein, 57 aa, Artificial Sequence
  Synthetic
REELLERLKELIKRLLEALKRLDEEVSKLIDELLKRLEKLAKEVLDLNRELLERTRR

SEQ ID NO: 25935 - protein, 60 aa, Artificial Sequence
  Synthetic
SDEERLDKVLKEAEDIIRELERLLRESLETLKRLIERLEKLLRDSLEELRRLIEDLARKR

SEQ ID NO: 25936 - protein, 59 aa, Artificial Sequence
  Synthetic
EDVVRMLKEVSRRDEELTRRLLRMAKKLLEDNEELSRRLVKKLDEVLKRVEEIIKRETD

SEQ ID NO: 25937 - protein, 60 aa, Artificial Sequence
  Synthetic
SREERIRKLAEDLKRKIEELLRRVRKLAEEHKRLIEKILEESERLAEELKRRAEELKKRL

SEQ ID NO: 25938 - protein, 59 aa, Artificial Sequence
  Synthetic
KEVLDELRRLLELLKKLVDRLLELNKRLNDHAKKLVEDLLRLLKKLLEEIKKLVDDARR

SEQ ID NO: 25939 - protein, 61 aa, Artificial Sequence
  Synthetic
SEEERLEEEVRRELERYRRTVRRLAEEVKEELERYEREVKKEEEKLEKTLEDLERELTRDG

SEQ ID NO: 25940 - protein, 57 aa, Artificial Sequence
  Synthetic
KKTIAEELKRVLRELTRILRELVKLNSDVVRRLLEVLTRLAKLSEDVVREILEIERE

SEQ ID NO: 25941 - protein, 59 aa, Artificial Sequence
  Synthetic
SEEEKLETVREELRRALERIEELITKNEKKIEDTLRDIRREIEENARTVKEALERIKKD

SEQ ID NO: 25942 - protein, 59 aa, Artificial Sequence
  Synthetic
KEKVDRTKEELERLKKEHRERVEETKRKLDELKKEHEREIRKTETDLRRLLKELADRAK

SEQ ID NO: 25943 - protein, 59 aa, Artificial Sequence
  Synthetic
SEDEKLRKLVEEVERTLKKLIDYLRENVEDVDRILRRLKELIDRHLKKVRELIEKLLRG

SEQ ID NO: 25944 - protein, 59 aa, Artificial Sequence
  Synthetic
KDTVREIEKDLEDSKRELERIKEEIEELLKRLEDKNERAIEEIEEDLKRLEERLREAAK

SEQ ID NO: 25945 - protein, 59 aa, Artificial Sequence
  Synthetic
SEEEKLRKTEEDLKRTLEELKKILDDHLRIIERLLREIKRVLEENKRNARRLLEEIKRS

SEQ ID NO: 25946 - protein, 59 aa, Artificial Sequence
  Synthetic
ERVLKRLEKELRDHLKRLEEIIKRLEEDLKKTLDELKRTIEDAERKLRDLERKVKEDAK

SEQ ID NO: 25947 - protein, 59 aa, Artificial Sequence
  Synthetic
SILERLVRELIRLLRELLRIHKELVERVIRVLERLLEVHKKLVETIERLLDKLAELVRR

SEQ ID NO: 25948 - protein, 56 aa, Artificial Sequence
  Synthetic
KREIEKVLREIKEELRRSLRELKRVLDEVKERLKESLERLRKLIEEIKERLDRIRK

SEQ ID NO: 25949 - protein, 59 aa, Artificial Sequence
  Synthetic
SLEEITKRLLELVEENLRRHEEILRELLELAKRLAKEDRDILEEVLKLIEELLKLLEDN

SEQ ID NO: 25950 - protein, 60 aa, Artificial Sequence
  Synthetic
ERTLREVVRKVLEEAKRLLDELEEVHKRVKKELEDIIEENRRVVKRVRDELREIKRELDE

SEQ ID NO: 25951 - protein, 60 aa, Artificial Sequence
  Synthetic
SKIEEVLERAKEVLDRLLDLHRRLVKEIEDVLDRSNELLDRLLKELEKVLDELLDIVRRR

SEQ ID NO: 25952 - protein, 59 aa, Artificial Sequence
  Synthetic
EEALKELKERIEEIKKTLRELLKELKKLNREIKETIKELSERLARAVEKIKRELEKLRK

SEQ ID NO: 25953 - protein, 60 aa, Artificial Sequence
  Synthetic
KAEEAVEKLVRIARAIVKINEDLSREVVRILREIVRLNEETTRLLVEIAREVVKVVEDAG

SEQ ID NO: 25954 - protein, 59 aa, Artificial Sequence
  Synthetic
EELLRRLEELRKRLEKVLDDSRKELEKLKRELERLLEESRRKLEKLKRDLERVLEETRR

SEQ ID NO: 25955 - protein, 59 aa, Artificial Sequence
  Synthetic
DDRRILKLLIDIIRKLVKLNEETADKLIRVIDELLKMAEESLKKVIDLVRTLVEIIRRE

SEQ ID NO: 25956 - protein, 56 aa, Artificial Sequence
  Synthetic
RKVVEELLRKVEKLIKDIRERYERLVKKVRDLVERWKELVRRLLKKAEDVIREIEK

SEQ ID NO: 25957 - protein, 58 aa, Artificial Sequence
  Synthetic
DEEDALRTIEELVKRVNEENKKILDESEDLVRRLNEKNERINKESRDLVKKLREDAED

SEQ ID NO: 25958 - protein, 55 aa, Artificial Sequence
  Synthetic
ERVLKLVEDAAREDERLNRELDRATREVAEEDKKLNEDIDKTLNDVIRELLEAAR

SEQ ID NO: 25959 - protein, 58 aa, Artificial Sequence
  Synthetic
SSVETIKKLVEDARKKLEDSIRKIEKLVRDVEKTLRDSLKRIRDLVEKVVRTLRELLR

SEQ ID NO: 25960 - protein, 57 aa, Artificial Sequence
  Synthetic
LEELVKRITDILREHVKMHEDLIRAIAKVLRDHVEAHKRLIKRITEILEEVVKAVTD

SEQ ID NO: 25961 - protein, 59 aa, Artificial Sequence
  Synthetic
DTKEEIKKLVEELLRLIEELIKRTEELNKEDNEIAERVVETHSRILRDLLRSLEEVART

SEQ ID NO: 25962 - protein, 59 aa, Artificial Sequence
  Synthetic
DDELREVLDRIRERVKRSEDKLREVLERLKRDSKRIHKDLRKALEEAKKDVDEIRKETE

SEQ ID NO: 25963 - protein, 56 aa, Artificial Sequence
  Synthetic
RREEELKRIIREIERILEELRRRSREIEEKLKKVLEEHERVSRRIKERVEDLKRKV

SEQ ID NO: 25964 - protein, 56 aa, Artificial Sequence
  Synthetic
EKDIERIVEEALKLHEDVHDENRRILEEAIRTHREVIKRLEEIVKEAIKLIEDVTR

SEQ ID NO: 25965 - protein, 56 aa, Artificial Sequence
  Synthetic
SEKELLEEIEKRAEEVLREHDKRSEEIKRELERVLKELRDLSRKIEEDLERLVREV

SEQ ID NO: 25966 - protein, 56 aa, Artificial Sequence
  Synthetic
KKDIERIVRELIKVHRDVLRKLEKVVREALELHDRVNKELREVVERALRLLREVTR

SEQ ID NO: 25967 - protein, 58 aa, Artificial Sequence
  Synthetic
SEEEILKKIEDRLRAITEKHERMLREIKKELKKVMDEHEDLLRKIEKELRDVLERLRR

SEQ ID NO: 25968 - protein, 56 aa, Artificial Sequence
  Synthetic
ATLLERIVERARRELTKNHDKLRKILERLERILRELNEDLRRILTTAVDILRKLRK

SEQ ID NO: 25969 - protein, 60 aa, Artificial Sequence
  Synthetic
REDEVLRDIERLLREIEEKIRRILEESTRELRKVEEEVKRIIERTKRELKKIKEDVERKG

SEQ ID NO: 25970 - protein, 56 aa, Artificial Sequence
  Synthetic
RDLLEKIKRVIREHIKALEKLARDLKEILRRHIEALKELARDLAEVIRKLLEDVKR

SEQ ID NO: 25971 - protein, 59 aa, Artificial Sequence
  Synthetic
DLERLVELLKRIDDEAVKLVRKLVEVLKRIDEELVRLVEELLRALRRINEEVVRLVKRV

SEQ ID NO: 25972 - protein, 56 aa, Artificial Sequence
  Synthetic
EELLKRLRRIVEESKRRVDELLKELRKISEDVAREVERLLRELERISREVKRRVEE

SEQ ID NO: 25973 - protein, 59 aa, Artificial Sequence
  Synthetic
SDEEVARELSDIVRKLVERNKESIEDAMRIVKELVDRNKKVTEDVLRLLEKLLEDVRDT

SEQ ID NO: 25974 - protein, 56 aa, Artificial Sequence
  Synthetic
EEFLRRLKEEVRKIVEKVKRDLERSLKELERILEEVKRMLERSLRELERVLKEIKD

SEQ ID NO: 25975 - protein, 56 aa, Artificial Sequence
  Synthetic
SKEEILRELEELSRRLVEKLKDLLRKLEKLSDEVVKELRKSLEELKDLADKMVKKL

SEQ ID NO: 25976 - protein, 55 aa, Artificial Sequence
  Synthetic
RLLEEIVKLLRDVAKRNLDLLEKHRELLERALEEVKRLLDEHLKLLRDALRRLKK

SEQ ID NO: 25977 - protein, 58 aa, Artificial Sequence
  Synthetic
SREDLLRKLKELIETILRKSSELLDRLLKLVREHSETSERLIRELKKILEDILKLIKG

SEQ ID NO: 25978 - protein, 56 aa, Artificial Sequence
  Synthetic
EKELRRIKEAVERVLRDHKRKNDKILRDVEEVLRRHLEELRRILKDVKKVLDEARK

SEQ ID NO: 25979 - protein, 58 aa, Artificial Sequence
  Synthetic
DDEELLKRLEDLDERLLRFSKENLEELRRRTRELIETSETLLERLREIIETILKVIRD

SEQ ID NO: 25980 - protein, 56 aa, Artificial Sequence
  Synthetic
ERFLEEIAERVERILKEHRELLKRIEDEVRRVLTEHKKKLEKLKREVERVAEETKT

SEQ ID NO: 25981 - protein, 57 aa, Artificial Sequence
  Synthetic
KETDEVVKRAKELVDTLLKVIKEHVERLKRLVEELLKVIRDHVRILRELAKRLREKV

SEQ ID NO: 25982 - protein, 59 aa, Artificial Sequence
  Synthetic
SDVERVLEELRRRLEKSVEEVERVLKRLKEELDKSVEEVKDVLRRLLEDLKRVVEELRR

SEQ ID NO: 25983 - protein, 59 aa, Artificial Sequence
  Synthetic
SEEERVLEEIKREIDRIVKRARELLEKYRELVERIKRRNEEILKKYEKLLEEIERLADA

SEQ ID NO: 25984 - protein, 56 aa, Artificial Sequence
  Synthetic
ERDLKRALRRHAEELTRLNKELNELLKEHEDELRRLLAELDRIVRKLLRTLKELTE

SEQ ID NO: 25985 - protein, 60 aa, Artificial Sequence
  Synthetic
SKEEEAKRVIDELREELRRILRENTELVKESERRITELLKENSDLVEEVRRRLEEVLEKE

SEQ ID NO: 25986 - protein, 55 aa, Artificial Sequence
  Synthetic
EDLKRLVDDVLRLAEESHRKIEELNRRTLKLMEDSHRKLKELVRKALELITELTR

SEQ ID NO: 25987 - protein, 59 aa, Artificial Sequence
  Synthetic
DSIERLAEELDKIVTDVLRVNEDSVRTWTRILEEVLRLNRELARILIDIARRVLELVKR

SEQ ID NO: 25988 - protein, 60 aa, Artificial Sequence
  Synthetic
EKELLDEVRRLLKRVKELLKRSIDLVEKILRDVKRLLDESIELVKRVLDKIRRLLEELAR

SEQ ID NO: 25989 - protein, 60 aa, Artificial Sequence
  Synthetic
SEEDEVLKTLDRKHKEAKKELDKVLRELEEEHKKVKRELDEVLKRLEDIHRRITELLRRG

SEQ ID NO: 25990 - protein, 56 aa, Artificial Sequence
  Synthetic
EEAVERVLKENKELIEEIVRLIRKILDENIELIRRIVRLLERLLRENLRLIEEARK

SEQ ID NO: 25991 - protein, 61 aa, Artificial Sequence
  Synthetic
SKEEDVRRLIEELVRELRRILEENRRMLKELVEKLEEVLRRSEEVWRRLAKELDELLKELN

SEQ ID NO: 25992 - protein, 59 aa, Artificial Sequence
  Synthetic
EEVIKKIEDLVRKTERELREVHKELRRLVEEAKEVVDRSVEILRDLVRKIVRILEESAR

SEQ ID NO: 25993 - protein, 58 aa, Artificial Sequence
  Synthetic
STEDELRKIKEELEDIRRRIEELDKKDNEDLDRIDEEIKRRLDKNIRDLDEIAKEVRK

SEQ ID NO: 25994 - protein, 60 aa, Artificial Sequence
  Synthetic
KEELAEITERLLKKYREVAEENMRSLKELLREYREVNTRTHKALERIIDRIREILEKVRK

SEQ ID NO: 25995 - protein, 59 aa, Artificial Sequence
  Synthetic
KEKEAIKEVAELLKRLIDDLLRLLKEDVDTARRVLDEIKKLLEENERIAREVLRRLRED

SEQ ID NO: 25996 - protein, 56 aa, Artificial Sequence
  Synthetic
ETDLDRIVKEMEKVLEDSIRELEKLVKRLEDILRESEKALRDLLRELRKVLEEVRT

SEQ ID NO: 25997 - protein, 56 aa, Artificial Sequence
  Synthetic
SSMETAVKLVKDLLREDIRSNEEHVRLAKKLLEEDIESNERLLRILKKLLDLVEKT

SEQ ID NO: 25998 - protein, 56 aa, Artificial Sequence
  Synthetic
REELRRVAEEIKRRAEELLRRTEELVRDILRRHEDALRRTEELVRRIEKRLRDATR

SEQ ID NO: 25999 - protein, 61 aa, Artificial Sequence
  Synthetic
RELEDVLRMIEELARRLVEILERHNKLSKRVIELLVRILEEHLKLVAELIKKAVEILRRIL

SEQ ID NO: 26000 - protein, 59 aa, Artificial Sequence
  Synthetic
DDIRKLLKELLDDVKKIIDDSRRLLDELRKELEKILKESEKLVDELREAVDRLIRKVRE

SEQ ID NO: 26001 - protein, 58 aa, Artificial Sequence
  Synthetic
SREELLKELRKLVEEIKRRSEELLRRLEKLLEDNERRTRELLERLKELLREIEERIRG

SEQ ID NO: 26002 - protein, 56 aa, Artificial Sequence
  Synthetic
RDIVRELTELVRRLLKRVEELLKRSLEILRELIKAIADAIKESLDILDRLLREVAR

SEQ ID NO: 26003 - protein, 59 aa, Artificial Sequence
  Synthetic
EEEEVLRRLRELIERLVRETEEKLKEIERRIEEVLERHRRALEELKKEIDEILEEAERR

SEQ ID NO: 26004 - protein, 60 aa, Artificial Sequence
  Synthetic
EEALRRLVEKVKRVLEEILKVSEEVLEKVKKVLTDILKRLKELVERNVRLLERILDEARR

SEQ ID NO: 26005 - protein, 57 aa, Artificial Sequence
  Synthetic
SKIEKLLRVIKKIIDKLEELLKRLLEVVRESIELLKRILDELLKVVERTADELRRIV

SEQ ID NO: 26006 - protein, 59 aa, Artificial Sequence
  Synthetic
KDLERLLRKVKEDNDRVKKEVERLLKEIEDRNRKVVEEIKRRLEEIKRELDKVVEEIRR

SEQ ID NO: 26007 - protein, 57 aa, Artificial Sequence; identical to SEQ ID NO: 26005
  Synthetic

SEQ ID NO: 26008 - protein, 59 aa, Artificial Sequence; identical to SEQ ID NO: 26006
  Synthetic

SEQ ID NO: 26009 - protein, 59 aa, Artificial Sequence
  Synthetic
KDEDKLRRIVAVLEDLIRLTEELAKILKRVTERLKELTEELKRRNEKVVEEILKLLRDS

SEQ ID NO: 26010 - protein, 56 aa, Artificial Sequence
  Synthetic
EEVVRRIRELATKNLDDNRKALEESRRIIEEIVKRIKDVIRTSREIIKELRKEIRT

SEQ ID NO: 26011 - protein, 56 aa, Artificial Sequence
  Synthetic
KEAEELVEVVRKHIKTLAEIWKKLVDALRKHVEILRRLLKELVEVIRRAIERVRRD

SEQ ID NO: 26012 - protein, 55 aa, Artificial Sequence
  Synthetic
ERLDTVLEELRRVLKELERKLRESIKELRDVLREVEERLKESIEELERVLDRLRR

SEQ ID NO: 26013 - protein, 57 aa, Artificial Sequence
  Synthetic
SEEEIAERVKDLIRRVLEEHERSVKKVEDLIERVLREHRRVLEEVRRLAEELERRLG

SEQ ID NO: 26014 - protein, 59 aa, Artificial Sequence
  Synthetic
DRRKDDLRRVLEELLKRLKELLEELKRINEELLKTLEKLARDNLEINKELIKRLDEETR

SEQ ID NO: 26015 - protein, 59 aa, Artificial Sequence
  Synthetic
SEEDVLRKLEEIVEELERSNRDAVRRLEEVVKRVEDLWEEVVRRLRELVREVEERLRDV

SEQ ID NO: 26016 - protein, 55 aa, Artificial Sequence
  Synthetic
KEIEEIIERVLRLLAELLKRVKRISEDLKRLLDELIEENADILRKLDELVTRDET

SEQ ID NO: 26017 - protein, 60 aa, Artificial Sequence
  Synthetic
DKERIIKRVLDELKEALKKAEKLHEDVLRELRRLLDEALKLHEDVLRELEELLRKIESTL

SEQ ID NO: 26018 - protein, 59 aa, Artificial Sequence
  Synthetic
REKVEELADEIRRVVKRIEERHDKLRKDIERLVRRIEELHKRLLEELEELVKRITEELK

SEQ ID NO: 26019 - protein, 57 aa, Artificial Sequence
  Synthetic
SVLETIVDIVRKLIELIEKLLRDLLELDKRNVDAVARNADKILKIAEDIVRTIASKG

SEQ ID NO: 26020 - protein, 55 aa, Artificial Sequence
  Synthetic
EDLKRELDRLIKEIEESNRRLKKTTKDLVDEVERILRKIKDDIEDVKRKIEEDKR

SEQ ID NO: 26021 - protein, 59 aa, Artificial Sequence
  Synthetic
SEDELLDRLDESVKEVLDRHRKLLEDLADTIRRVIKKVKDLLDEHKKTLEDVIEKVLRR

SEQ ID NO: 26022 - protein, 59 aa, Artificial Sequence
  Synthetic
ETVVRDLRRLLEELRRISEEIVRDLRRLLEELKKIVEDVVRESKKLLDDLRRIIDETVR

SEQ ID NO: 26023 - protein, 59 aa, Artificial Sequence
  Synthetic
SRAERLADEVRKAVKKSEEDNETLVREVEKAVRELKKNNKTWVDEVRKLMKRLVDLLRD

SEQ ID NO: 26024 - protein, 60 aa, Artificial Sequence
  Synthetic
SEELVRIAIEVLKRLLEIIEELVRLNNEILERLLKIVRELHKDNIKILEDLLRIIEEVLR

SEQ ID NO: 26025 - protein, 57 aa, Artificial Sequence
  Synthetic
SEVETLIRLIEENLRLLKEVADLSLEVIERLLRILKEIVKRSLDVIRRLLKLIEEVL

SEQ ID NO: 26026 - protein, 55 aa, Artificial Sequence
  Synthetic
ERAKKRLEDLLREHREILKEVVKRLKELLDRHRKLLDEARRESKRVLDEIDEKTK

SEQ ID NO: 26027 - protein, 57 aa, Artificial Sequence
  Synthetic
SRVETLIRVVEKNLELLREIVERSLRVIKKNLRLLEEVARLSLKVIKELLEEIKRRV

SEQ ID NO: 26028 - protein, 55 aa, Artificial Sequence
  Synthetic
RRVKEELKRLLEKHRELLKEAVKRSEDVLKEHKEVLDDVRRESEKVLEELRRAET

SEQ ID NO: 26029 - protein, 61 aa, Artificial Sequence
  Synthetic
SEKDEVTRRIRELLKEAEETNREAIERIKRLLDRVREKVEEVAKRSEELLRRLKKVLDRDL

SEQ ID NO: 26030 - protein, 57 aa, Artificial Sequence
  Synthetic
KEDLLREIARILRESLRLIRELLKEIEKIVKEIIELLERLNDELRKIIEKILETTKK

SEQ ID NO: 26031 - protein, 59 aa, Artificial Sequence
  Synthetic
SRKELLKKLREVLETNLKLIEDLVRDIERALEEDRKLIEDLLRRIEEVARRILELRERG

SEQ ID NO: 26032 - protein, 56 aa, Artificial Sequence
  Synthetic
DKRLREVIKRLIEELRRLLKEYEDVLRKVREDLKKLLEEYKRVLERVDEELRKRDK

SEQ ID NO: 26033 - protein, 59 aa, Artificial Sequence
  Synthetic
DEEKRVEDVLRRVEDLLRKLEEEHRRIVKRIRDELRESERKIEELVDRLRKEIDRIRKT

SEQ ID NO: 26034 - protein, 57 aa, Artificial Sequence
  Synthetic
KEDLLRRTEKVEREIRKTLDDLHERTRRVVEETLRKNEELLKEIKRVVETILDEIRK

SEQ ID NO: 26035 - protein, 57 aa, Artificial Sequence
  Synthetic
SKKETLVKLAEEIIADIHRVNRESLELIKRLIERVEKLTKESLDSIRKLIERILRDI

SEQ ID NO: 26036 - protein, 55 aa, Artificial Sequence
  Synthetic
DEVREIKEKVRELIDKDRRLVKEIEDLAREILDTDRKLVKRLEEVVRELIERARR

SEQ ID NO: 26037 - protein, 59 aa, Artificial Sequence
  Synthetic
DEERVLTEIEKLVKRLKDRNDEIRRELEKTSKRLEEELERIERELDRLVEELKKELERT

SEQ ID NO: 26038 - protein, 56 aa, Artificial Sequence
  Synthetic
DKDLEDLIRRVLTRVKELARRLDRKNKELLKEIERLIREDKETADRVKTEIKKKTD

SEQ ID NO: 26039 - protein, 62 aa, Artificial Sequence
  Synthetic
DEEELVRRVEKLARDIEETLERLVKELERLYREIEKELKRLVKELEDANRRIVKRLKDLFDK

SEQ ID NO: 26040 - protein, 60 aa, Artificial Sequence
  Synthetic
DEEVLRRIEKLNKELEDVLREVEERIRKLLRELEEVSRRVTERIKRLEDELRKAFEEVTR

SEQ ID NO: 26041 - protein, 64 aa, Artificial Sequence
  Synthetic
SKKEDAIRKARKLLERIRRLADKAIKRSRRLLERVRELVKESLDILRKLLERLRDLVRKIKKDG

SEQ ID NO: 26042 - protein, 55 aa, Artificial Sequence
  Synthetic
DELRRLTEEILKLHEESVKKLEDLTKEALEASEDVHRKLEKLTEEILRRTEEAEK

SEQ ID NO: 26043 - protein, 59 aa, Artificial Sequence
  Synthetic
KEKEEADRELRELKREMEDILREVEKELRELLKKSEELLEEIERLSKELTDEAREVERN

SEQ ID NO: 26044 - protein, 56 aa, Artificial Sequence
  Synthetic
RELARKLLKRLKELNDRILETLRRLNEETARLVKEVLDTARRLLEELIRVLDETRT

SEQ ID NO: 26045 - protein, 64 aa, Artificial Sequence
  Synthetic
SKEDRLREILTELKEVIDTILRKLEEDARRLKKAHEESNEKLKRIVEDLERVLRELLRKLKERV

SEQ ID NO: 26046 - protein, 56 aa, Artificial Sequence
  Synthetic
KELLDKAKEIVDRVTEEVERILEENERLWRESIKDVKRILDEAREIVRRLLEEVRK

SEQ ID NO: 26047 - protein, 56 aa, Artificial Sequence
  Synthetic
DESEKVKEILERIERSLREVKRRVDEVLKRIKELLEELKRRHDESVKELKRILEEI

SEQ ID NO: 26048 - protein, 60 aa, Artificial Sequence
  Synthetic
GEELAKTLEKLAKELLDANRRLVDTSVKLVKRLLEIVAELVERHKESNRRLLKLIEDRDR

SEQ ID NO: 26049 - protein, 56 aa, Artificial Sequence
  Synthetic
SEEDILRRVVEELERLIKEAKEIIEEIRRLHEELDRKSEELLDRLLELLRDLLRRL

SEQ ID NO: 26050 - protein, 59 aa, Artificial Sequence
  Synthetic
KDKVRRLDELVKELLERLRRLHEENTEEVERVLRESARLLDDLLRKVEEVVEKIKEELR

SEQ ID NO: 26051 - protein, 56 aa, Artificial Sequence
  Synthetic
SREELVKDILRLLTESNDEHKKLSDKLVDLVRKLIELAEKLTEEVVDLVRRLLEEL

SEQ ID NO: 26052 - protein, 59 aa, Artificial Sequence
  Synthetic
EDAKELLKKVKEIVDELVRRHKKLVDEVREVVERVVREHRELVKKDRRLVDEVLKRLRT

SEQ ID NO: 26053 - protein, 56 aa, Artificial Sequence
  Synthetic
SREDLTRETERLLRESNEKHKELTKEIIRLVDRLIKLLEELTERLKELVKELLKRL

SEQ ID NO: 26054 - protein, 59 aa, Artificial Sequence
  Synthetic
EDAKKLVKEVRDVVERVRREHDKLVKEIEKIVRDIEKKLRDLVREDRELVKKIEKKLRD

SEQ ID NO: 26055 - protein, 59 aa, Artificial Sequence
  Synthetic
SAEDLVRRVKDLVDKLEDKLRKVVRTNERLWEEIRKRLEELVRRNKELWDRLVEKLKAG

SEQ ID NO: 26056 - protein, 56 aa, Artificial Sequence
  Synthetic
IRVLVELVRRHNKVLKELVEELEKLVRDHNRVVEEVVRELVELLRRAVEVIKEVVK

SEQ ID NO: 26057 - protein, 62 aa, Artificial Sequence
  Synthetic
REKEVIDDVRRMLEDLLRTIRRVIEENKRIVKESSDHIREVLKRVLEVLRRLLEEVKRLTER

SEQ ID NO: 26058 - protein, 60 aa, Artificial Sequence
  Synthetic
RKDVERELEKIIREVEERLRRVKEKLDDIDRRAKELHEEVMKRLEELVERIRRLLEDVER

SEQ ID NO: 26059 - protein, 62 aa, Artificial Sequence
  Synthetic
SDEEILREILKTLEDVVRRLEELLKENEKLIRESTKLIKDVLDELLEIIKRVAKLIRDLKRN

SEQ ID NO: 26060 - protein, 60 aa, Artificial Sequence
  Synthetic
EETVERKLKKLLDKARTELEKIKRRLDKLNEDYERKLRELEKRLRDLLERLRKTLEDIRK

SEQ ID NO: 26061 - protein, 60 aa, Artificial Sequence
  Synthetic
SEIEKILEELKRLVERVLKLNEDIARRIAELVKKDLKLIEDLLRELEDLVRKILDALRKK

SEQ ID NO: 26062 - protein, 56 aa, Artificial Sequence
  Synthetic
KDKVVEEIRRLLKRLKEEAEKVARESEELLRRIREASKELAERAKDLLRKLDEAVR

SEQ ID NO: 26063 - protein, 62 aa, Artificial Sequence
  Synthetic
SDEERILDTLRRIIEDLLRLLREALRRHEELLRRNIELIRRVLETIKEVLRRLLKLLLEVAK

SEQ ID NO: 26064 - protein, 60 aa, Artificial Sequence
  Synthetic
REELDRLLEDVRRVIEELKKLVREVLERSERMVKEVRDLWRDLKRRIEEAAERIKDELRR

SEQ ID NO: 26065 - protein, 61 aa, Artificial Sequence
  Synthetic
SERELLEKVRKVAEENIRILEEVLRKIAEVVKEDLKLLKELLEATERVVEELLKRIVEKKK

SEQ ID NO: 26066 - protein, 55 aa, Artificial Sequence
  Synthetic
ETLERLLEELERLVKEVVERSERLLKKLLEDVRRVAEELVKSVEDLLKDIEREVT

SEQ ID NO: 26067 - protein, 59 aa, Artificial Sequence
  Synthetic
REKELVDDIRRILEEILRLLRRLLEEVIRLLEENEKLVRRHLKTVIDILRRVAKLLDEN

SEQ ID NO: 26068 - protein, 56 aa, Artificial Sequence
  Synthetic
DSLVREVEELIKRLEKHIDDLLKTSRDLVKRVLDLVDEVVKRVEDLVERVKEKIDT

SEQ ID NO: 26069 - protein, 62 aa, Artificial Sequence
  Synthetic
DEERLAEELERVLDRNRKLLEEALRELRRVIEENRKSVKRLLDELKRVLDELLKVLRELSRD

SEQ ID NO: 26070 - protein, 56 aa, Artificial Sequence
  Synthetic
EEDVERAVKEIRDRLRKLLEDYERAVRRLEDKLRRVRERYEKVLKRIKDKLEETKR

SEQ ID NO: 26071 - protein, 62 aa, Artificial Sequence
  Synthetic
SREEVLRELEEVIEDNRRLLEELIEKSKKVLDESLKLIDELLRRLEEVLERVLRLLEELSKL

SEQ ID NO: 26072 - protein, 56 aa, Artificial Sequence
  Synthetic
EDDLKRVVDEVEKKLRELKRRYKEALERIKEKIKELKDRYERAVREVVAELRKTTK

SEQ ID NO: 26073 - protein, 56 aa, Artificial Sequence
  Synthetic
KKDEEIREKLDRLLEENRRALEEITTRLDDLLRRNKDALRKVMEKLKRLLDDLRRA

SEQ ID NO: 26074 - protein, 55 aa, Artificial Sequence
  Synthetic
ERVKEILERILRVVEEAVRLNEESLRRILDVVRKAVKLDRESLKKILDVVEEAVR

SEQ ID NO: 26075 - protein, 61 aa, Artificial Sequence
  Synthetic
SRVEELKKLIEDILRISREVVERIKRVAEDIHRINRRVLDDLRKLIEDILRTVEEILARKV

SEQ ID NO: 26076 - protein, 55 aa, Artificial Sequence
  Synthetic
DEVEREIRRVKEDLDRILEEYRRLLEEIKRKLEEILRRVEELHRRLRRKLEEIDR

SEQ ID NO: 26077 - protein, 60 aa, Artificial Sequence
  Synthetic
SRVEKVLELLKRIIEILRELVKVHLDVLRHNDELLKRIVEDLKRLVKKLVDILKEIVEKR

SEQ ID NO: 26078 - protein, 55 aa, Artificial Sequence
  Synthetic
EEALERLKRLLEEIRERLEELKKRLEESLKRHEEEVRKLLDKLRRLLRRAEEEAR

SEQ ID NO: 26079 - protein, 58 aa, Artificial Sequence
  Synthetic
SKEDELRKVLETLERLARELEELNKKILDDLKKLIEELRRHTEEVMRRLKELADELRK

SEQ ID NO: 26080 - protein, 54 aa, Artificial Sequence
  Synthetic
EVVRVLEELLRLVRDNVRRLDEILKELLRLVEESVRTAEEILKELLRLIKELAR

SEQ ID NO: 26081 - protein, 59 aa, Artificial Sequence
  Synthetic
SIEELVDELLKVLKEVVEETAKLLEENNRRLKKITDDVRRLNEDTIRRLREVVKELETK

SEQ ID NO: 26082 - protein, 56 aa, Artificial Sequence
  Synthetic
DDKARKALEDLERELRDVDRRSDEEATRLHEEHKKALDRYVKELKRVLDKMKEDTR

SEQ ID NO: 26083 - protein, 59 aa, Artificial Sequence
  Synthetic
SEKELVDKLIKLLEDVVKKLEDIARDNNRILKEIADRVKELNERTVEEIKRVIEELRRK

SEQ ID NO: 26084 - protein, 56 aa, Artificial Sequence
  Synthetic
EEKLTRAAEDLLRKLRRVDEESDKKLREVHRKHKEALEEVKRRLKEITEEADRATR

SEQ ID NO: 26085 - protein, 62 aa, Artificial Sequence
  Synthetic
SESELIRELEKLVKEIVDELERLLRNNIRLLEEVAKTLIRLLENNIELLDEILRELERLSKE

SEQ ID NO: 26086 - protein, 56 aa, Artificial Sequence
  Synthetic
EEEVRRTIERLKEEHEDALRRLKEILEELKDEHRRVLKRVKDKLRELKRRLEEREK

SEQ ID NO: 26087 - protein, 57 aa, Artificial Sequence
  Synthetic
SEREELERLLKELEDVTREVVERLKKLLRDNEKLTDEVRKRLRDLLRRLEEMVRRRG

SEQ ID NO: 26088 - protein, 56 aa, Artificial Sequence
  Synthetic
EEEIEEIVKRLVEVLEKVLRELERASRKLVKVVEEVLRALEEISKELVDVVREVLR

SEQ ID NO: 26089 - protein, 60 aa, Artificial Sequence
  Synthetic
DEDRRLEDAVRKLRKEHKDIMKKLDDIMRELDEDHRRIKERLDRILEELKKLLTRVLRET

SEQ ID NO: 26090 - protein, 54 aa, Artificial Sequence
  Synthetic
EIERIIRRVIEVIREILDLVRKVNKKALRVIEEILEDLARVNKKAVDAIDELRK

SEQ ID NO: 26091 - protein, 58 aa, Artificial Sequence
  Synthetic
DEERLLKTILDVIRKVLKESKDILRRVEEILRRVIETAKEIHKEVKEIIEDVLRLLRE

SEQ ID NO: 26092 - protein, 60 aa, Artificial Sequence
  Synthetic
EEEIEKRVREIKKEVEDLLRRSEELLKELLDRIRKLLEELKKRHEDLLREVKKDLDEIRR

SEQ ID NO: 26093 - protein, 61 aa, Artificial Sequence
  Synthetic
DEVEELLKRVRELLKRSEELVRKILEDVKRLLERSIEEVEDLLRKVEELLKRLLDLVERRK

SEQ ID NO: 26094 - protein, 56 aa, Artificial Sequence
  Synthetic
EDLDRDVDRVLKEIMDLLRDLVRRTKELLEELLRLLEELVRRHKELVRKILDEIRK

SEQ ID NO: 26095 - protein, 59 aa, Artificial Sequence
  Synthetic
REAEELLRELEELLKKSEKVLEDLLRKNRELIKDSKRRLDEVRRKVEKLAEEVEEVIRR

SEQ ID NO: 26096 - protein, 56 aa, Artificial Sequence
  Synthetic
KDAVRKLIEELKKLLEDLVEHHERLLKEDHERLKRLLDHHRELLKTVLTILRETAK

SEQ ID NO: 26097 - protein, 59 aa, Artificial Sequence
  Synthetic
ELDEILRKVVEDSRRLVKELEDILREVIERTERILEEHRDLTRKADEDIRRILEEATRT

SEQ ID NO: 26098 - protein, 57 aa, Artificial Sequence
  Synthetic
KEEVLKDIVRVLRDVLKKANDLLKTHLDLNRESVKKVVEIARRHVKMNEDSVRKVEK

SEQ ID NO: 26099 - protein, 59 aa, Artificial Sequence
  Synthetic
DVEDVLREVVERSRRLVEEHKRISEKVIRDTKRILDEHRELTERVIRRAKKLVDDARRT

SEQ ID NO: 26100 - protein, 57 aa, Artificial Sequence
  Synthetic
KEEVLKDAVRVLEEILRKLNELLERHLKLNEESLERMNRILTRHVKLNKESADDARR

SEQ ID NO: 26101 - protein, 59 aa, Artificial Sequence
  Synthetic
DEEELLRRVTEELKRLLDEARKLHEDVKRELEKLLKENDDLLRDVKRKLERLLEALKRG

SEQ ID NO: 26102 - protein, 57 aa, Artificial Sequence
  Synthetic
KDKLLERIRRLLETLLEVLKRDNEEIKRILEELLRVAEENLRRIKEIIDRLLDATRR

SEQ ID NO: 26103 - protein, 59 aa, Artificial Sequence
  Synthetic
DEEEVVKRLADVLRENDETIRKVVEDLVRIAEENDRLWKKLVEDIAEILRRIVELLRRG

SEQ ID NO: 26104 - protein, 59 aa, Artificial Sequence
  Synthetic
EDVKRALEELVKRLRKLLEDVKKKSEDIVREVERIVRELKKRSDEILKKLEDIVEKLRE

SEQ ID NO: 26105 - protein, 56 aa, Artificial Sequence
  Synthetic
KEREEIRERVKRILETSRKLLEELAKAVEDVLRRSKELIDELRDAVRRVLEELERG

SEQ ID NO: 26106 - protein, 59 aa, Artificial Sequence
  Synthetic
DRTKKIVERIIELIEELLRLLVKVVEDSVRLIEELLKLAEEVAKRSLKLIEDLLRAIEK

SEQ ID NO: 26107 - protein, 58 aa, Artificial Sequence
  Synthetic
SDDEVIEKVKEDLRRLIKEAEDVVREYEKRLREVEKKLDEVVKESERLLRELLKKLEA

SEQ ID NO: 26108 - protein, 60 aa, Artificial Sequence
  Synthetic
KKELIKILRDLARKHRELLKRLKELTREHLKRVREILEELLRVTRELVEEIDKILKDLKK

SEQ ID NO: 26109 - protein, 58 aa, Artificial Sequence
  Synthetic
SEDEVLERIRRALERVEDEHRKVLEKIVEDLKDVLEKHKRVLEEAKRDLERIKEDADK

SEQ ID NO: 26110 - protein, 60 aa, Artificial Sequence
  Synthetic
EKSLKDLLREVLERSKKLLEEHHKHLEEIVRRTKELLERHHRHLKEIIRRIEEILKRERD

SEQ ID NO: 26111 - protein, 59 aa, Artificial Sequence
  Synthetic
SKEDELREVLERVKRLIETVKRALDEALDRTRRLIEELDKTSKRVLTTVKKLIEDARRE

SEQ ID NO: 26112 - protein, 57 aa, Artificial Sequence
  Synthetic
ERDLLRELLRIVKEHVDEVRKLLDELRKVNEKIVDAVRKILEKLLKIATDAIEETRK

SEQ ID NO: 26113 - protein, 61 aa, Artificial Sequence
  Synthetic
SEKERLMEEIKRVAEELRKTVDRLRERNEKVVRDIRETVREVEREHEDVVKELADRVRELR

SEQ ID NO: 26114 - protein, 62 aa, Artificial Sequence
  Synthetic
EEVREVLRRLTKILRDLLKRNKEIMEKLLRDLKELLKENKKALEDLLRKLEELLRRIAEAEK

SEQ ID NO: 26115 - protein, 57 aa, Artificial Sequence
  Synthetic
SKEETTKRLLDRHLERDRELLDRAARTNEEILRRNREVLKELFELLKRILDRVREAN

SEQ ID NO: 26116 - protein, 59 aa, Artificial Sequence
  Synthetic
EEVLRELRELLKRLKKRLEELLREHEKLLEDYKDRLRKSDDDLRRSVEEIKKALDRLRK

SEQ ID NO: 26117 - protein, 57 aa, Artificial Sequence
  Synthetic
SKLEDSAEKLKEHLKRDRELLKRAEDLLREILRRNREVLDELRRTLDDILRRIREEN

SEQ ID NO: 26118 - protein, 59 aa, Artificial Sequence
  Synthetic
KEVLDRLEKLLRDARKRLKELLDEHEKVLEDMERRLRESLDDLRRSLDRIRKDLKRKTD

SEQ ID NO: 26119 - protein, 62 aa, Artificial Sequence
  Synthetic
SEKERTKELLERLLKLIRELLKKLEDLNRDLLRRVKEVLDRLAELNEELLRRVEEVTRLRDE

SEQ ID NO: 26120 - protein, 60 aa, Artificial Sequence
  Synthetic
KEKLTKLIKEIKERSKRLLEEVKRALEEVMKKNEKILRDVRDDLRRAREELREILREADD

SEQ ID NO: 26121 - protein, 60 aa, Artificial Sequence
  Synthetic
REEEKLKETLERILRELEKLAKENKELLERILKRDEDLTRENKETLDRLLKRVEEVTRRK

SEQ ID NO: 26122 - protein, 60 aa, Artificial Sequence
  Synthetic
DREVEKVLRDIKRKIKEIVDEHRDMNRKIKEEIDRIDTEYKKSLKDIKKEIEEVLDEARQ

SEQ ID NO: 26123 - protein, 59 aa, Artificial Sequence
  Synthetic
RKEEAIERIRREIEKVRRRLREVHKESEERIRRLEDEYRRALETSAELIRRILDELRKN

SEQ ID NO: 26124 - protein, 59 aa, Artificial Sequence
  Synthetic
KRVKDIVRKILRVIEENLKFVAEAVKKLKEIIERNLRLLEEIAKLLLDILEEVLKRLTT

SEQ ID NO: 26125 - protein, 59 aa, Artificial Sequence
  Synthetic
REKEVIEDIKRLLDEILKRLEEANKETEERLEKLRKEYRELLEDSKRKIKDIEAELRRL

SEQ ID NO: 26126 - protein, 59 aa, Artificial Sequence
  Synthetic
EAVKEIVKRLKEVIKDNLRVVEELVRKLKEIIEDNLRVLREIAKLLKDVLEKLLRDVRK

SEQ ID NO: 26127 - protein, 56 aa, Artificial Sequence
  Synthetic
DKDKRLEELLKRLKELNDKTFEELERILEELKRANERSLREAERILEELRRRIEER

SEQ ID NO: 26128 - protein, 59 aa, Artificial Sequence
  Synthetic
KDVKDIIRTILEVARDLLRLLEEDSRTNSEVVKRLLDLLREDSKANSEVVKRLLDVLRE

SEQ ID NO: 26129 - protein, 56 aa, Artificial Sequence
  Synthetic
SKEETLKRLLDELEKRNRETVERLERLLKELEDRNRRSLEELERVLEELERKIEES

SEQ ID NO: 26130 - protein, 59 aa, Artificial Sequence
  Synthetic
REVKDIVRKMEEVIRRLIEILRRDVELNLDVAKKLLELLKEDSKLNLDVARELLELLDR

SEQ ID NO: 26131 - protein, 57 aa, Artificial Sequence
  Synthetic
RELELLDELLRRTERLVKEYLRVSKELLEETLKLLTELLKLSKRLLEETERLLRRDK

SEQ ID NO: 26132 - protein, 60 aa, Artificial Sequence
  Synthetic
KTELLEEAVKRLETLLRRYKEEIRRVAKRLEELLRELNELSKRLEETLKKLLEDLREDAR

SEQ ID NO: 26133 - protein, 57 aa, Artificial Sequence
  Synthetic
DEEETLRRLLERKVELAKEYLDVSKEVIDRTTKLLDEYLKTSKRIVDKTVELLERDD

SEQ ID NO: 26134 - protein, 60 aa, Artificial Sequence
  Synthetic
LRERLEEARRRLEELLRELNEITKDLERKLEKLLRDLNELTKRLEEELKRLLDELKKRTD

SEQ ID NO: 26135 - protein, 61 aa, Artificial Sequence
  Synthetic
SEEDELVKRLRELVKELIDAIREHLRRLEELLRELLKALEDHLRKLAELVRRIIEELRRTN

SEQ ID NO: 26136 - protein, 59 aa, Artificial Sequence
  Synthetic
EELKERIRRIVETIRRSLERLKEEADRIVKEIEKSLRELEERLERIVDTIRKLLEDAKR

SEQ ID NO: 26137 - protein, 61 aa, Artificial Sequence
  Synthetic
SEDDVLRKLLEAIKKLLKETKEILDRYLRESDRHNKALREILERLLELIKTLLEDLVRRTG

SEQ ID NO: 26138 - protein, 59 aa, Artificial Sequence
  Synthetic
EEALKEIKRKLRELEKEIRKVVEDSRRISEESLRRLEKALEDIERILKKLSDEIRTDAT

SEQ ID NO: 26139 - protein, 58 aa, Artificial Sequence
  Synthetic
DEEEVTKEVERLNRELLKRLREIVEETKDLNRRLLEILEELVRRTEKLLKDVLEIRKR

SEQ ID NO: 26140 - protein, 56 aa, Artificial Sequence
  Synthetic
KDRLREELKKLLEELRRVLEDAKRKSEELSRRLEEVLRRAEEKNKEIMDRIRKARE

SEQ ID NO: 26141 - protein, 57 aa, Artificial Sequence
  Synthetic
KEKEELLEEVERKVTELKKRSEDLVRKLDEEVKRLEREHEELLKKLRDAVEELRRAK

SEQ ID NO: 26142 - protein, 60 aa, Artificial Sequence
  Synthetic
RETVLRKIIRLVEELLKILARINEEVKKLIRKLLEILTRINKKMIEVIDELVKIIREAAT

SEQ ID NO: 26143 - protein, 56 aa, Artificial Sequence
  Synthetic
SEEERTKESLKKVLKALVDLNRELLRKLEENMRELTKLNEEVKRKLKEVLDKVREN

SEQ ID NO: 26144 - protein, 59 aa, Artificial Sequence
  Synthetic
EEIRKIVEEILKEIKELADRYREEVRKSKDKLRRILEDYKRKVDELKERLRELIEEVET

SEQ ID NO: 26145 - protein, 59 aa, Artificial Sequence
  Synthetic
SLKELAEEVLRRILELLRRIIEIHERSLERSNRTLKKLIDEIERVMREILETLKRALSI

SEQ ID NO: 26146 - protein, 56 aa, Artificial Sequence
  Synthetic
RTLLEEIRRRVEKVIREARETLREHRERVERSIEELRRMLEDVERIVREAIERLRR

SEQ ID NO: 26147 - protein, 61 aa, Artificial Sequence
  Synthetic
SEVEDILRRLAELNKRLIDKLRELIDRIRRLNEELLRVVEDILRRLKRLADELIRVVRERG

SEQ ID NO: 26148 - protein, 56 aa, Artificial Sequence
  Synthetic
DEDLKRLLEKLKEDVERVLKEVRDRTRESLKHLEDVIRELEKKTEDSLRHMEERRK

SEQ ID NO: 26149 - protein, 57 aa, Artificial Sequence
  Synthetic
SKEELVKEALEENVRSVEEVIKLLKDALDENLKVVERVIRELKRALERVKDVIRKLI

SEQ ID NO: 26150 - protein, 59 aa, Artificial Sequence
  Synthetic
KKVADELKKLLDELKKILEEIRRMLEEANRKHDDIVRDIRRVLEENDRKLEKIADDIRR

SEQ ID NO: 26151 - protein, 57 aa, Artificial Sequence
  Synthetic
SKKEELEKLLDTNLTEIRRLLKRVKDVLDRNLEVVRRVIEELARLLDEVTEVVRRLI

SEQ ID NO: 26152 - protein, 59 aa, Artificial Sequence
  Synthetic
EKVKRELEKLIKRVKDILDDIRRRLKKVNEEHEREADRLRRELERLDRELKKRMDDIRR

SEQ ID NO: 26153 - protein, 56 aa, Artificial Sequence
  Synthetic
DEDEELKERTKKSLEKLRRLLERLEKIIRESLDKLRDLLRLLEEALKRILDELRRN

SEQ ID NO: 26154 - protein, 56 aa, Artificial Sequence
  Synthetic
RDKLEKIERDIRKIIRDLEEIARRLKEDHERVIKELRETVKKHKEDLEEVIRELRR

SEQ ID NO: 26155 - protein, 55 aa, Artificial Sequence
  Synthetic
REKEDVARRIKRIHDELETRIRKLARDLERIHRKLKEDIERLVREAEKKLRELEK

SEQ ID NO: 26156 - protein, 55 aa, Artificial Sequence
  Synthetic
EEIERLVEELKKILETILKLIAELNEEVVRLLEDILRLVRELNERVAELLERAEK

SEQ ID NO: 26157 - protein, 60 aa, Artificial Sequence
  Synthetic
DEERIIKTLEDINKKLVEDIKRILDKVRELNERLADAIRKILEETKRILERTTRKVRKDG

SEQ ID NO: 26158 - protein, 56 aa, Artificial Sequence
  Synthetic
KDTLRTVEKLVEDVKRRLDKLLEDYKRLIEEVKKELDKLLKEYEDRLREIKKRIDE

SEQ ID NO: 26159 - protein, 59 aa, Artificial Sequence
  Synthetic
DLEDAIRELLRRLTELIEELVRILEELNKRLNDLVRRLVEILRRINELLKKLVDRLRKD

SEQ ID NO: 26160 - protein, 59 aa, Artificial Sequence
  Synthetic
ERELKKVLDDIREKVKKTIKEIDEVLEKITRENERTRKEIEEMLRTLRELIKRLLEETK

SEQ ID NO: 26161 - protein, 56 aa, Artificial Sequence
  Synthetic
SEEDEVAKTLEDILRRLEELLREHHELHRRILEELEKLLRDHIKLHKDILDEATKS

SEQ ID NO: 26162 - protein, 56 aa, Artificial Sequence
  Synthetic
KETLKRLKDRSKELNDRVRETLKRLAERSKRLNEKVEEDVRRAVEELRRLLEEIRK

SEQ ID NO: 26163 - protein, 56 aa, Artificial Sequence
  Synthetic
DERKVIEDLVEVLRDLLRVIKEVLDRNVKLIKDLLRLNLKVAEELIRVLKELLDRL

SEQ ID NO: 26164 - protein, 55 aa, Artificial Sequence
  Synthetic
EELDRIRKELKRLLDELTKLHEDVRKKSEELVREAERTLEDVKRKLDELLERAKK

SEQ ID NO: 26165 - protein, 60 aa, Artificial Sequence
  Synthetic
DEERELERLLEDVRRRHEELLRRLEKLLEDIRKLYEDVRRKLKRLLERVDRLVREILRRD

SEQ ID NO: 26166 - protein, 58 aa, Artificial Sequence
  Synthetic
ELIKELADIVKEILRLAEELAKELEKINRELDRVTRELIKDLLRISRELIKRLEDTTR

SEQ ID NO: 26167 - protein, 58 aa, Artificial Sequence
  Synthetic
SDKELLDDTIRKMRKLHRDSVELLDDIRRKLEELLRKVRELLDRNVKKIRELIELRKK

SEQ ID NO: 26168 - protein, 56 aa, Artificial Sequence
  Synthetic
DSDLEDLIRRDIEELKKVIEKLEELVRRIEELLREAKERDKESLDRIEDELRKAKK

SEQ ID NO: 26169 - protein, 58 aa, Artificial Sequence
  Synthetic
EEDDLLKANLDTLRELHKESEKLLRDIEETAKELHKKSEELLKRITDELDRLVKLSRK

SEQ ID NO: 26170 - protein, 56 aa, Artificial Sequence
  Synthetic
DSDIKRILDDLRRRLEDALRRDRETLKRLKEEIERVKKEDRRSLERDKEELEKARK

SEQ ID NO: 26171 - protein, 56 aa, Artificial Sequence
  Synthetic
SAAELILKAAKEAAEANREAAELALKAAEESARAAREAAELALKAAKEAAEAARRG

SEQ ID NO: 26172 - protein, 56 aa, Artificial Sequence
  Synthetic
KDDLTRAADELLKKAKKLADDYKRAADRLLKEAEDLAREWKKLADKALEDAKRDAD

SEQ ID NO: 26173 - protein, 56 aa, Artificial Sequence
  Synthetic
KAEEAAKEAARLAKEDADLAKKAAEDAAELHERHAKLLEDSARTAAELAKRLAEAA

SEQ ID NO: 26174 - protein, 59 aa, Artificial Sequence
  Synthetic
KEDLDRLAKIAKEAADALEELLERSKESAERAARALEKLLKEWADSAKKAADALEELDR

SEQ ID NO: 26175 - protein, 60 aa, Artificial Sequence
  Synthetic
DELETLKKEAEDVLRELRDILRKLEDLSRKTIEDMRRIVEEVLKLNEDSIRELKRIIEEL

SEQ ID NO: 26176 - protein, 55 aa, Artificial Sequence
  Synthetic
DEVVKKLEDVSRKSIDDLRKIIETLREVVERSIEEIERIIRDLERVIREIIEREK

SEQ ID NO: 26177 - protein, 57 aa, Artificial Sequence
  Synthetic
SKIEELAKIAEEHAELNRRAARKNNEIAKEAAELWKRAAEKHVRIAERAADAIRKAA

SEQ ID NO: 26178 - protein, 59 aa, Artificial Sequence
  Synthetic
EKALREAKELAERAARENREALKEAKELAKRNSEKAKESAKEHKKLAEDANKRAEEATR

SEQ ID NO: 26179 - protein, 59 aa, Artificial Sequence
  Synthetic
DEEEVIEEILKTLEEINRRVLKLIKDILEKVKRVDDEIKTLVKEVLRENERVLREVREK

SEQ ID NO: 26180 - protein, 59 aa, Artificial Sequence
  Synthetic
EKMLEDILRRLEEINRTSLRLVDEVSKKTREVLERILKLVKEVLDESRRVAKKVKDDLK

SEQ ID NO: 26181 - protein, 57 aa, Artificial Sequence
  Synthetic
SAVDIAREAARRVIELLKRSAEAAEEAARRSIKLAKESADAAREAAKKVIEILKRAA

SEQ ID NO: 26182 - protein, 56 aa, Artificial Sequence
  Synthetic
EDAARKAAEIAARAAKRSADTAKRWAEVAKEAAEESAKSAKKAAKIAEDAAREIEK

SEQ ID NO: 26183 - protein, 57 aa, Artificial Sequence
  Synthetic
DLREAAKEAIDAAEEAARRTEEAAKENIRALEEAAKRTRDAVRRAIKAIEDAVRDAG

SEQ ID NO: 26184 - protein, 56 aa, Artificial Sequence
  Synthetic
REDLERIAREAAERAKELADRLEEIYRRAAEESKRLAEELKRIYKRAAEEAKKAAD

SEQ ID NO: 26185 - protein, 57 aa, Artificial Sequence
  Synthetic
SKIEELMKLVEKIIRKTLDLVRKHAEVSKEVLKEYIRISKEHLDVSKRVAEELKKEI

SEQ ID NO: 26186 - protein, 59 aa, Artificial Sequence
  Synthetic
KEDLDRIRDTLRRVIERSKRIHDRLREMLEEVKRRSEEIVERIERELRDVARKLEETLR

SEQ ID NO: 26187 - protein, 59 aa, Artificial Sequence
  Synthetic
SLTEELRRVVKEIEEVVRRDVRTLEEVVKKITEVVRRDDKSLREVVKRNEELVRLLARG

SEQ ID NO: 26188 - protein, 60 aa, Artificial Sequence
  Synthetic
EKDRREILRELVELTERSVEEIARVNKELVDIVRELVKELKRLNERLVELVKRLVEETAT

SEQ ID NO: 26189 - protein, 56 aa, Artificial Sequence
  Synthetic
RAIETLVDVVREAIEINKRLVDRNVESNKELAKLNRDLVRRNRESNTELADLVRRD

SEQ ID NO: 26190 - protein, 60 aa, Artificial Sequence
  Synthetic
EEELKRVVDEIVELLKRVLETTEKVVRDNVRLLEKALRSSKKVLDENVKKLEDVLRDLKR

SEQ ID NO: 26191 - protein, 56 aa, Artificial Sequence
  Synthetic
SAAEALAKLAKENAELNRELAERNARSNKELAELNEEAARRNAKSNKELAELARRE

SEQ ID NO: 26192 - protein, 60 aa, Artificial Sequence
  Synthetic
EEELKRAIEEAAKLLKRAADETRRAAKENAEALEKAARESKEAAKDNAEALKKAAEEAKK

SEQ ID NO: 26193 - protein, 58 aa, Artificial Sequence
  Synthetic
TEEEVVEDVKRVLDESHDDLRRLIETLTRVLRESLKRIKEALEELERVLKKLLDLLEG

SEQ ID NO: 26194 - protein, 56 aa, Artificial Sequence
  Synthetic
REEVKRVLEEARDELRRLLEEYKKIIEELERELERLLREHREVIRRIKEEIDKSSK

SEQ ID NO: 26195 - protein, 59 aa, Artificial Sequence
  Synthetic
SEVERAVEDVKRALEENVRLSKELVDRVTKMAEDNVKLTKDIVDKVRRILEELVEVIER

SEQ ID NO: 26196 - protein, 56 aa, Artificial Sequence
  Synthetic
KDEVRKIVRELVEEAKKVVEYDTENAKRVVEELKRVVKRDADVVRKLVELLDRKAR

SEQ ID NO: 26197 - protein, 59 aa, Artificial Sequence
  Synthetic
SELEEAVKRVRDALRENLDSIRRLVEKIRRVLEEHNKLSKELVDRIEEVLRRTVEAVKK

SEQ ID NO: 26198 - protein, 56 aa, Artificial Sequence
  Synthetic
KRDVARVVRELIELVKRVLERDKRIVDELVKLVDEVLKRNKEIVDELVRLVDEARR

SEQ ID NO: 26199 - protein, 56 aa, Artificial Sequence
  Synthetic
SELEDLIRLLREVIKRLEESVKELVDIVEEAIERLRKIVKELIDLSRKVIDELLEL

SEQ ID NO: 26200 - protein, 59 aa, Artificial Sequence
  Synthetic
EELLDRIRRLIEESIKKLARIADRLRKLIEDLRRLLEELLRRNEELIERLERMLDEKAR

SEQ ID NO: 26201 - protein, 60 aa, Artificial Sequence
  Synthetic
SEKEEAAKAAEEAAEIAERADEKAARSSKEAAKIAEKADKEAAESTRKALDDARRALEEA

SEQ ID NO: 26202 - protein, 59 aa, Artificial Sequence
  Synthetic
EDAARRAEKAARENADSIRRAAEKSRKAAEDNARSIEKAARESEEAAERAARILKRAKD

SEQ ID NO: 26203 - protein, 57 aa, Artificial Sequence
  Synthetic
KEVEDVVEKLRELIDRALDRNRKVVEEVRDVVRRALEENRKVVEEVRKVIKEILDRV

SEQ ID NO: 26204 - protein, 55 aa, Artificial Sequence
  Synthetic
KEATDLIRELIERLRKVLEKSRRLIDRLVKLSRDVLEETKRLVEELIREVKRAET

SEQ ID NO: 26205 - protein, 60 aa, Artificial Sequence
  Synthetic
KLEEIVKKLEDLNKKAVEILRRVLEEHEKLVEKVKKVLRDVLRLLEKVVREVIETLKKKD

SEQ ID NO: 26206 - protein, 56 aa, Artificial Sequence
  Synthetic
EEVLRKLKEIIKELKDRLKKLLDDYERIIDELRRELERVLREYEKILEDLRKELED

SEQ ID NO: 26207 - protein, 60 aa, Artificial Sequence
  Synthetic
SELEEAAKALERIAKKAAKAARDWAEEDRRLAEEAIRAAEEWAKENKKLADELAKAAKDN

SEQ ID NO: 26208 - protein, 56 aa, Artificial Sequence
  Synthetic
SDEAVRALEEAAKRSEDAARKAAKLARDAAEKSRRAAEKAIRLLEEAAKEAKDAAR

SEQ ID NO: 26209 - protein, 57 aa, Artificial Sequence
  Synthetic
KEAEEIAEAVKRLAEASAKTAEELARAVRKAAEDLVKLAKEHADALRTAADRIAKLI

SEQ ID NO: 26210 - protein, 59 aa, Artificial Sequence
  Synthetic
EDIRREIKRIADELKEITKRLEDEVEKIIRRLEKIAKEAEDRHRKLAEELRRIAEEAKR

SEQ ID NO: 26211 - protein, 59 aa, Artificial Sequence
  Synthetic
SVDEALEELVRRLLEVLKTVLERTKELSRDDLRVVKEVLRIIEELVKRLLKVIRDGLDD

SEQ ID NO: 26212 - protein, 59 aa, Artificial Sequence
  Synthetic
EDVRRDIERLLEELKRRVERLLEDIERLLRELEKLNEDVLRENKKLLEDLERRVRERKK

SEQ ID NO: 26213 - protein, 60 aa, Artificial Sequence
  Synthetic
DEERIVREIVKIIEEAVKELVRLVREDIELVKDVVRRHNRLNEEIVKLWKELVDEVLKSR

SEQ ID NO: 26214 - protein, 56 aa, Artificial Sequence
  Synthetic
KDLLRRAEEEIRRLLKENEDILKRVEEEVKKSNEELRRILDRVRRELEKALKRLRD

SEQ ID NO: 26215 - protein, 60 aa, Artificial Sequence
  Synthetic
SKEEEVKRLIDELKRVNERVNKTIKELVKLLEESHEEVLKEIERLIREVLRVIKEVIEAV

SEQ ID NO: 26216 - protein, 59 aa, Artificial Sequence
  Synthetic
KEALDKLVDAARRVLEAVRDVLRKDERSVERVLDEVRRVAEELERTHREVVKRVEDAAR

SEQ ID NO: 26217 - protein, 60 aa, Artificial Sequence
  Synthetic
DKEKTVADLIEKVERSHERVLKRLAELIEELKRVNERVNREIERLIRELEEVIDRVIKAV

SEQ ID NO: 26218 - protein, 59 aa, Artificial Sequence
  Synthetic
REMLEELVRVARRVLEAIKTVADELRKRHEEVSREIERVAEEDKRTVEEVLKRIEDAAR

SEQ ID NO: 26219 - protein, 60 aa, Artificial Sequence
  Synthetic
KDEEIIKRLEDLLKENVDRLREILERVERTHRKVIEELKRILEELEEILRRVIEKLRRKN

SEQ ID NO: 26220 - protein, 55 aa, Artificial Sequence
  Synthetic
RDVERLLKELKRIVEEILRLVRELVTRDIDALRRLLESVRRLVDKLIRIVEERRR

SEQ ID NO: 26221 - protein, 60 aa, Artificial Sequence
  Synthetic
SDKDRLLEEIKRLIDESRRKAEEILKRSTELLEDSKRDLREILRRSEKILDELLDLIRRN

SEQ ID NO: 26222 - protein, 60 aa, Artificial Sequence
  Synthetic
SKEIKDALRRVLEKHKKVLREAIKKHEESLEEHRKVLEEIIELHKRSLKKLEDVIDTVRK

SEQ ID NO: 26223 - protein, 60 aa, Artificial Sequence
  Synthetic
SKEELIKELKETVKRIIKLLEELSKKMEEIIKRIAELLRELSKKLVDIIKRIIELLRREG

SEQ ID NO: 26224 - protein, 55 aa, Artificial Sequence
  Synthetic
EEILKEIKRLLDESKERLDRVLREIEELLRRYEEEVRRVLEEIKKILDELRERIR

SEQ ID NO: 26225 - protein, 56 aa, Artificial Sequence
  Synthetic
DTERAADEARRRLEKLARDHKEKLKKAAEDLRRLLEEAERAHRKIEKELEELTRKV

SEQ ID NO: 26226 - protein, 57 aa, Artificial Sequence
  Synthetic
AERALKEAADRAREALRRNLRALREAVREAEEAIEKDARAIDEALKKAREAIEEAER

SEQ ID NO: 26227 - protein, 56 aa, Artificial Sequence
  Synthetic
SKVEELAERAARSHKELADAIRELAREAAESHKEAAEVVKRLADEAARAAKEVAKA

SEQ ID NO: 26228 - protein, 56 aa, Artificial Sequence
  Synthetic
RKVLEDAKKILEDLRKKAEDALRKHKKILDELEEKAKKAAEKHERILRKLDEDAKR

SEQ ID NO: 26229 - protein, 59 aa, Artificial Sequence
  Synthetic
SEDEEVLKDIKRLLEEVKKTLEEVAKRHEKALREIEERVKEIVKEHEDLLKEVEDKARS

SEQ ID NO: 26230 - protein, 60 aa, Artificial Sequence
  Synthetic
KEDLDRLLKEVLDISRKVLEEVLKIIKRVLEISKRVLEEILRRIEKVLRDIDRVLKKLRE

SEQ ID NO: 26231 - protein, 57 aa, Artificial Sequence
  Synthetic
SREEDLARKIAEAVKELLDADRRLLREIEKLAEELLRINEELLRRLEELARELLEAV

SEQ ID NO: 26232 - protein, 56 aa, Artificial Sequence
  Synthetic
ERLLRKLEEILRRLKDESRKVLKKVKEILDRLKRETEEILDKVRKILERLEEEVRR

SEQ ID NO: 26233 - protein, 59 aa, Artificial Sequence
  Synthetic
SAEEAAEEALRRAAEAAKESIKAAREALEEVRKAAEKSIRAAEKALRDVKKAAEEAKSA

SEQ ID NO: 26234 - protein, 57 aa, Artificial Sequence
  Synthetic
IEEAAKKAIDLARDHARLVKKIAKDLIDLAKEHADLVREIAKRIIEAAKRIAEIVRK

SEQ ID NO: 26235 - protein, 60 aa, Artificial Sequence
  Synthetic
SDEELLEEIKKILDEVLKKNADAVRSLEKVLDKVLEDNARAVEELKTVLDKVLRDLERRG

SEQ ID NO: 26236 - protein, 55 aa, Artificial Sequence
  Synthetic
KDVEEVVKEVRDVLRESVDKVRRVIEEVKRVLDRSSEEVERAVEEVKRVLDKVRK

SEQ ID NO: 26237 - protein, 61 aa, Artificial Sequence
  Synthetic
SDEELLERVERLLRELLDTNRRMLEEVEKELRRLLETNKKTLDDVRRLLKELLDVLETRGV

SEQ ID NO: 26238 - protein, 55 aa, Artificial Sequence
  Synthetic
DDLRELKKRIEDLLKEDKERLEKIARDIERDLERYARDLKRLEDELREDIERARR

SEQ ID NO: 26239 - protein, 61 aa, Artificial Sequence; identical to SEQ ID NO: 26237
  Synthetic

SEQ ID NO: 26240 - protein, 55 aa, Artificial Sequence; identical to SEQ ID NO: 26238
  Synthetic

SEQ ID NO: 26241 - protein, 56 aa, Artificial Sequence
  Synthetic
EEDERLTKRVEEIKRENRELLRRLEEEVKELERKSEKIVRDLKEKVDRAKEKLDSG

SEQ ID NO: 26242 - protein, 57 aa, Artificial Sequence; identical to SEQ ID NO: 25298
  Synthetic

SEQ ID NO: 26243 - protein, 56 aa, Artificial Sequence; identical to SEQ ID NO: 26241
  Synthetic

SEQ ID NO: 26244 - protein, 57 aa, Artificial Sequence; identical to SEQ ID NO: 25298
  Synthetic

SEQ ID NO: 26245 - protein, 58 aa, Artificial Sequence
  Synthetic
TEEEVLRKVEKLIKDLLDVLRDLLRASEEVVREALRVLEELIEENKRVIEELSRALSG

SEQ ID NO: 26246 - protein, 60 aa, Artificial Sequence
  Synthetic
EEKLRRDLTETKKELEKRHEDLRRELEKLLRDYKRELEEIERALEEIEKTLKRRADETRR

SEQ ID NO: 26247 - protein, 58 aa, Artificial Sequence; identical to SEQ ID NO: 26245
  Synthetic

SEQ ID NO: 26248 - protein, 60 aa, Artificial Sequence; identical to SEQ ID NO: 26246
  Synthetic

SEQ ID NO: 26249 - protein, 60 aa, Artificial Sequence
  Synthetic
SAKETIRKLIEENKDIIRKLAEKLKRLLEESERIAEEALRLIKELLERIERALRRVGSGI

SEQ ID NO: 26250 - protein, 55 aa, Artificial Sequence
  Synthetic
KELEKLLEDLEREIRRLAKRLKELSDRLEEKIRKIKRELDDLSARLREKIERTRK

SEQ ID NO: 26251 - protein, 60 aa, Artificial Sequence; identical to SEQ ID NO: 26249
  Synthetic

SEQ ID NO: 26252 - protein, 55 aa, Artificial Sequence; identical to SEQ ID NO: 26250
  Synthetic

SEQ ID NO: 26253 - protein, 59 aa, Artificial Sequence; identical to SEQ ID NO: 25341
  Synthetic

SEQ ID NO: 26254 - protein, 56 aa, Artificial Sequence; identical to SEQ ID NO: 25342
  Synthetic

SEQ ID NO: 26255 - protein, 59 aa, Artificial Sequence; identical to SEQ ID NO: 25341
  Synthetic

SEQ ID NO: 26256 - protein, 56 aa, Artificial Sequence; identical to SEQ ID NO: 25342
  Synthetic

SEQ ID NO: 26257 - protein, 60 aa, Artificial Sequence; identical to SEQ ID NO: 25343
  Synthetic

SEQ ID NO: 26258 - protein, 58 aa, Artificial Sequence
  Synthetic
EEIKRLKEELERRHRRLEEEVERVARELEKAHRDLERDIRRVAEELKKLLKKLRDDRR

SEQ ID NO: 26259 - protein, 60 aa, Artificial Sequence; identical to SEQ ID NO: 25343
  Synthetic

SEQ ID NO: 26260 - protein, 58 aa, Artificial Sequence; identical to SEQ ID NO: 26258
  Synthetic

SEQ ID NO: 26261 - protein, 60 aa, Artificial Sequence
  Synthetic
SAEETVERLLEEARKRHEEIIKKAKELLDRAREEHERIIREAEKLLEEIKKRVDELVRDG

SEQ ID NO: 26262 - protein, 56 aa, Artificial Sequence; identical to SEQ ID NO: 25348
  Synthetic

SEQ ID NO: 26263 - protein, 60 aa, Artificial Sequence; identical to SEQ ID NO: 26261
  Synthetic

SEQ ID NO: 26264 - protein, 56 aa, Artificial Sequence; identical to SEQ ID NO: 25348
  Synthetic

SEQ ID NO: 26265 - protein, 56 aa, Artificial Sequence
  Synthetic
SEKEELKRLLDKLLKELKRLSDELKATIDKILKILKEVSEEVKRTADELLDAIRRG

SEQ ID NO: 26266 - protein, 59 aa, Artificial Sequence
  Synthetic
EDELRKVEEDLKRLEDKLKKLLEDYEKKVRELEETLDDLLRKYEETLRRLEKELEEAER

SEQ ID NO: 26267 - protein, 56 aa, Artificial Sequence; identical to SEQ ID NO: 26265
  Synthetic

SEQ ID NO: 26268 - protein, 59 aa, Artificial Sequence; identical to SEQ ID NO: 26266
  Synthetic

SEQ ID NO: 26269 - protein, 60 aa, Artificial Sequence
  Synthetic
SDAERLVKKIADSLRAYEDLLRKLVERIRDLLRAYEEELRKLLTEIEKTLEDVRDVLRRG

SEQ ID NO: 26270 - protein, 58 aa, Artificial Sequence
  Synthetic
DLLEALRRLVERLKRLIERVLKLNRELVKKLLELLEEALRANRRLVEDILKIADEARK

SEQ ID NO: 26271 - protein, 60 aa, Artificial Sequence; identical to SEQ ID NO: 26269
  Synthetic

SEQ ID NO: 26272 - protein, 58 aa, Artificial Sequence; identical to SEQ ID NO: 26270
  Synthetic

SEQ ID NO: 26273 - protein, 59 aa, Artificial Sequence
  Synthetic
SATERVLDLARDLIRILLEIHKRALKLIAELVSKLLKIHEDVLKLSEELVEELLEIVKR

SEQ ID NO: 26274 - protein, 60 aa, Artificial Sequence
  Synthetic
EDTLRRVLERIREEVERVKEKHRRLLEELKKLLEELRARSADLLEDIKRKVRELEEKTRR

SEQ ID NO: 26275 - protein, 59 aa, Artificial Sequence; identical to SEQ ID NO: 26273
  Synthetic

SEQ ID NO: 26276 - protein, 60 aa, Artificial Sequence; identical to SEQ ID NO: 26274
  Synthetic

SEQ ID NO: 26277 - protein, 56 aa, Artificial Sequence; identical to SEQ ID NO: 25371
  Synthetic

SEQ ID NO: 26278 - protein, 60 aa, Artificial Sequence
  Synthetic
RERLARLLKALADKLIRVLEEILKINEELNRKIIKFARENLERNRRVNKKVIEVLREAAR

SEQ ID NO: 26279 - protein, 56 aa, Artificial Sequence; identical to SEQ ID NO: 25371
  Synthetic

SEQ ID NO: 26280 - protein, 60 aa, Artificial Sequence; identical to SEQ ID NO: 26278
  Synthetic

SEQ ID NO: 26281 - protein, 61 aa, Artificial Sequence
  Synthetic
STEEILKRVKEILDELAKELRDIIRESLRTIEELLDELRRILEESERTLEELVKTIKDGVK

SEQ ID NO: 26282 - protein, 59 aa, Artificial Sequence; identical to SEQ ID NO: 25380
  Synthetic

SEQ ID NO: 26283 - protein, 61 aa, Artificial Sequence; identical to SEQ ID NO: 26281
  Synthetic

SEQ ID NO: 26284 - protein, 59 aa, Artificial Sequence; identical to SEQ ID NO: 25380
  Synthetic

SEQ ID NO: 26285 - protein, 60 aa, Artificial Sequence
  Synthetic
SEKEELLKLIKRVIELLKRVLEEHLRLVEDVIRRLKELLDSNEKIVREVIEDLKRLLDEV

SEQ ID NO: 26286 - protein, 59 aa, Artificial Sequence
  Synthetic
EDLLRKAKKVITEVREKLKRNLEDVRRVIEDVKRKSARILEEARRLIEEVERELEKIRK

SEQ ID NO: 26287 - protein, 60 aa, Artificial Sequence; identical to SEQ ID NO: 26285
  Synthetic

SEQ ID NO: 26288 - protein, 59 aa, Artificial Sequence; identical to SEQ ID NO: 26286
  Synthetic

SEQ ID NO: 26289 - protein, 57 aa, Artificial Sequence
  Synthetic
SRAERIKRALEEHIRKLKEITDEVRKTNEELLELTRRILEEAKKANEELVKKIREAG

SEQ ID NO: 26290 - protein, 56 aa, Artificial Sequence; identical to SEQ ID NO: 25390
  Synthetic

SEQ ID NO: 26291 - protein, 57 aa, Artificial Sequence; identical to SEQ ID NO: 26289
  Synthetic

SEQ ID NO: 26292 - protein, 56 aa, Artificial Sequence; identical to SEQ ID NO: 25390
  Synthetic

SEQ ID NO: 26293 - protein, 57 aa, Artificial Sequence
  Synthetic
SEAEKIREALETNLRLLEELIKRLKEILDTHNELLRRVIETLERLLKELLELLEEGG

SEQ ID NO: 26294 - protein, 56 aa, Artificial Sequence
  Synthetic
KEDLERLRRKVEELEDRLRRLLEKLARDSAELMRELERILDRYARESEELDRRLAE

SEQ ID NO: 26295 - protein, 57 aa, Artificial Sequence; identical to SEQ ID NO: 26293
  Synthetic

SEQ ID NO: 26296 - protein, 56 aa, Artificial Sequence; identical to SEQ ID NO: 26294
  Synthetic

SEQ ID NO: 26297 - protein, 62 aa, Artificial Sequence
  Synthetic
SAEEELEKLVRKVEEDLKRLEEESERIKKEIKDTLRAIRKRSEDLKRKVKELLRRLEEEGRR

SEQ ID NO: 26298 - protein, 60 aa, Artificial Sequence
  Synthetic
ADEALEMLKRLLDKALKVHEDVLRKLVELVDEVLKVHEESLRKLLTLAAKVLEVLRKITK

SEQ ID NO: 26299 - protein, 62 aa, Artificial Sequence; identical to SEQ ID NO: 26297
  Synthetic

SEQ ID NO: 26300 - protein, 60 aa, Artificial Sequence; identical to SEQ ID NO: 26298
  Synthetic

SEQ ID NO: 26301 - protein, 60 aa, Artificial Sequence
  Synthetic
DDERRKLEDLERMVEELKRKSDKLLKEIREEVERLERETRKLLEELKAKVDELREDLRRN

SEQ ID NO: 26302 - protein, 55 aa, Artificial Sequence
  Synthetic
EDLEKAERLVKDILRLNEEHTAELEDVVRDLLRALEKHTRDLEKLVKDALDKVKT

SEQ ID NO: 26303 - protein, 60 aa, Artificial Sequence; identical to SEQ ID NO: 26301
  Synthetic

SEQ ID NO: 26304 - protein, 55 aa, Artificial Sequence; identical to SEQ ID NO: 26302
  Synthetic

SEQ ID NO: 26305 - protein, 62 aa, Artificial Sequence
  Synthetic
SKIDEALKKLAKILEDAIKLNKELNDTTAEILKEIIKLNAEVLEKIRRILKELVDLILKGLK

SEQ ID NO: 26306 - protein, 55 aa, Artificial Sequence; identical to SEQ ID NO: 25416
  Synthetic

SEQ ID NO: 26307 - protein, 62 aa, Artificial Sequence; identical to SEQ ID NO: 26305
  Synthetic

SEQ ID NO: 26308 - protein, 55 aa, Artificial Sequence; identical to SEQ ID NO: 25416
  Synthetic

SEQ ID NO: 26309 - protein, 59 aa, Artificial Sequence; identical to SEQ ID NO: 25421
  Synthetic

SEQ ID NO: 26310 - protein, 60 aa, Artificial Sequence
  Synthetic
KETLARDLKEALKTLIKLIREILEDNLRVLRRIIELIETLLEDNRRVLEEIIKLIEEATT

SEQ ID NO: 26311 - protein, 60 aa, Artificial Sequence
  Synthetic
DEEEKIREDLERTLREYERELRRAKEELKETLKRYEEELREVKEDLDRTLEEVDDLLRRG

SEQ ID NO: 26312 - protein, 60 aa, Artificial Sequence; identical to SEQ ID NO: 26310
  Synthetic

SEQ ID NO: 26313 - protein, 58 aa, Artificial Sequence
  Synthetic
DELEKVERLLEEIEKIIEDLIRRVEELVRRILEFNKTTLKRNEELVRELEKLVKETTG

SEQ ID NO: 26314 - protein, 59 aa, Artificial Sequence; identical to SEQ ID NO: 25426
  Synthetic

SEQ ID NO: 26315 - protein, 58 aa, Artificial Sequence; identical to SEQ ID NO: 26313
  Synthetic

SEQ ID NO: 26316 - protein, 59 aa, Artificial Sequence; identical to SEQ ID NO: 25426
  Synthetic

SEQ ID NO: 26317 - protein, 56 aa, Artificial Sequence
  Synthetic
SEKERLMRLLDKLKDLNRRLVERIKELLDKALELHKKLVKELRELLERLKELVERG

SEQ ID NO: 26318 - protein, 59 aa, Artificial Sequence
  Synthetic
EETVRRLREALKKLEDDLRKIERDAEREYKKLKDELEELTERYRREIRKLKEELKADRK

SEQ ID NO: 26319 - protein, 56 aa, Artificial Sequence; identical to SEQ ID NO: 26317
  Synthetic

SEQ ID NO: 26320 - protein, 59 aa, Artificial Sequence; identical to SEQ ID NO: 26318
  Synthetic

SEQ ID NO: 26321 - protein, 56 aa, Artificial Sequence
  Synthetic
SEAEDLEELIKELAELLKDVIRKLEKINRRLVKILEDIIRRLKEISKEAEEELRKG

SEQ ID NO: 26322 - protein, 59 aa, Artificial Sequence; identical to SEQ ID NO: 25434
  Synthetic

SEQ ID NO: 26323 - protein, 56 aa, Artificial Sequence; identical to SEQ ID NO: 26321
  Synthetic

SEQ ID NO: 26324 - protein, 59 aa, Artificial Sequence; identical to SEQ ID NO: 25434
  Synthetic

SEQ ID NO: 26325 - protein, 60 aa, Artificial Sequence; identical to SEQ ID NO: 25439
  Synthetic

SEQ ID NO: 26326 - protein, 60 aa, Artificial Sequence; identical to SEQ ID NO: 25440
  Synthetic

SEQ ID NO: 26327 - protein, 60 aa, Artificial Sequence; identical to SEQ ID NO: 25439
  Synthetic

SEQ ID NO: 26328 - protein, 60 aa, Artificial Sequence; identical to SEQ ID NO: 25440
  Synthetic

SEQ ID NO: 26329 - protein, 60 aa, Artificial Sequence; identical to SEQ ID NO: 25441
  Synthetic

SEQ ID NO: 26330 - protein, 59 aa, Artificial Sequence; identical to SEQ ID NO: 25442
  Synthetic

SEQ ID NO: 26331 - protein, 60 aa, Artificial Sequence; identical to SEQ ID NO: 25441
  Synthetic

SEQ ID NO: 26332 - protein, 59 aa, Artificial Sequence; identical to SEQ ID NO: 25442
  Synthetic

SEQ ID NO: 26333 - protein, 60 aa, Artificial Sequence
  Synthetic
DEDRIIEEIARLLEELLRELLELIKKLIETNRRLNEEHERAVRELARLLEELLDRLVKKG

SEQ ID NO: 26334 - protein, 59 aa, Artificial Sequence
  Synthetic
EKIAEEIERELEELRRMIKRLHEDLERKLKESEDELREIEARLEEKIRRLEEKLERKRR

SEQ ID NO: 26335 - protein, 60 aa, Artificial Sequence; identical to SEQ ID NO: 26333
  Synthetic

SEQ ID NO: 26336 - protein, 59 aa, Artificial Sequence; identical to SEQ ID NO: 26334
  Synthetic

SEQ ID NO: 26337 - protein, 59 aa, Artificial Sequence
  Synthetic
DEEEKIRTTLDLLRKLLKVLREILEELIRSNKELNERLLRLVEDSDRLLEELLKKLADD

SEQ ID NO: 26338 - protein, 59 aa, Artificial Sequence
  Synthetic
EEKVRDTEKKLRDLREKHAEIAKELERLLRENRRRLEELAREAKKVLDELRKRLEDERR

SEQ ID NO: 26339 - protein, 59 aa, Artificial Sequence; identical to SEQ ID NO: 26337
  Synthetic

SEQ ID NO: 26340 - protein, 59 aa, Artificial Sequence; identical to SEQ ID NO: 26338
  Synthetic

SEQ ID NO: 26341 - protein, 59 aa, Artificial Sequence
  Synthetic
SEKEKLLKESEEEVRRLRRTLEELLRKYREVLERLRKELREIEERVRDVVRRLKEVLDR

SEQ ID NO: 26342 - protein, 56 aa, Artificial Sequence
  Synthetic
ERLVKTLIEDVEAVIKRILELITRVAEDNERVLERIIRELTDNLERHLKIVREIVK

SEQ ID NO: 26343 - protein, 59 aa, Artificial Sequence; identical to SEQ ID NO: 26341
  Synthetic

SEQ ID NO: 26344 - protein, 56 aa, Artificial Sequence; identical to SEQ ID NO: 26342
  Synthetic

SEQ ID NO: 26345 - protein, 60 aa, Artificial Sequence
  Synthetic
SELERAEELIKKLLKLHEDVLRRLTEVDDELLEIHDRVLKRLKEVDDELLKLIRDMLRRG

SEQ ID NO: 26346 - protein, 58 aa, Artificial Sequence; identical to SEQ ID NO: 25488
  Synthetic

SEQ ID NO: 26347 - protein, 60 aa, Artificial Sequence; identical to SEQ ID NO: 26345
  Synthetic

SEQ ID NO: 26348 - protein, 58 aa, Artificial Sequence; identical to SEQ ID NO: 25488
  Synthetic

SEQ ID NO: 26349 - protein, 59 aa, Artificial Sequence; identical to SEQ ID NO: 25495
  Synthetic

SEQ ID NO: 26350 - protein, 55 aa, Artificial Sequence
  Synthetic
REIEKEIRRILEELKAKHDEIEKKIRELEREIKRAHEELEDRIRKIERDLDRRTK

SEQ ID NO: 26351 - protein, 59 aa, Artificial Sequence; identical to SEQ ID NO: 25495
  Synthetic

SEQ ID NO: 26352 - protein, 55 aa, Artificial Sequence; identical to SEQ ID NO: 26350
  Synthetic

SEQ ID NO: 26353 - protein, 60 aa, Artificial Sequence
  Synthetic
SSEELLKRIVDEDERVLEEWARVLEEIKDLSKAVVDLLDKVLKEIEAIVDEVTRRLERDG

SEQ ID NO: 26354 - protein, 55 aa, Artificial Sequence
  Synthetic
KDLLETIKKRVEEIRRTLEKIKRDYDKAIEEIRAKLERKLEEYKEVIDDLRRKTK

SEQ ID NO: 26355 - protein, 60 aa, Artificial Sequence; identical to SEQ ID NO: 26353
  Synthetic

SEQ ID NO: 26356 - protein, 55 aa, Artificial Sequence; identical to SEQ ID NO: 26354
  Synthetic

SEQ ID NO: 26357 - protein, 59 aa, Artificial Sequence; identical to SEQ ID NO: 25517
  Synthetic

SEQ ID NO: 26358 - protein, 56 aa, Artificial Sequence; identical to SEQ ID NO: 25518
  Synthetic

SEQ ID NO: 26359 - protein, 59 aa, Artificial Sequence; identical to SEQ ID NO: 25517
  Synthetic

SEQ ID NO: 26360 - protein, 56 aa, Artificial Sequence; identical to SEQ ID NO: 25518
  Synthetic

SEQ ID NO: 26361 - protein, 56 aa, Artificial Sequence
  Synthetic
DKAEVLREALKLLKDLLEELIKIHEESLKRILDLIDTLVKVHEDALRALKELLERS

SEQ ID NO: 26362 - protein, 55 aa, Artificial Sequence; identical to SEQ ID NO: 25524
  Synthetic

SEQ ID NO: 26363 - protein, 56 aa, Artificial Sequence; identical to SEQ ID NO: 26361
  Synthetic

SEQ ID NO: 26364 - protein, 55 aa, Artificial Sequence; identical to SEQ ID NO: 25524
  Synthetic

SEQ ID NO: 26365 - protein, 56 aa, Artificial Sequence
  Synthetic
STREKAKKVLDTLRADNEDMKRVVEKILRALKRTNERAEKLAREITEEIKRILKEV

SEQ ID NO: 26366 - protein, 56 aa, Artificial Sequence; identical to SEQ ID NO: 25528
  Synthetic

SEQ ID NO: 26367 - protein, 56 aa, Artificial Sequence; identical to SEQ ID NO: 26365
  Synthetic

SEQ ID NO: 26368 - protein, 56 aa, Artificial Sequence; identical to SEQ ID NO: 25528
  Synthetic

SEQ ID NO: 26369 - protein, 56 aa, Artificial Sequence
  Synthetic
SKAEKLLKDLREALEKVKRRYEELERRLDEVLKEHEEIVKRLLEELEKVLKRIEEG

SEQ ID NO: 26370 - protein, 59 aa, Artificial Sequence; identical to SEQ ID NO: 25542
  Synthetic

SEQ ID NO: 26371 - protein, 56 aa, Artificial Sequence; identical to SEQ ID NO: 26369
  Synthetic

SEQ ID NO: 26372 - protein, 59 aa, Artificial Sequence; identical to SEQ ID NO: 25542
  Synthetic

SEQ ID NO: 26373 - protein, 57 aa, Artificial Sequence; identical to SEQ ID NO: 25543
  Synthetic

SEQ ID NO: 26374 - protein, 59 aa, Artificial Sequence
  Synthetic
EDLLTELEKKLRKLKRDSEKVVDDLKKELERIKREVKRLIEENARTLADIKRAVDEARK

SEQ ID NO: 26375 - protein, 57 aa, Artificial Sequence; identical to SEQ ID NO: 25543
  Synthetic

SEQ ID NO: 26376 - protein, 59 aa, Artificial Sequence; identical to SEQ ID NO: 26374
  Synthetic

SEQ ID NO: 26377 - protein, 56 aa, Artificial Sequence; identical to SEQ ID NO: 25551
  Synthetic

SEQ ID NO: 26378 - protein, 59 aa, Artificial Sequence
  Synthetic
DDERRTLTELLKRMEDILEKVERTLKKLLDDSARMAEEVKKTLKELLERSEKVAEDVRK

SEQ ID NO: 26379 - protein, 56 aa, Artificial Sequence; identical to SEQ ID NO: 25551
  Synthetic

SEQ ID NO: 26380 - protein, 59 aa, Artificial Sequence; identical to SEQ ID NO: 26378
  Synthetic

SEQ ID NO: 26381 - protein, 56 aa, Artificial Sequence; identical to SEQ ID NO: 25555
  Synthetic

SEQ ID NO: 26382 - protein, 59 aa, Artificial Sequence; identical to SEQ ID NO: 25556
  Synthetic

SEQ ID NO: 26383 - protein, 56 aa, Artificial Sequence; identical to SEQ ID NO: 25555
  Synthetic

SEQ ID NO: 26384 - protein, 59 aa, Artificial Sequence; identical to SEQ ID NO: 25556
  Synthetic

SEQ ID NO: 26385 - protein, 60 aa, Artificial Sequence
  Synthetic
SKKELLEEVVRRAIELLKRHLEKLKRILEEIVRLLEEHLEKVERVLEAILSLLDDLLRRG

SEQ ID NO: 26386 - protein, 56 aa, Artificial Sequence
  Synthetic
EDKLKEIEDELRRLLEELRRLDKAIKDRLRELKKDLDEANRRIKETLKKLLREVEK

SEQ ID NO: 26387 - protein, 60 aa, Artificial Sequence; identical to SEQ ID NO: 26385
  Synthetic

SEQ ID NO: 26388 - protein, 56 aa, Artificial Sequence; identical to SEQ ID NO: 26386
  Synthetic

SEQ ID NO: 26389 - protein, 56 aa, Artificial Sequence
  Synthetic
SDLEELEALIRRLLKINEDLIRIIEDLIRKSLTLLKRIVDLIRELIREIEEIIRRT

SEQ ID NO: 26390 - protein, 55 aa, Artificial Sequence; identical to SEQ ID NO: 25580
  Synthetic

SEQ ID NO: 26391 - protein, 56 aa, Artificial Sequence; identical to SEQ ID NO: 26389
  Synthetic

SEQ ID NO: 26392 - protein, 55 aa, Artificial Sequence; identical to SEQ ID NO: 25580
  Synthetic

SEQ ID NO: 26393 - protein, 60 aa, Artificial Sequence
  Synthetic
SERDVLRELLERIKKLLETLIRIVEELVRRSEETIKRLAELNRRLIEEIRRIVEEVKKGV

SEQ ID NO: 26394 - protein, 55 aa, Artificial Sequence; identical to SEQ ID NO: 25606
  Synthetic

SEQ ID NO: 26395 - protein, 60 aa, Artificial Sequence; identical to SEQ ID NO: 26393
  Synthetic

SEQ ID NO: 26396 - protein, 55 aa, Artificial Sequence; identical to SEQ ID NO: 25606
  Synthetic

SEQ ID NO: 26397 - protein, 58 aa, Artificial Sequence
  Synthetic
SKEELVKEIDELNKRVNDLLEELLRKSEKLHKEILELLERLLREIISLLRRILEIVER

SEQ ID NO: 26398 - protein, 56 aa, Artificial Sequence
  Synthetic
EDELRRLLEDIERKIEALLRELKKESEEIRKRIRELLEDNRDKSRKIKKAIEELKK

SEQ ID NO: 26399 - protein, 58 aa, Artificial Sequence; identical to SEQ ID NO: 26397
  Synthetic

SEQ ID NO: 26400 - protein, 56 aa, Artificial Sequence; identical to SEQ ID NO: 26398
  Synthetic

SEQ ID NO: 26401 - protein, 60 aa, Artificial Sequence
  Synthetic
KEIEETLKELEDLNREMVETNRRVLEETRRLNKETVDRVKATLDELAKMLKKLVDDVRKG

SEQ ID NO: 26402 - protein, 55 aa, Artificial Sequence
  Synthetic
KAVEELEKALEEIKRRLKEVIDRYEDELRKLRKEYKEKIDKYERKLEEIERRERT

SEQ ID NO: 26403 - protein, 60 aa, Artificial Sequence; identical to SEQ ID NO: 26401
  Synthetic

SEQ ID NO: 26404 - protein, 55 aa, Artificial Sequence; identical to SEQ ID NO: 26402
  Synthetic

SEQ ID NO: 26405 - protein, 56 aa, Artificial Sequence; identical to SEQ ID NO: 25691
  Synthetic

SEQ ID NO: 26406 - protein, 56 aa, Artificial Sequence
  Synthetic
EDVVRALIEVIERLLRVAEEVIRRILKVNTELMRVDERSIRESLKAISEVLKVLDT

SEQ ID NO: 26407 - protein, 56 aa, Artificial Sequence; identical to SEQ ID NO: 25691
  Synthetic

SEQ ID NO: 26408 - protein, 56 aa, Artificial Sequence; identical to SEQ ID NO: 26406
  Synthetic

SEQ ID NO: 26409 - protein, 60 aa, Artificial Sequence
  Synthetic
DEDELIRKLLEDLKDIVRKILELIERDLRDIERVVRRIVKVIRDDLKKIKEVVDDIARGV

SEQ ID NO: 26410 - protein, 59 aa, Artificial Sequence
  Synthetic
SELADRIRKLIEDLERHTAKVLEDVKRAITELRKNSKDILEEVRKLIDELRKRIKEVED

SEQ ID NO: 26411 - protein, 60 aa, Artificial Sequence; identical to SEQ ID NO: 26409
  Synthetic

SEQ ID NO: 26412 - protein, 59 aa, Artificial Sequence; identical to SEQ ID NO: 26410
  Synthetic

SEQ ID NO: 26413 - protein, 59 aa, Artificial Sequence
  Synthetic
RDRDVLRKVKAEIEELVARIEKVSRDALSEVKRLLDENRKIAEDVLRLIESLLRKIRDT

SEQ ID NO: 26414 - protein, 59 aa, Artificial Sequence
  Synthetic
EEVVEELLRMLKRVAEEMKRVHDDLSRAVEKVVRDVVRVDKELLDELARILRRLEEVIT

SEQ ID NO: 26415 - protein, 59 aa, Artificial Sequence; identical to SEQ ID NO: 26413
  Synthetic

SEQ ID NO: 26416 - protein, 59 aa, Artificial Sequence; identical to SEQ ID NO: 26414
  Synthetic

SEQ ID NO: 26417 - protein, 56 aa, Artificial Sequence
  Synthetic
SKDEELARLLEELVERWRKIVEDLERDHRRLVKEIRELVERIRKKLEELVDRIRKN

SEQ ID NO: 26418 - protein, 58 aa, Artificial Sequence
  Synthetic
EEIRRILEELKRIVDDVLRIIARILKLLRDLTRRLAEVAKAVHKLLEELLRKLKEDTR

SEQ ID NO: 26419 - protein, 56 aa, Artificial Sequence; identical to SEQ ID NO: 26417
  Synthetic

SEQ ID NO: 26420 - protein, 58 aa, Artificial Sequence; identical to SEQ ID NO: 26418
  Synthetic

SEQ ID NO: 26421 - protein, 56 aa, Artificial Sequence
  Synthetic
SAAETVKRLAEESSERIRKIVEDDKRVADDSSRKIKELIEEIKRRVKELLDRIKGL

SEQ ID NO: 26422 - protein, 56 aa, Artificial Sequence
  Synthetic
KEAVIRLIEELVKLLEDVLRRLLEVNETLVELNKRVWDRLVRINEELAEVALRVAT

SEQ ID NO: 26423 - protein, 56 aa, Artificial Sequence; identical to SEQ ID NO: 26421
  Synthetic

SEQ ID NO: 26424 - protein, 56 aa, Artificial Sequence; identical to SEQ ID NO: 26422
  Synthetic

SEQ ID NO: 26425 - protein, 56 aa, Artificial Sequence
  Synthetic
SALETVKKLLEDSSEKIERIVEEDERVAKESSDRIRRLVEEDKRVADEILDLIEKI

SEQ ID NO: 26426 - protein, 56 aa, Artificial Sequence
  Synthetic
AEAVIKVIEKLIRANKRVWDALLKINEDLVRVNKTVWKELLRVNEKLARDLERVVK

SEQ ID NO: 26427 - protein, 56 aa, Artificial Sequence; identical to SEQ ID NO: 26425
  Synthetic

SEQ ID NO: 26428 - protein, 56 aa, Artificial Sequence; identical to SEQ ID NO: 26426
  Synthetic

SEQ ID NO: 26429 - protein, 60 aa, Artificial Sequence
  Synthetic
DEIETVLKRLAELIKESLDLLRETLDELRKIIEESKKSLEDVLRRLKELIDRLRRLAKEG

SEQ ID NO: 26430 - protein, 60 aa, Artificial Sequence
  Synthetic
ADELLRRVEEILKRLLELIRRIIEEHRKILERLLETHEDLIRKHEEILRRLLKAADEERQ

SEQ ID NO: 26431 - protein, 60 aa, Artificial Sequence; identical to SEQ ID NO: 26429
  Synthetic

SEQ ID NO: 26432 - protein, 60 aa, Artificial Sequence; identical to SEQ ID NO: 26430
  Synthetic

SEQ ID NO: 26433 - protein, 57 aa, Artificial Sequence
  Synthetic
SKEEKLKDDVRAVLEDLDRVLKELEKLSEDNLRELKRVLDRITDLHRRILDELRKGI

SEQ ID NO: 26434 - protein, 59 aa, Artificial Sequence
  Synthetic
SKAAEDILRVLEKLVKVSREAIKLILELSEHHVRVSTRIARLLLDVARKLAEVIKEAER

SEQ ID NO: 26435 - protein, 57 aa, Artificial Sequence; identical to SEQ ID NO: 26433
  Synthetic

SEQ ID NO: 26436 - protein, 59 aa, Artificial Sequence; identical to SEQ ID NO: 26434
  Synthetic

SEQ ID NO: 26437 - protein, 61 aa, Artificial Sequence
  Synthetic
SEIEDVIRRLRKILEDLERVSEKLLREIKKILDEARRLNEEVIKEIKRVLEDAVRVFRDGS

SEQ ID NO: 26438 - protein, 56 aa, Artificial Sequence; identical to SEQ ID NO: 25780
  Synthetic

SEQ ID NO: 26439 - protein, 60 aa, Artificial Sequence
  Synthetic
SEIEDVIRRLRKILEDLERVSEKLLREIKKILDEARRLNEEVIKEIKRVLEDAVRVFRDG

SEQ ID NO: 26440 - protein, 56 aa, Artificial Sequence; identical to SEQ ID NO: 25780
  Synthetic

SEQ ID NO: 26441 - protein, 60 aa, Artificial Sequence
  Synthetic
SREEIVATLEDLARKILEVVKKLAKEIEDAWREIERAVREILKRLEELWREIEDVVRKKV

SEQ ID NO: 26442 - protein, 59 aa, Artificial Sequence
  Synthetic
EEAVKELVELLEEILERNTRVIKEIIDLLRTVIRIHEKIVEDLIKLLEELLRRLEEATR

SEQ ID NO: 26443 - protein, 60 aa, Artificial Sequence; identical to SEQ ID NO: 26441
  Synthetic

SEQ ID NO: 26444 - protein, 59 aa, Artificial Sequence; identical to SEQ ID NO: 26442
  Synthetic

SEQ ID NO: 26445 - protein, 58 aa, Artificial Sequence; identical to SEQ ID NO: 25783
  Synthetic

SEQ ID NO: 26446 - protein, 59 aa, Artificial Sequence; identical to SEQ ID NO: 25784
  Synthetic

SEQ ID NO: 26447 - protein, 58 aa, Artificial Sequence; identical to SEQ ID NO: 25783
  Synthetic

SEQ ID NO: 26448 - protein, 59 aa, Artificial Sequence; identical to SEQ ID NO: 25784
  Synthetic

SEQ ID NO: 26449 - protein, 55 aa, Artificial Sequence
  Synthetic
SKEERLREVAEKHKKDLEDIVKRVDEAAKETARRLEEILKRLEEVLKKILDDLEK

SEQ ID NO: 26450 - protein, 55 aa, Artificial Sequence; identical to SEQ ID NO: 25794
  Synthetic

SEQ ID NO: 26451 - protein, 55 aa, Artificial Sequence; identical to SEQ ID NO: 26449
  Synthetic

SEQ ID NO: 26452 - protein, 55 aa, Artificial Sequence; identical to SEQ ID NO: 25794
  Synthetic

SEQ ID NO: 26453 - protein, 56 aa, Artificial Sequence; identical to SEQ ID NO: 25819
  Synthetic

SEQ ID NO: 26454 - protein, 62 aa, Artificial Sequence
  Synthetic
EDAVRKIAKIIEELKRLLEDLARDTRRVIEEAKRLLKEWRDRNKEVADTLKKLLEDLIRKIR

SEQ ID NO: 26455 - protein, 56 aa, Artificial Sequence; identical to SEQ ID NO: 25819
  Synthetic

SEQ ID NO: 26456 - protein, 62 aa, Artificial Sequence; identical to SEQ ID NO: 26454
  Synthetic

SEQ ID NO: 26457 - protein, 61 aa, Artificial Sequence
  Synthetic
SEDELLEKIVRKLAEAVKRIEEELRKSKREIERLVKEIKEKLEDSLARVKETLDRIRETRK

SEQ ID NO: 26458 - protein, 56 aa, Artificial Sequence
  Synthetic
LEELLRLLKEVIERSIESLERLLELILRVLEYSVASLEELLRRLLEVIKRIVDTTK

SEQ ID NO: 26459 - protein, 61 aa, Artificial Sequence; identical to SEQ ID NO: 26457
  Synthetic

SEQ ID NO: 26460 - protein, 56 aa, Artificial Sequence; identical to SEQ ID NO: 26458
  Synthetic

SEQ ID NO: 26461 - protein, 59 aa, Artificial Sequence
  Synthetic
DEDEIAEELKRLLREVEEASKEIVRRMRELAREANKASEDILRTLEKLLEELRRRVEES

SEQ ID NO: 26462 - protein, 56 aa, Artificial Sequence; identical to SEQ ID NO: 25832
  Synthetic

SEQ ID NO: 26463 - protein, 59 aa, Artificial Sequence; identical to SEQ ID NO: 26461
  Synthetic

SEQ ID NO: 26464 - protein, 56 aa, Artificial Sequence; identical to SEQ ID NO: 25832
  Synthetic

SEQ ID NO: 26465 - protein, 60 aa, Artificial Sequence
  Synthetic
DAEEKAKKIEDVARRYAEEVKRVLDDLERLLRESEEEVERIVRKLEKLARDLEERVREGT

SEQ ID NO: 26466 - protein, 59 aa, Artificial Sequence; identical to SEQ ID NO: 25854
  Synthetic

SEQ ID NO: 26467 - protein, 60 aa, Artificial Sequence; identical to SEQ ID NO: 26465
  Synthetic

SEQ ID NO: 26468 - protein, 59 aa, Artificial Sequence; identical to SEQ ID NO: 25854
  Synthetic

SEQ ID NO: 26469 - protein, 59 aa, Artificial Sequence; identical to SEQ ID NO: 25887
  Synthetic

SEQ ID NO: 26470 - protein, 55 aa, Artificial Sequence
  Synthetic
EEALDDLRRLVKELADKLRKLLKDYKDLLKELKDEAKKLLDDYARLIEELEKKAR

SEQ ID NO: 26471 - protein, 59 aa, Artificial Sequence; identical to SEQ ID NO: 25887
  Synthetic

SEQ ID NO: 26472 - protein, 55 aa, Artificial Sequence; identical to SEQ ID NO: 26470
  Synthetic

SEQ ID NO: 26473 - protein, 60 aa, Artificial Sequence
  Synthetic
SREELLDRILEAIAKILEDLKRLIDENLARLEEVVRELERIIDRNLKLIREILDELKKGS

SEQ ID NO: 26474 - protein, 59 aa, Artificial Sequence; identical to SEQ ID NO: 25896
  Synthetic

SEQ ID NO: 26475 - protein, 60 aa, Artificial Sequence; identical to SEQ ID NO: 26473
  Synthetic

SEQ ID NO: 26476 - protein, 59 aa, Artificial Sequence; identical to SEQ ID NO: 25896
  Synthetic

SEQ ID NO: 26477 - protein, 61 aa, Artificial Sequence; identical to SEQ ID NO: 25897
  Synthetic

SEQ ID NO: 26478 - protein, 60 aa, Artificial Sequence; identical to SEQ ID NO: 25898
  Synthetic

SEQ ID NO: 26479 - protein, 61 aa, Artificial Sequence; identical to SEQ ID NO: 25897
  Synthetic

SEQ ID NO: 26480 - protein, 60 aa, Artificial Sequence; identical to SEQ ID NO: 25898
  Synthetic

SEQ ID NO: 26481 - protein, 60 aa, Artificial Sequence
  Synthetic
DREKSVRDIEEDLKRVLDKLRRRVETSKEELKKVLKADKENADELEKTLRDVVRELDRGI

SEQ ID NO: 26482 - protein, 56 aa, Artificial Sequence
  Synthetic
SEVAKELDEVIKRLLDNLKENTDRLKEVIDRNLADLRDLAEELRAVIERLLEDARR

SEQ ID NO: 26483 - protein, 60 aa, Artificial Sequence; identical to SEQ ID NO: 26481
  Synthetic

SEQ ID NO: 26484 - protein, 56 aa, Artificial Sequence; identical to SEQ ID NO: 26482
  Synthetic

SEQ ID NO: 26485 - protein, 59 aa, Artificial Sequence
  Synthetic
SLEEITKRLLELVEENLARHEEILRELLELAKRLAKEDRDILEEVLKLIEELLKLLEDN

SEQ ID NO: 26486 - protein, 60 aa, Artificial Sequence; identical to SEQ ID NO: 25950
  Synthetic

SEQ ID NO: 26487 - protein, 59 aa, Artificial Sequence; identical to SEQ ID NO: 26485
  Synthetic

SEQ ID NO: 26488 - protein, 60 aa, Artificial Sequence; identical to SEQ ID NO: 25950
  Synthetic

SEQ ID NO: 26489 - protein, 60 aa, Artificial Sequence
  Synthetic
SAEEAVEKLVRIARAIVKINEDLSREVVRILREIVRLNEETTRLLVEIAREVVKVVEDGG

SEQ ID NO: 26490 - protein, 59 aa, Artificial Sequence
  Synthetic
EELLRRLEELRKRLEKVLDDSAKELEKLKRELERLLEESRRKLEKLKRDLERVLEETRR

SEQ ID NO: 26491 - protein, 60 aa, Artificial Sequence; identical to SEQ ID NO: 26489
  Synthetic

SEQ ID NO: 26492 - protein, 59 aa, Artificial Sequence; identical to SEQ ID NO: 26490
  Synthetic

SEQ ID NO: 26493 - protein, 60 aa, Artificial Sequence
  Synthetic
REDEVLRDIERLLREIEEKIRRILEESTAELRKVEEEVKRIIERTKRELKAIKEDVERKG

SEQ ID NO: 26494 - protein, 56 aa, Artificial Sequence
  Synthetic
EDLLEKIKRVIREHIKALEKLARDLKEILRRHIEALKELARDLAEVIRKLLEDVKR

SEQ ID NO: 26495 - protein, 60 aa, Artificial Sequence; identical to SEQ ID NO: 26493
  Synthetic

SEQ ID NO: 26496 - protein, 56 aa, Artificial Sequence; identical to SEQ ID NO: 26494
  Synthetic

SEQ ID NO: 26497 - protein, 58 aa, Artificial Sequence
  Synthetic
SREDLLRSLAELIETILRKSSELLDRLLKLVREHSETSERLIRELKKILEDILKLIKG

SEQ ID NO: 26498 - protein, 56 aa, Artificial Sequence
  Synthetic
EKELRRIAEAVERVLRDHKAKNDKILRDVEEVLRRHLEELARILKDVKKVLDEARK

SEQ ID NO: 26499 - protein, 58 aa, Artificial Sequence; identical to SEQ ID NO: 26497
  Synthetic

SEQ ID NO: 26500 - protein, 56 aa, Artificial Sequence; identical to SEQ ID NO: 26498
  Synthetic

SEQ ID NO: 26501 - protein, 60 aa, Artificial Sequence; identical to SEQ ID NO: 25989
  Synthetic

SEQ ID NO: 26502 - protein, 56 aa, Artificial Sequence; identical to SEQ ID NO: 25990
  Synthetic

SEQ ID NO: 26503 - protein, 60 aa, Artificial Sequence; identical to SEQ ID NO: 25989
  Synthetic

SEQ ID NO: 26504 - protein, 56 aa, Artificial Sequence; identical to SEQ ID NO: 25990
  Synthetic

SEQ ID NO: 26505 - protein, 61 aa, Artificial Sequence
  Synthetic
SKEEDVRRLIEELVRELRRILEENRRMLKELVEKLEEVLRRSEEVWRRLAKELDELLKEGN

SEQ ID NO: 26506 - protein, 59 aa, Artificial Sequence; identical to SEQ ID NO: 25992
  Synthetic

SEQ ID NO: 26507 - protein, 61 aa, Artificial Sequence; identical to SEQ ID NO: 26505
  Synthetic

SEQ ID NO: 26508 - protein, 59 aa, Artificial Sequence; identical to SEQ ID NO: 25992
  Synthetic

SEQ ID NO: 26509 - protein, 59 aa, Artificial Sequence
  Synthetic
SEKEAIKEVAELLKALIDDLLRLLKEDVDTARRVLDEIKKLLEENESIAREVLRRLREG

SEQ ID NO: 26510 - protein, 56 aa, Artificial Sequence
  Synthetic
ETDLDRIVKEMEKVLEDSIRELEKLVKRLEDILRESEKALRDLLSELAKVLEEVRT

SEQ ID NO: 26511 - protein, 59 aa, Artificial Sequence; identical to SEQ ID NO: 26509
  Synthetic

SEQ ID NO: 26512 - protein, 56 aa, Artificial Sequence; identical to SEQ ID NO: 26510
  Synthetic

SEQ ID NO: 26513 - protein, 58 aa, Artificial Sequence; identical to SEQ ID NO: 26001
  Synthetic

SEQ ID NO: 26514 - protein, 56 aa, Artificial Sequence
  Synthetic
EDTVRELTELVRRLLKRVEELLKRSLEILRELIKAIADAIKESLDILDRLLREVAR

SEQ ID NO: 26515 - protein, 58 aa, Artificial Sequence; identical to SEQ ID NO: 26001
  Synthetic

SEQ ID NO: 26516 - protein, 56 aa, Artificial Sequence; identical to SEQ ID NO: 26514
  Synthetic

SEQ ID NO: 26517 - protein, 59 aa, Artificial Sequence
  Synthetic
SEAERLADEVRKAVKKSEEDNETLVREVEKAVRELKKNNKTWVDEVRKLMKRLVDLLRD

SEQ ID NO: 26518 - protein, 60 aa, Artificial Sequence; identical to SEQ ID NO: 26024
  Synthetic

SEQ ID NO: 26519 - protein, 59 aa, Artificial Sequence; identical to SEQ ID NO: 26517
  Synthetic

SEQ ID NO: 26520 - protein, 60 aa, Artificial Sequence; identical to SEQ ID NO: 26024
  Synthetic

SEQ ID NO: 26521 - protein, 61 aa, Artificial Sequence
  Synthetic
SEKDEVTRRIRELLKEAEETNREAIERIKRLLDRVREAVEEVAKRSEELLRRLKKVLDRGL

SEQ ID NO: 26522 - protein, 57 aa, Artificial Sequence
  Synthetic
KEDLLREIARILAESLRLIRELLKEIEKIVKEIIELLERLNDELRKIIEAILETTKK

SEQ ID NO: 26523 - protein, 61 aa, Artificial Sequence; identical to SEQ ID NO: 26521
  Synthetic

SEQ ID NO: 26524 - protein, 57 aa, Artificial Sequence; identical to SEQ ID NO: 26522
  Synthetic

SEQ ID NO: 26525 - protein, 59 aa, Artificial Sequence
  Synthetic
SAEDLVRRVKDLVDKLEDKLRKVVRTNERLWEEIRKRLEELVRRNKELWDALVEKLKAG

SEQ ID NO: 26526 - protein, 56 aa, Artificial Sequence
  Synthetic
IRVLVELVRRHNKVLKELVEELEKLVRDHNRVVEEVVRELVELLSRAVEVIKEVVK

SEQ ID NO: 26527 - protein, 59 aa, Artificial Sequence; identical to SEQ ID NO: 26525
  Synthetic

SEQ ID NO: 26528 - protein, 56 aa, Artificial Sequence; identical to SEQ ID NO: 26526
  Synthetic

SEQ ID NO: 26529 - protein, 59 aa, Artificial Sequence
  Synthetic
SEKELVDDIRRILEEILRLLRSLLEEVIRLLEENEKLVRRHLKTVIDILRRVAKLLDEN

SEQ ID NO: 26530 - protein, 56 aa, Artificial Sequence; identical to SEQ ID NO: 26068
  Synthetic

SEQ ID NO: 26531 - protein, 59 aa, Artificial Sequence; identical to SEQ ID NO: 26529
  Synthetic

SEQ ID NO: 26532 - protein, 56 aa, Artificial Sequence; identical to SEQ ID NO: 26068
  Synthetic

SEQ ID NO: 26533 - protein, 62 aa, Artificial Sequence
  Synthetic
DEERLAEELERVLDRNRKLLEEALRELRRVIEENRKSVKRLLDELKRVLDELLKVLRELSRG

SEQ ID NO: 26534 - protein, 56 aa, Artificial Sequence
  Synthetic
EEDVERAVKEIRDRLRKLLEDYERAVRRLEDKLRRVRERYEAVLKRIKDKLEETKR

SEQ ID NO: 26535 - protein, 62 aa, Artificial Sequence; identical to SEQ ID NO: 26533
  Synthetic

SEQ ID NO: 26536 - protein, 56 aa, Artificial Sequence; identical to SEQ ID NO: 26534
  Synthetic

SEQ ID NO: 26537 - protein, 61 aa, Artificial Sequence
  Synthetic
SRVEELKKLIEDILRISREVVERIARVAEDIHRINRRVLDDLRKLIEDILRTVEEILARKV

SEQ ID NO: 26538 - protein, 55 aa, Artificial Sequence; identical to SEQ ID NO: 26076
  Synthetic

SEQ ID NO: 26539 - protein, 62 aa, Artificial Sequence
  Synthetic
SRVEELKKLIEDILRISREVVERIARVAEDIHRINRRVLDDLRKLIEDILRTVEEILARKVS

SEQ ID NO: 26540 - protein, 55 aa, Artificial Sequence; identical to SEQ ID NO: 26076
  Synthetic

SEQ ID NO: 26541 - protein, 60 aa, Artificial Sequence
  Synthetic
DEDRRLEDAVAKLRKEHADIMKKLDDIMRELDEDHARIKERLDRILEELKALLTRVLRET

SEQ ID NO: 26542 - protein, 54 aa, Artificial Sequence
  Synthetic
EIERIIRRVIEVIREILDLVRKVNKKALRVIEEILEDLARVNKKAVDAIDELAK

SEQ ID NO: 26543 - protein, 60 aa, Artificial Sequence; identical to SEQ ID NO: 26541
  Synthetic

SEQ ID NO: 26544 - protein, 54 aa, Artificial Sequence; identical to SEQ ID NO: 26542
  Synthetic

SEQ ID NO: 26545 - protein, 61 aa, Artificial Sequence
  Synthetic
DEVEELLKRVRELLKASEELVRKILEDVKRLLERSIEEVEDLLRKVEELLKRLLDLVERGG

SEQ ID NO: 26546 - protein, 56 aa, Artificial Sequence
  Synthetic
EDLIRDVDRVLKEIMDLLRDLVRRTKELLEELLRLLEELVRAHKELVRSILDEIRK

SEQ ID NO: 26547 - protein, 61 aa, Artificial Sequence; identical to SEQ ID NO: 26545
  Synthetic

SEQ ID NO: 26548 - protein, 56 aa, Artificial Sequence; identical to SEQ ID NO: 26546
  Synthetic

SEQ ID NO: 26549 - protein, 59 aa, Artificial Sequence
  Synthetic
SEAEELLRELEELLKKSEKVLEDLLRKNAELIKDSKARLDEVRRKVEKLAEEVEEVIRR

SEQ ID NO: 26550 - protein, 56 aa, Artificial Sequence
  Synthetic
KDAVRKLIEELKKLLEDLVEHHERLLKEDHERLKALLDHHRELLKTVLTILRETAK

SEQ ID NO: 26551 - protein, 59 aa, Artificial Sequence; identical to SEQ ID NO: 26549
  Synthetic

SEQ ID NO: 26552 - protein, 56 aa, Artificial Sequence; identical to SEQ ID NO: 26550
  Synthetic

SEQ ID NO: 26553 - protein, 59 aa, Artificial Sequence
  Synthetic
DEEELLRRVTEELKRLLDEARKLHEDVKRELEKLLKENDDLLADVKRKLESLLEALKRG

SEQ ID NO: 26554 - protein, 57 aa, Artificial Sequence
  Synthetic
ADKLLERIRALLETLLEVLKRDNEEIKRILEELLRVAEENLRRIKEIIDRLLDATRR

SEQ ID NO: 26555 - protein, 59 aa, Artificial Sequence; identical to SEQ ID NO: 26553
  Synthetic

SEQ ID NO: 26556 - protein, 57 aa, Artificial Sequence; identical to SEQ ID NO: 26554
  Synthetic

SEQ ID NO: 26557 - protein, 59 aa, Artificial Sequence
  Synthetic
DAEEVVKRLADVLRENDETIRKVVEDLVRIAEENDRLWKKLVEDIAEILRRIVELLRRG

SEQ ID NO: 26558 - protein, 59 aa, Artificial Sequence
  Synthetic
EDVKRALEELVSRLRKLLEDVKKASEDIVREVERIVRELAKRSDEILKKLEDIVEKLRE

SEQ ID NO: 26559 - protein, 59 aa, Artificial Sequence; identical to SEQ ID NO: 26557
  Synthetic

SEQ ID NO: 26560 - protein, 59 aa, Artificial Sequence; identical to SEQ ID NO: 26558
  Synthetic

SEQ ID NO: 26561 - protein, 56 aa, Artificial Sequence
  Synthetic
DKDKRLEELLKRLKELNDKTFEELERILEELKRANEASLREAERILEELRARIEGG

SEQ ID NO: 26562 - protein, 59 aa, Artificial Sequence; identical to SEQ ID NO: 26128
  Synthetic

SEQ ID NO: 26563 - protein, 56 aa, Artificial Sequence; identical to SEQ ID NO: 26561
  Synthetic

SEQ ID NO: 26564 - protein, 59 aa, Artificial Sequence; identical to SEQ ID NO: 26128
  Synthetic

SEQ ID NO: 26565 - protein, 56 aa, Artificial Sequence
  Synthetic
SKEETLKRLLDELEKRNRETVERLERLLKELEDRNRASLEELEAVLEELERKIEES

SEQ ID NO: 26566 - protein, 59 aa, Artificial Sequence
  Synthetic
EEVKDIVRAMEEVIRRLIEILRRDVELNLDVAKKLLELLKEDSKLNLDVARELLELLDR

SEQ ID NO: 26567 - protein, 56 aa, Artificial Sequence; identical to SEQ ID NO: 26565
  Synthetic

SEQ ID NO: 26568 - protein, 59 aa, Artificial Sequence; identical to SEQ ID NO: 26566
  Synthetic

SEQ ID NO: 26569 - protein, 57 aa, Artificial Sequence
  Synthetic
DEEETLRRLLERKVELAKEYLDVSKEVIDRTTKLLDEYLKTSKRIVDATVELLERGD

SEQ ID NO: 26570 - protein, 60 aa, Artificial Sequence
  Synthetic
SREALEEARRRLEELLRELNEITKDLEAKLEKLLRDLNELTKALEEELKRLLDELKKRTD

SEQ ID NO: 26571 - protein, 57 aa, Artificial Sequence; identical to SEQ ID NO: 26569
  Synthetic

SEQ ID NO: 26572 - protein, 60 aa, Artificial Sequence; identical to SEQ ID NO: 26570
  Synthetic

SEQ ID NO: 26573 - protein, 56 aa, Artificial Sequence
  Synthetic
SEAERTKESLKKVLKALVDLNRELLRKLEENMRELTKLNEEVKRALKEVLDKVREG

SEQ ID NO: 26574 - protein, 59 aa, Artificial Sequence
  Synthetic
EEIRKIVEEILKEIKELADRYREEVRKSKDKLRSILEDYKRKVDELKERLRELIEEVET

SEQ ID NO: 26575 - protein, 56 aa, Artificial Sequence; identical to SEQ ID NO: 26573
  Synthetic

SEQ ID NO: 26576 - protein, 59 aa, Artificial Sequence; identical to SEQ ID NO: 26574
  Synthetic

SEQ ID NO: 26577 - protein, 61 aa, Artificial Sequence
  Synthetic
SEVEDILRRLAELNKRLIDKLRELIDRIARLNEELLRVVEDILSRLKRLADELIRVVRERG

SEQ ID NO: 26578 - protein, 56 aa, Artificial Sequence
  Synthetic
DEDLKRLLEKLKEDVERVLKEVRDRTAESLKHLEDVIRELEKKTEDSLRHMEERRK

SEQ ID NO: 26579 - protein, 61 aa, Artificial Sequence; identical to SEQ ID NO: 26577
  Synthetic

SEQ ID NO: 26580 - protein, 56 aa, Artificial Sequence; identical to SEQ ID NO: 26578
  Synthetic

SEQ ID NO: 26581 - protein, 60 aa, Artificial Sequence
  Synthetic
DEERIIKTLEDINAKLVEDIKRILDKVAELNERLADAIRKILEETKRILEATTRKVRKDG

SEQ ID NO: 26582 - protein, 56 aa, Artificial Sequence
  Synthetic
KDTLRTVEKLVEDVKRRLDKLLEDYKRLIEEVKKELDKLLKEYEDALREIKKRIDE

SEQ ID NO: 26583 - protein, 60 aa, Artificial Sequence; identical to SEQ ID NO: 26581
  Synthetic

SEQ ID NO: 26584 - protein, 56 aa, Artificial Sequence; identical to SEQ ID NO: 26582
  Synthetic

SEQ ID NO: 26585 - protein, 58 aa, Artificial Sequence; identical to SEQ ID NO: 26193
  Synthetic

SEQ ID NO: 26586 - protein, 56 aa, Artificial Sequence
  Synthetic
REEVKRVLEEARDELRRLLEEYKAIIEELERELERLLREHREVIRRIKEEIDKSSK

SEQ ID NO: 26587 - protein, 58 aa, Artificial Sequence; identical to SEQ ID NO: 26193
  Synthetic

SEQ ID NO: 26588 - protein, 56 aa, Artificial Sequence; identical to SEQ ID NO: 26586
  Synthetic

SEQ ID NO: 26589 - protein, 59 aa, Artificial Sequence; identical to SEQ ID NO: 26195
  Synthetic

SEQ ID NO: 26590 - protein, 56 aa, Artificial Sequence; identical to SEQ ID NO: 26196
  Synthetic

SEQ ID NO: 26591 - protein, 59 aa, Artificial Sequence; identical to SEQ ID NO: 26195
  Synthetic

SEQ ID NO: 26592 - protein, 56 aa, Artificial Sequence; identical to SEQ ID NO: 26196
  Synthetic

SEQ ID NO: 26593 - protein, 60 aa, Artificial Sequence
  Synthetic
SLEEIVKKLEDLNKKAVEILRRVLEEHEKLVEKVKKVLRDVLRLLEKVVREVIETLKKGD

SEQ ID NO: 26594 - protein, 56 aa, Artificial Sequence
  Synthetic
EEVLRKLKEIIKELKDRLKKLLDDYERIIDELRAELERVLREYEKILEDLRKELED

SEQ ID NO: 26595 - protein, 60 aa, Artificial Sequence; identical to SEQ ID NO: 26593
  Synthetic

SEQ ID NO: 26596 - protein, 56 aa, Artificial Sequence; identical to SEQ ID NO: 26594
  Synthetic

SEQ ID NO: 26597 - protein, 59 aa, Artificial Sequence
  Synthetic
SADEALEELVRRLLEVLKTVLERTKELSRDDLRVVKEVLRIIEELVKRLLKVIRDGLDD

SEQ ID NO: 26598 - protein, 59 aa, Artificial Sequence
  Synthetic
EDVRRDIERLLEELKRRVERLLEDIERLLAELEKLNEDVLRENKALLEDLERRVRERKK

SEQ ID NO: 26599 - protein, 59 aa, Artificial Sequence; identical to SEQ ID NO: 26597
  Synthetic

SEQ ID NO: 26600 - protein, 59 aa, Artificial Sequence; identical to SEQ ID NO: 26598
  Synthetic

SEQ ID NO: 26601 - protein, 59 aa, Artificial Sequence
  Synthetic
REVEEIERRLRELVRRSDELVRTVAEELEKLVRRNKKLVEDVMKRLRDLVERLRELVDA

SEQ ID NO: 26602 - protein, 58 aa, Artificial Sequence
  Synthetic
SGSKEVLDILERAVEVVRRVIKALKEVLERHVDATREVIERVKRVNKRLLEAVREVVT

SEQ ID NO: 26603 - protein, 58 aa, Artificial Sequence
  Synthetic
GVPEEIDRELKRVVEELRRLHEEIKERLDDVARRSEEELRRIIKKLKEVVKEIRKKLK

SEQ ID NO: 26604 - protein, 55 aa, Artificial Sequence
  Synthetic
DLLRKLEEELRRIKEKLRKALEELEREHRELEKELDKLHDESRKEHERIEEELRR

SEQ ID NO: 26605 - protein, 57 aa, Artificial Sequence
  Synthetic
DEDLLEKIKRVIREHIKALEKLARDLKEILRRHIEALKELARDLAEVIRKLLEDVKR

SEQ ID NO: 26606 - protein, 54 aa, Artificial Sequence
  Synthetic
DLERLRRKVEELEDRLRRLLEKLARDSAELMRELERILDRYARESEELDRRLAE

SEQ ID NO: 26607 - protein, 54 aa, Artificial Sequence
  Synthetic
DLEDILRKNLDRLRKLLERLREILRENLEALKKTLKRLEDVVREILEDLKRERK

SEQ ID NO: 26608 - protein, 54 aa, Artificial Sequence; identical to SEQ ID NO: 26606
  Synthetic

SEQ ID NO: 26609 - protein, 58 aa, Artificial Sequence; identical to SEQ ID NO: 26602
  Synthetic

SEQ ID NO: 26610 - protein, 54 aa, Artificial Sequence; identical to SEQ ID NO: 26606
  Synthetic

SEQ ID NO: 26611 - protein, 58 aa, Artificial Sequence
  Synthetic
RLIEEVVRLLRENLDVVRRILEALAKLIKELLEALEEVLRRNKELIRELLRVLDEALK

SEQ ID NO: 26612 - protein, 55 aa, Artificial Sequence
  Synthetic
DIVRAMEEVIRRLIEILRRDVELNLDVAKKLLELLKEDSKLNLDVARELLELLDR

SEQ ID NO: 26613 - protein, 55 aa, Artificial Sequence; identical to SEQ ID NO: 26612
  Synthetic

SEQ ID NO: 26614 - protein, 58 aa, Artificial Sequence; identical to SEQ ID NO: 26611
  Synthetic

SEQ ID NO: 26615 - protein, 58 aa, Artificial Sequence; identical to SEQ ID NO: 26611
  Synthetic

SEQ ID NO: 26616 - protein, 55 aa, Artificial Sequence; identical to SEQ ID NO: 26604
  Synthetic

SEQ ID NO: 26617 - protein, 55 aa, Artificial Sequence; identical to SEQ ID NO: 26604
  Synthetic

SEQ ID NO: 26618 - protein, 58 aa, Artificial Sequence
  Synthetic
ELAREVERVIKELLDKSKEILERIERAIDELLKVSEEILKLSEDASEELLKILREFAK

SEQ ID NO: 26619 - protein, 58 aa, Artificial Sequence
  Synthetic
DVKDIIRTILEVARDLLRLLEEDSRTNSEVVKRLLDLLREDSKANSEVVKRLLDVLRE

SEQ ID NO: 26620 - protein, 54 aa, Artificial Sequence; identical to SEQ ID NO: 26606
  Synthetic

SEQ ID NO: 26621 - protein, 54 aa, Artificial Sequence; identical to SEQ ID NO: 26606
  Synthetic

SEQ ID NO: 26622 - protein, 58 aa, Artificial Sequence; identical to SEQ ID NO: 26611
  Synthetic

SEQ ID NO: 26623 - protein, 54 aa, Artificial Sequence; identical to SEQ ID NO: 26607
  Synthetic

SEQ ID NO: 26624 - protein, 55 aa, Artificial Sequence; identical to SEQ ID NO: 26604
  Synthetic

SEQ ID NO: 26625 - protein, 57 aa, Artificial Sequence; identical to SEQ ID NO: 26605
  Synthetic

SEQ ID NO: 26626 - protein, 58 aa, Artificial Sequence
  Synthetic
ELVRIAIEVLKRLLEIIEELVRLNNEILERLLKIVRELHKDNIKILEDLLRIIEEVLR

SEQ ID NO: 26627 - protein, 58 aa, Artificial Sequence; identical to SEQ ID NO: 26626
  Synthetic

SEQ ID NO: 26628 - protein, 58 aa, Artificial Sequence
  Synthetic
RLARLLKALADKLIRVLEEILKINEELNRKIIKFARENLERNRRVNKKVIEVLREAAR

SEQ ID NO: 26629 - protein, 54 aa, Artificial Sequence; identical to SEQ ID NO: 26606
  Synthetic

SEQ ID NO: 26630 - protein, 58 aa, Artificial Sequence; identical to SEQ ID NO: 26626
  Synthetic

SEQ ID NO: 26631 - protein, 58 aa, Artificial Sequence; identical to SEQ ID NO: 26626
  Synthetic

SEQ ID NO: 26632 - protein, 55 aa, Artificial Sequence; identical to SEQ ID NO: 26612
  Synthetic

SEQ ID NO: 26633 - protein, 58 aa, Artificial Sequence
  Synthetic
RKIAKIIEELKRLLEDLARDTRRVIEEAKRLLKEWRDRNKEVADTLKKLLEDLIRKIR

SEQ ID NO: 26634 - protein, 55 aa, Artificial Sequence; identical to SEQ ID NO: 26604
  Synthetic

SEQ ID NO: 26635 - protein, 55 aa, Artificial Sequence; identical to SEQ ID NO: 26604
  Synthetic

SEQ ID NO: 26636 - protein, 58 aa, Artificial Sequence; identical to SEQ ID NO: 26633
  Synthetic

SEQ ID NO: 26637 - protein, 58 aa, Artificial Sequence; identical to SEQ ID NO: 26626
  Synthetic

SEQ ID NO: 26638 - protein, 57 aa, Artificial Sequence
  Synthetic
TVRRLREALKKLEDDLRKIERDAEREYKKLKDELEELTERYRREIRKLKEELKADRK

SEQ ID NO: 26639 - protein, 58 aa, Artificial Sequence
  Synthetic
DEAERRRRELKDKLDRLREEHEEVKRRLEEELTRLRETHKKIEKELREALKRVRDRST

SEQ ID NO: 26640 - protein, 58 aa, Artificial Sequence; identical to SEQ ID NO: 26639
  Synthetic

SEQ ID NO: 26641 - protein, 54 aa, Artificial Sequence; identical to SEQ ID NO: 26607
  Synthetic

SEQ ID NO: 26642 - protein, 54 aa, Artificial Sequence; identical to SEQ ID NO: 26606
  Synthetic

SEQ ID NO: 26643 - protein, 58 aa, Artificial Sequence; identical to SEQ ID NO: 26639
  Synthetic

SEQ ID NO: 26644 - protein, 58 aa, Artificial Sequence; identical to SEQ ID NO: 26639
  Synthetic

SEQ ID NO: 26645 - protein, 58 aa, Artificial Sequence; identical to SEQ ID NO: 26639
  Synthetic

SEQ ID NO: 26646 - protein, 56 aa, Artificial Sequence
  Synthetic
DKAVEELEKALEEIKRRLKEVIDRYEDELRKLRKEYKEKIDKYERKLEEIERRERT

SEQ ID NO: 26647 - protein, 58 aa, Artificial Sequence
  Synthetic
DVKRALEELVSRLRKLLEDVKKASEDIVREVERIVRELAKRSDEILKKLEDIVEKLRE

SEQ ID NO: 26648 - protein, 58 aa, Artificial Sequence; identical to SEQ ID NO: 26647
  Synthetic

SEQ ID NO: 26649 - protein, 58 aa, Artificial Sequence; identical to SEQ ID NO: 26639
  Synthetic

SEQ ID NO: 26650 - protein, 58 aa, Artificial Sequence; identical to SEQ ID NO: 26647
  Synthetic

SEQ ID NO: 26651 - protein, 58 aa, Artificial Sequence
  Synthetic
EVKRRLEEKERRIRTRYEELRRRLRKRVKDYEDKLREIEKKVRRDAERIEEELERAKK

SEQ ID NO: 26652 - protein, 58 aa, Artificial Sequence; identical to SEQ ID NO: 26639
  Synthetic

SEQ ID NO: 26653 - protein, 58 aa, Artificial Sequence
  Synthetic
KIAEEIERELEELRRMIKRLHEDLERKLKESEDELREIEARLEEKIRRLEEKLERKRR

SEQ ID NO: 26654 - protein, 58 aa, Artificial Sequence; identical to SEQ ID NO: 26653
  Synthetic

SEQ ID NO: 26655 - protein, 56 aa, Artificial Sequence; identical to SEQ ID NO: 26646
  Synthetic

SEQ ID NO: 26656 - protein, 58 aa, Artificial Sequence; identical to SEQ ID NO: 26653
  Synthetic

SEQ ID NO: 26657 - protein, 58 aa, Artificial Sequence; identical to SEQ ID NO: 26626
  Synthetic

SEQ ID NO: 26658 - protein, 55 aa, Artificial Sequence; identical to SEQ ID NO: 26076
  Synthetic

SEQ ID NO: 26659 - protein, 58 aa, Artificial Sequence; identical to SEQ ID NO: 26647
  Synthetic

SEQ ID NO: 26660 - protein, 58 aa, Artificial Sequence; identical to SEQ ID NO: 26639
  Synthetic

SEQ ID NO: 26661 - protein, 58 aa, Artificial Sequence; identical to SEQ ID NO: 26639
  Synthetic

SEQ ID NO: 26662 - protein, 58 aa, Artificial Sequence
  Synthetic
TLREVVRKVLEEAKRLLDELEEVHKRVKKELEDIIEENRRVVKRVRDELREIKRELDE

SEQ ID NO: 26663 - protein, 58 aa, Artificial Sequence; identical to SEQ ID NO: 26647
  Synthetic

SEQ ID NO: 26664 - protein, 58 aa, Artificial Sequence; identical to SEQ ID NO: 26647
  Synthetic

SEQ ID NO: 26665 - protein, 58 aa, Artificial Sequence; identical to SEQ ID NO: 26639
  Synthetic

SEQ ID NO: 26666 - protein, 58 aa, Artificial Sequence; identical to SEQ ID NO: 26639
  Synthetic

SEQ ID NO: 26667 - protein, 58 aa, Artificial Sequence; identical to SEQ ID NO: 26653
  Synthetic

SEQ ID NO: 26668 - protein, 58 aa, Artificial Sequence; identical to SEQ ID NO: 26647
  Synthetic

SEQ ID NO: 26669 - protein, 58 aa, Artificial Sequence
  Synthetic
SEAERLADEVRKAVKKSEEDNETLVREVEKAVRELKKNNKTWVDEVRKLMKRLVDLLR

SEQ ID NO: 26670 - protein, 58 aa, Artificial Sequence; identical to SEQ ID NO: 26669
  Synthetic

SEQ ID NO: 26671 - protein, 58 aa, Artificial Sequence
  Synthetic
DKDKRLEELLKRLKELNDKTFEELERILEELKRANEASLREAERILEELRARIEGGNL

SEQ ID NO: 26672 - protein, 58 aa, Artificial Sequence
  Synthetic
SEAEDLEELIKELAELLKDVIRKLEKINRRLVKILEDIIRRLKEISKEAEEELRKGTV

SEQ ID NO: 26673 - protein, 58 aa, Artificial Sequence
  Synthetic
SDKEEIKRRVEKTARDLETEHDKIKKRLEDTVRDIKRELDELLEKYERVLRKIEKTLR

SEQ ID NO: 26674 - protein, 58 aa, Artificial Sequence
  Synthetic
SEAEKIREALETNLRLLEELIKRLKEILDTHNELLRRVIETLERLLKELLELLEEGGL

SEQ ID NO: 26675 - protein, 58 aa, Artificial Sequence; identical to SEQ ID NO: 26674
  Synthetic

SEQ ID NO: 26676 - protein, 58 aa, Artificial Sequence
  Synthetic
SKEERLREVAEKHKKDLEDIVKRVDEAAKETARRLEEILKRLEEVLKKILDDLEKGPD

SEQ ID NO: 26677 - protein, 58 aa, Artificial Sequence
  Synthetic
SLEEITKRLLELVEENLARHEEILRELLELAKRLAKEDRDILEEVLKLIEELLKLLED

SEQ ID NO: 26678 - protein, 58 aa, Artificial Sequence
  Synthetic
SKEETLKRLLDELEKRNRETVERLERLLKELEDRNRASLEELEAVLEELERKIEESGL

SEQ ID NO: 26679 - protein, 58 aa, Artificial Sequence; identical to SEQ ID NO: 26678
  Synthetic

SEQ ID NO: 26680 - protein, 58 aa, Artificial Sequence; identical to SEQ ID NO: 26678
  Synthetic

SEQ ID NO: 26681 - protein, 58 aa, Artificial Sequence
  Synthetic
STREKAKKVLDTLRADNEDMKRVVEKILRALKRTNERAEKLAREITEEIKRILKEVGV

SEQ ID NO: 26682 - protein, 58 aa, Artificial Sequence
  Synthetic
DAEEVVKRLADVLRENDETIRKVVEDLVRIAEENDRLWKKLVEDIAEILRRIVELLRR

SEQ ID NO: 26683 - protein, 58 aa, Artificial Sequence; identical to SEQ ID NO: 26678
  Synthetic

SEQ ID NO: 26684 - protein, 58 aa, Artificial Sequence; identical to SEQ ID NO: 26681
  Synthetic

SEQ ID NO: 26685 - protein, 58 aa, Artificial Sequence
  Synthetic
SKEEEVEKVLRKWEEILRRLIEENKRANDKIRREYEELVKEIRRVLEEIKEVAERLGV

SEQ ID NO: 26686 - protein, 58 aa, Artificial Sequence
  Synthetic
DREKSVRDIEEDLKRVLDKLRRRVETSKEELKKVLKADKENADELEKTLRDVVRELDR

SEQ ID NO: 26687 - protein, 58 aa, Artificial Sequence; identical to SEQ ID NO: 26673
  Synthetic

SEQ ID NO: 26688 - protein, 58 aa, Artificial Sequence; identical to SEQ ID NO: 26681
  Synthetic

SEQ ID NO: 26689 - protein, 58 aa, Artificial Sequence
  Synthetic
SKDEELARLLEELVERWRKIVEDLERDHRRLVKEIRELVERIRKKLEELVDRIRKNGI

SEQ ID NO: 26690 - protein, 58 aa, Artificial Sequence; identical to SEQ ID NO: 26669
  Synthetic

SEQ ID NO: 26691 - protein, 58 aa, Artificial Sequence; identical to SEQ ID NO: 26689
  Synthetic

SEQ ID NO: 26692 - protein, 58 aa, Artificial Sequence
  Synthetic
KEIEETLKELEDLNREMVETNRRVLEETRRLNKETVDRVKATLDELAKMLKKLVDDVR

SEQ ID NO: 26693 - protein, 58 aa, Artificial Sequence; identical to SEQ ID NO: 26669
  Synthetic

SEQ ID NO: 26694 - protein, 58 aa, Artificial Sequence; identical to SEQ ID NO: 26678
  Synthetic

SEQ ID NO: 26695 - protein, 58 aa, Artificial Sequence
  Synthetic
DKAEVLREALKLLKDLLEELIKIHEESLKRILDLIDTLVKVHEDALRALKELLERSGL

SEQ ID NO: 26696 - protein, 58 aa, Artificial Sequence; identical to SEQ ID NO: 26685
  Synthetic

SEQ ID NO: 26697 - protein, 58 aa, Artificial Sequence; identical to SEQ ID NO: 26678
  Synthetic

SEQ ID NO: 26698 - protein, 56 aa, Artificial Sequence
  Synthetic
SERVKEILERILRVVEEAVRLNEESLRRILDVVRKAVKLDRESLKKILDVVEEAVR

SEQ ID NO: 26699 - protein, 56 aa, Artificial Sequence; identical to SEQ ID NO: 26698
  Synthetic

SEQ ID NO: 26700 - protein, 57 aa, Artificial Sequence
  Synthetic
DERRIAERIRELLRESKKLVRDVVEEAKRLLKENRDSTRKIIEDIRRLLRKIEDSTR

SEQ ID NO: 26701 - protein, 55 aa, Artificial Sequence
  Synthetic
DALSRLLEELLRVVDDLIRVLKELIDKSRKVIEELLELLKRINEENLKVLAEIIK

SEQ ID NO: 26702 - protein, 57 aa, Artificial Sequence; identical to SEQ ID NO: 26700
  Synthetic

SEQ ID NO: 26703 - protein, 58 aa, Artificial Sequence
  Synthetic
EALRKLVELLVEVLRRLIRVNRELVKLLREVLERLLRILRESVKKLKRLIEKVIKDAT

SEQ ID NO: 26704 - protein, 58 aa, Artificial Sequence; identical to SEQ ID NO: 26703
  Synthetic

SEQ ID NO: 26705 - protein, 58 aa, Artificial Sequence
  Synthetic
AAKRLVEELLKAVTDLSRKNKRILEELLKAIETLSDENKKILTEILDALRRLVEKIEK

SEQ ID NO: 26706 - protein, 58 aa, Artificial Sequence; identical to SEQ ID NO: 26703
  Synthetic

SEQ ID NO: 26707 - protein, 58 aa, Artificial Sequence; identical to SEQ ID NO: 26703
  Synthetic

SEQ ID NO: 26708 - protein, 55 aa, Artificial Sequence; identical to SEQ ID NO: 26701
  Synthetic

SEQ ID NO: 26709 - protein, 55 aa, Artificial Sequence; identical to SEQ ID NO: 26701
  Synthetic

SEQ ID NO: 26710 - protein, 58 aa, Artificial Sequence
  Synthetic
RAVKKLDEIVKEVAKKLEDVVRANEELWRALVELNKESVRRLREIVERVARDLEETAR

SEQ ID NO: 26711 - protein, 58 aa, Artificial Sequence
  Synthetic
DRLDKVEELVKKLLEDTKRTVDRVRELVRKILKKSRETLEELERLIEKILRELEKDAR

SEQ ID NO: 26712 - protein, 55 aa, Artificial Sequence; identical to SEQ ID NO: 26701
  Synthetic

SEQ ID NO: 26713 - protein, 58 aa, Artificial Sequence; identical to SEQ ID NO: 26710
  Synthetic

SEQ ID NO: 26714 - protein, 58 aa, Artificial Sequence; identical to SEQ ID NO: 26710
  Synthetic

SEQ ID NO: 26715 - protein, 57 aa, Artificial Sequence
  Synthetic
SEDDLKRVVDEVEKKLRELKRRYAEALERIKEKIKELKDRYERAVREVVAELRKTTK

SEQ ID NO: 26716 - protein, 58 aa, Artificial Sequence; identical to SEQ ID NO: 26710
  Synthetic

SEQ ID NO: 26717 - protein, 55 aa, Artificial Sequence; identical to SEQ ID NO: 26076
  Synthetic

SEQ ID NO: 26718 - protein, 57 aa, Artificial Sequence; identical to SEQ ID NO: 26715
  Synthetic

SEQ ID NO: 26719 - protein, 58 aa, Artificial Sequence
  Synthetic
DEAKELLDEIRKAVKESEDRLEKLLRDYEKELRRLEKELRDLKRRIEEKLEELRRGSL

SEQ ID NO: 26720 - protein, 58 aa, Artificial Sequence
  Synthetic
SEKEDAARKLRKLVEELTREYEELVKKLERLIEEIEKVSEESVRKLEKLLAEISEEVR

SEQ ID NO: 26721 - protein, 58 aa, Artificial Sequence
  Synthetic
SEDEIIKKIIEDLRRVLKEVEEIHKEVEERLDKVLKEAEEMHKEVLKELDRVLDEVKR

SEQ ID NO: 26722 - protein, 58 aa, Artificial Sequence
  Synthetic
SKAEEIAEKLDRLLEENRRALEEITTRLDDLLRRNKDALRKVMEKLKRLLDDLRRGGI

SEQ ID NO: 26723 - protein, 58 aa, Artificial Sequence
  Synthetic
SEKEKLLKESEEEVRRLRRTLEELLRKYREVLERLRKELREIEERVRDVVRRLKEVLD

SEQ ID NO: 26724 - protein, 58 aa, Artificial Sequence; identical to SEQ ID NO: 26720
  Synthetic

SEQ ID NO: 26725 - protein, 58 aa, Artificial Sequence
  Synthetic
SKEETLRKEAEDLLRRLEELTRRLEKKARELLERAKKLSRDLAEELKRLLKELREKGV

SEQ ID NO: 26726 - protein, 58 aa, Artificial Sequence; identical to SEQ ID NO: 26720
  Synthetic

SEQ ID NO: 26727 - protein, 58 aa, Artificial Sequence; identical to SEQ ID NO: 26722
  Synthetic

SEQ ID NO: 26728 - protein, 58 aa, Artificial Sequence; identical to SEQ ID NO: 26720
  Synthetic

SEQ ID NO: 26729 - protein, 58 aa, Artificial Sequence; identical to SEQ ID NO: 26722
  Synthetic

SEQ ID NO: 26730 - protein, 58 aa, Artificial Sequence; identical to SEQ ID NO: 26725
  Synthetic

SEQ ID NO: 26731 - protein, 58 aa, Artificial Sequence
  Synthetic
SRVEELKKLIEDILRISREVVERIKRVAEDIHRINRRVLDDLRKLIEDILRTVEEILA

SEQ ID NO: 26732 - protein, 58 aa, Artificial Sequence; identical to SEQ ID NO: 26725
  Synthetic

SEQ ID NO: 26733 - protein, 58 aa, Artificial Sequence; identical to SEQ ID NO: 26722
  Synthetic

SEQ ID NO: 26734 - protein, 58 aa, Artificial Sequence; identical to SEQ ID NO: 26725
  Synthetic

SEQ ID NO: 26735 - protein, 58 aa, Artificial Sequence; identical to SEQ ID NO: 26720
  Synthetic

SEQ ID NO: 26736 - protein, 58 aa, Artificial Sequence; identical to SEQ ID NO: 26725
  Synthetic

SEQ ID NO: 26737 - protein, 58 aa, Artificial Sequence
  Synthetic
SERETVKRRLEELLKEVKRTLDKLKEEHDRLLEDVRRVVEELKREHDKLLKEVKDSGV

SEQ ID NO: 26738 - protein, 58 aa, Artificial Sequence; identical to SEQ ID NO: 26720
  Synthetic

SEQ ID NO: 26739 - protein, 58 aa, Artificial Sequence; identical to SEQ ID NO: 26725
  Synthetic

SEQ ID NO: 26740 - protein, 58 aa, Artificial Sequence
  Synthetic
KEREEVKEKLDRLLEEVEKTVRELKREHDELLKEVEKLVRDLKKEHDELLKKVKDDGV

SEQ ID NO: 26741 - protein, 58 aa, Artificial Sequence
  Synthetic
SREEVLRELEEVIEDNRRLLEELIEKSKKVLDESLKLIDELLRRLEEVLERVLRLLEE

SEQ ID NO: 26742 - protein, 56 aa, Artificial Sequence; identical to SEQ ID NO: 16914
  Synthetic

SEQ ID NO: 26743 - protein, 57 aa, Artificial Sequence
  Synthetic
SEDSVERIARELERNLDDLARVLKESEDDLAEILRRLKEVLEESERDLERVEREVRK

SEQ ID NO: 26744 - protein, 56 aa, Artificial Sequence; identical to SEQ ID NO: 25244
  Synthetic

SEQ ID NO: 26745 - protein, 57 aa, Artificial Sequence
  Synthetic
SKEKIDRIIRELERILEEAKKKHEDVLRRLEDSLRRVAELLKAALDRLREIVDRLRR

SEQ ID NO: 26746 - protein, 56 aa, Artificial Sequence; identical to SEQ ID NO: 16914
  Synthetic

SEQ ID NO: 26747 - protein, 57 aa, Artificial Sequence
  Synthetic
DIKTLLDRVRKLAEEDAERLDRLRRESEELNERVRRVDKKLLEEIRRKAKKVEDDTR

SEQ ID NO: 26748 - protein, 57 aa, Artificial Sequence
  Synthetic
DAETLLRELEKLSRDNKELLKKIEKEIRDLIKEDKERNIELSERLRKLVEELKKKAT

SEQ ID NO: 26749 - protein, 56 aa, Artificial Sequence; identical to SEQ ID NO: 16914
  Synthetic

SEQ ID NO: 26750 - protein, 57 aa, Artificial Sequence; identical to SEQ ID NO: 26747
  Synthetic

SEQ ID NO: 26751 - protein, 56 aa, Artificial Sequence
  Synthetic
SEELSAEVKKLLDEVRKALARHKDENDKLLKEIEDSLRRHKEENDRLLEKLKESTR

SEQ ID NO: 26752 - protein, 57 aa, Artificial Sequence
  Synthetic
DADDVLARVEELAKRAHDENERLIREVEELVRAHNKRNKELVDEVKRLVEKVIEEER

SEQ ID NO: 26753 - protein, 57 aa, Artificial Sequence; identical to SEQ ID NO: 26745
  Synthetic

SEQ ID NO: 26754 - protein, 56 aa, Artificial Sequence; identical to SEQ ID NO: 16914
  Synthetic

SEQ ID NO: 26755 - protein, 56 aa, Artificial Sequence; identical to SEQ ID NO: 26751
  Synthetic

SEQ ID NO: 26756 - protein, 57 aa, Artificial Sequence
  Synthetic
DAETVLRSAEDIVAKNRKLAEEVLRRVKKIVEENRKIASEVLDDVRKLVEDVLARAS

SEQ ID NO: 26757 - protein, 57 aa, Artificial Sequence; identical to SEQ ID NO: 26752
  Synthetic

SEQ ID NO: 26758 - protein, 57 aa, Artificial Sequence; identical to SEQ ID NO: 26745
  Synthetic

SEQ ID NO: 26759 - protein, 57 aa, Artificial Sequence
  Synthetic
DEEKLKDLIRKLRDILRRAAEAHKKLIDDARESLERAKREHEKLIDRLKKILEELER

SEQ ID NO: 26760 - protein, 57 aa, Artificial Sequence; identical to SEQ ID NO: 26747
  Synthetic

SEQ ID NO: 26761 - protein, 57 aa, Artificial Sequence
  Synthetic
DATRVIEEAKRILDEARKLNEETIRRSEELVRRIERVIEEIIKRSEKLLEDVARESK

SEQ ID NO: 26762 - protein, 56 aa, Artificial Sequence; identical to SEQ ID NO: 26751
  Synthetic

SEQ ID NO: 26763 - protein, 57 aa, Artificial Sequence; identical to SEQ ID NO: 26756
  Synthetic

SEQ ID NO: 26764 - protein, 57 aa, Artificial Sequence; identical to SEQ ID NO: 26752
  Synthetic

SEQ ID NO: 26765 - protein, 56 aa, Artificial Sequence; identical to SEQ ID NO: 25244
  Synthetic

SEQ ID NO: 26766 - protein, 56 aa, Artificial Sequence
  Synthetic
DEEVLKKLAEIVRRVKEENRKVNEEVEKRLRELEEENKKVIEDLKSTVEELVERLR

SEQ ID NO: 26767 - protein, 56 aa, Artificial Sequence; identical to SEQ ID NO: 26766
  Synthetic

SEQ ID NO: 26768 - protein, 55 aa, Artificial Sequence
  Synthetic
DKLLKEARDLIREIEKRLEELLKRVEKLTEDAKRDLERSNREHKELADRIKETAR

SEQ ID NO: 26769 - protein, 56 aa, Artificial Sequence
  Synthetic
DKDSARELERIVKENAELAERVFREVEKIVRENTKLAEDSVRELKRLVEELKKRAK

SEQ ID NO: 26770 - protein, 57 aa, Artificial Sequence; identical to SEQ ID NO: 26745
  Synthetic

SEQ ID NO: 26771 - protein, 57 aa, Artificial Sequence; identical to SEQ ID NO: 26759
  Synthetic

SEQ ID NO: 26772 - protein, 56 aa, Artificial Sequence; identical to SEQ ID NO: 16914
  Synthetic

SEQ ID NO: 26773 - protein, 57 aa, Artificial Sequence
  Synthetic
DEEVLRTLEEIIRRLTKELEDVLREYERELRRLEEENKRVIDKTEEEIRRLADRLRR

SEQ ID NO: 26774 - protein, 57 aa, Artificial Sequence
  Synthetic
DERILRELEERVKELEKEAREILKRSEDETDKLREKAERILEDLERANRRTMDEARR

SEQ ID NO: 26775 - protein, 56 aa, Artificial Sequence; identical to SEQ ID NO: 26751
  Synthetic

SEQ ID NO: 26776 - protein, 58 aa, Artificial Sequence
  Synthetic
LPEEVLRELEELLKESEERIKRIEEEIKKIIDKSREDIKRVLEEIERLNAKAADDLRK

SEQ ID NO: 26777 - protein, 57 aa, Artificial Sequence; identical to SEQ ID NO: 26752
  Synthetic

SEQ ID NO: 26778 - protein, 56 aa, Artificial Sequence; identical to SEQ ID NO: 26766
  Synthetic

SEQ ID NO: 26779 - protein, 55 aa, Artificial Sequence; identical to SEQ ID NO: 26768
  Synthetic

SEQ ID NO: 26780 - protein, 57 aa, Artificial Sequence; identical to SEQ ID NO: 26773
  Synthetic

SEQ ID NO: 26781 - protein, 56 aa, Artificial Sequence
  Synthetic
DRRIEKVLKEIEEKIREVIKEWERVHREVEELLKRLIDENRKVLDEIRKLLEEKSK

SEQ ID NO: 26782 - protein, 57 aa, Artificial Sequence; identical to SEQ ID NO: 26774
  Synthetic

SEQ ID NO: 26783 - protein, 56 aa, Artificial Sequence; identical to SEQ ID NO: 26751
  Synthetic

SEQ ID NO: 26784 - protein, 56 aa, Artificial Sequence; identical to SEQ ID NO: 26766
  Synthetic

SEQ ID NO: 26785 - protein, 57 aa, Artificial Sequence; identical to SEQ ID NO: 26745
  Synthetic

SEQ ID NO: 26786 - protein, 56 aa, Artificial Sequence; identical to SEQ ID NO: 26781
  Synthetic

SEQ ID NO: 26787 - protein, 57 aa, Artificial Sequence
  Synthetic
TLRELARSIRKLSAENKERLKELLRELKKLSDENKERIKKLLSDAEKIIEDVARRAK

SEQ ID NO: 26788 - protein, 57 aa, Artificial Sequence; identical to SEQ ID NO: 26774
  Synthetic

SEQ ID NO: 26789 - protein, 58 aa, Artificial Sequence
  Synthetic
EKLKELRDVIAEVAKRIDELDEYTRESIRRAKKEIERLNRETKKVIEEVVKRIEEERK

SEQ ID NO: 26790 - protein, 56 aa, Artificial Sequence
  Synthetic
DERVREELKKLLTRVEEEHRKVLETDKKILKEAHKESKEVNDRDRELLERLEESVR

SEQ ID NO: 26791 - protein, 57 aa, Artificial Sequence; identical to SEQ ID NO: 26752
  Synthetic

SEQ ID NO: 26792 - protein, 57 aa, Artificial Sequence
  Synthetic
TVKRLLDELRELLERLKRTIEELLKRNRDLLADAEEKARRLLEENRKLLKAARDTAT

SEQ ID NO: 26793 - protein, 56 aa, Artificial Sequence; identical to SEQ ID NO: 26766
  Synthetic

SEQ ID NO: 26794 - protein, 57 aa, Artificial Sequence; identical to SEQ ID NO: 26745
  Synthetic

SEQ ID NO: 26795 - protein, 57 aa, Artificial Sequence; identical to SEQ ID NO: 26774
  Synthetic

SEQ ID NO: 26796 - protein, 57 aa, Artificial Sequence; identical to SEQ ID NO: 26761
  Synthetic

SEQ ID NO: 26797 - protein, 58 aa, Artificial Sequence
  Synthetic
EAAREIIKRLREVNKRTKEKLDELIKHSEEVLERVKRLIDELRKHSEEVLEDLRRRAK

SEQ ID NO: 26798 - protein, 58 aa, Artificial Sequence; identical to SEQ ID NO: 26789
  Synthetic

SEQ ID NO: 26799 - protein, 58 aa, Artificial Sequence
  Synthetic
ELLRRIKKLLDEIKKAIEDSSREIKRLLEESERVMKRSSEDIKRTLDDTRRVVEEVRR

SEQ ID NO: 26800 - protein, 55 aa, Artificial Sequence
  Synthetic
SKAIKDVRDIVKKVKDELKEWRDRNKELVDRLSEELKEWLKDVERVLKELTDKDR

SEQ ID NO: 26801 - protein, 56 aa, Artificial Sequence; identical to SEQ ID NO: 26790
  Synthetic

SEQ ID NO: 26802 - protein, 57 aa, Artificial Sequence
  Synthetic
DIDKLLKELRDLVEKIKKDLKELLERYEEIVRRIKELLKDLNREAEEVVRRLKEELR

SEQ ID NO: 26803 - protein, 57 aa, Artificial Sequence; identical to SEQ ID NO: 26752
  Synthetic

SEQ ID NO: 26804 - protein, 56 aa, Artificial Sequence; identical to SEQ ID NO: 26766
  Synthetic

SEQ ID NO: 26805 - protein, 58 aa, Artificial Sequence
  Synthetic
EREEELKEVADRVKEKLDRLNRENEKSSEELKRELDKINDENRETSERLKREIDETTR

SEQ ID NO: 26806 - protein, 57 aa, Artificial Sequence; identical to SEQ ID NO: 26745
  Synthetic

SEQ ID NO: 26807 - protein, 57 aa, Artificial Sequence; identical to SEQ ID NO: 26745
  Synthetic

SEQ ID NO: 26808 - protein, 57 aa, Artificial Sequence
  Synthetic
TKDLLDENSKRSNEISREVKKDLERTVRENKKIVDEVAKALEDTVDKNRRIVEEVTT

SEQ ID NO: 26809 - protein, 56 aa, Artificial Sequence; identical to SEQ ID NO: 16914
  Synthetic

SEQ ID NO: 26810 - protein, 56 aa, Artificial Sequence; identical to SEQ ID NO: 26781
  Synthetic

SEQ ID NO: 26811 - protein, 58 aa, Artificial Sequence; identical to SEQ ID NO: 26799
  Synthetic

SEQ ID NO: 26812 - protein, 56 aa, Artificial Sequence; identical to SEQ ID NO: 26751
  Synthetic

SEQ ID NO: 26813 - protein, 57 aa, Artificial Sequence; identical to SEQ ID NO: 26802
  Synthetic

SEQ ID NO: 26814 - protein, 57 aa, Artificial Sequence; identical to SEQ ID NO: 26752
  Synthetic

SEQ ID NO: 26815 - protein, 56 aa, Artificial Sequence; identical to SEQ ID NO: 26766
  Synthetic

SEQ ID NO: 26816 - protein, 56 aa, Artificial Sequence; identical to SEQ ID NO: 26766
  Synthetic

SEQ ID NO: 26817 - protein, 57 aa, Artificial Sequence; identical to SEQ ID NO: 26745
  Synthetic

SEQ ID NO: 26818 - protein, 56 aa, Artificial Sequence
  Synthetic
SEELREELKKLERKIEKVAKEIHDHDKEVTERLEDLLRRITEHARKSDREIEETAR

SEQ ID NO: 26819 - protein, 56 aa, Artificial Sequence; identical to SEQ ID NO: 26781
  Synthetic

SEQ ID NO: 26820 - protein, 57 aa, Artificial Sequence; identical to SEQ ID NO: 26761
  Synthetic

SEQ ID NO: 26821 - protein, 58 aa, Artificial Sequence; identical to SEQ ID NO: 26789
  Synthetic

SEQ ID NO: 26822 - protein, 58 aa, Artificial Sequence; identical to SEQ ID NO: 26799
  Synthetic

SEQ ID NO: 26823 - protein, 57 aa, Artificial Sequence; identical to SEQ ID NO: 26802
  Synthetic

SEQ ID NO: 26824 - protein, 58 aa, Artificial Sequence
  Synthetic
EAKKKLDEVLERAKRTIDRLLETSDRSLEKVEADLRRLNEELDRSLERAERTIRELAK

SEQ ID NO: 26825 - protein, 56 aa, Artificial Sequence; identical to SEQ ID NO: 26766
  Synthetic

SEQ ID NO: 26826 - protein, 56 aa, Artificial Sequence; identical to SEQ ID NO: 26766
  Synthetic

SEQ ID NO: 26827 - protein, 56 aa, Artificial Sequence; identical to SEQ ID NO: 26781
  Synthetic

SEQ ID NO: 26828 - protein, 57 aa, Artificial Sequence; identical to SEQ ID NO: 26774
  Synthetic

SEQ ID NO: 26829 - protein, 57 aa, Artificial Sequence
  Synthetic
DLKRVEERAREVSRRNEESMRRVKEDADRVSEANKEVLDRVREEVKRLIEEVRETLR

SEQ ID NO: 26830 - protein, 58 aa, Artificial Sequence; identical to SEQ ID NO: 26789
  Synthetic

SEQ ID NO: 26831 - protein, 58 aa, Artificial Sequence; identical to SEQ ID NO: 26799
  Synthetic

SEQ ID NO: 26832 - protein, 58 aa, Artificial Sequence; identical to SEQ ID NO: 26799
  Synthetic

SEQ ID NO: 26833 - protein, 58 aa, Artificial Sequence; identical to SEQ ID NO: 26776
  Synthetic

SEQ ID NO: 26834 - protein, 58 aa, Artificial Sequence; identical to SEQ ID NO: 26824
  Synthetic

SEQ ID NO: 26835 - protein, 56 aa, Artificial Sequence; identical to SEQ ID NO: 26766
  Synthetic

SEQ ID NO: 26836 - protein, 55 aa, Artificial Sequence; identical to SEQ ID NO: 26768
  Synthetic

SEQ ID NO: 26837 - protein, 55 aa, Artificial Sequence; identical to SEQ ID NO: 26768
  Synthetic

SEQ ID NO: 26838 - protein, 58 aa, Artificial Sequence
  Synthetic
DIVRKIERIVETIEREVRESVKKVEEIARDIRRKVDESVKNVEKLLRDVDKKARDRKK

SEQ ID NO: 26839 - protein, 55 aa, Artificial Sequence
  Synthetic
DEIKRIVDEVRERLKRIVDENAKIVEDARRALEKIVKENEEILRRLKKELRELRK

SEQ ID NO: 26840 - protein, 56 aa, Artificial Sequence; identical to SEQ ID NO: 26781
  Synthetic

SEQ ID NO: 26841 - protein, 57 aa, Artificial Sequence; identical to SEQ ID NO: 26829
  Synthetic

SEQ ID NO: 26842 - protein, 57 aa, Artificial Sequence; identical to SEQ ID NO: 26761
  Synthetic

SEQ ID NO: 26843 - protein, 57 aa, Artificial Sequence
  Synthetic
DAETIERVVRELLEENKEVLRKTEEAVKRSTETNKRLLEASKEVADRLRERIKEAAK

SEQ ID NO: 26844 - protein, 58 aa, Artificial Sequence; identical to SEQ ID NO: 26789
  Synthetic

SEQ ID NO: 26845 - protein, 58 aa, Artificial Sequence; identical to SEQ ID NO: 26799
  Synthetic

SEQ ID NO: 26846 - protein, 55 aa, Artificial Sequence
  Synthetic
DEVVERAERISEENKRRVEDVARKSKELVEDVRRHSEEVVRRVEELVKEVEERVR

SEQ ID NO: 26847 - protein, 58 aa, Artificial Sequence; identical to SEQ ID NO: 26824
  Synthetic

SEQ ID NO: 26848 - protein, 57 aa, Artificial Sequence
  Synthetic
TAERARETLKRLLDENRDRSKKVKEEIRRILEDLTRTTERVKREIAKLLKELEDTAR

SEQ ID NO: 26849 - protein, 58 aa, Artificial Sequence; identical to SEQ ID NO: 25262
  Synthetic

SEQ ID NO: 26850 - protein, 57 aa, Artificial Sequence; identical to SEQ ID NO: 26774
  Synthetic

SEQ ID NO: 26851 - protein, 57 aa, Artificial Sequence; identical to SEQ ID NO: 26761
  Synthetic

SEQ ID NO: 26852 - protein, 58 aa, Artificial Sequence
  Synthetic
DKARKVAEVAEKVLRDIDKLDRESKEAFRATNEEIAKLDEDTARVAERVKKAIEDLAK

SEQ ID NO: 26853 - protein, 58 aa, Artificial Sequence; identical to SEQ ID NO: 26789
  Synthetic

SEQ ID NO: 26854 - protein, 58 aa, Artificial Sequence; identical to SEQ ID NO: 26799
  Synthetic

SEQ ID NO: 26855 - protein, 58 aa, Artificial Sequence
  Synthetic
DKVERVVREVEKLHEEDRKRLEESTRSVRKLLEELKRELEKSTRSVKALVDELRERVR

SEQ ID NO: 26856 - protein, 55 aa, Artificial Sequence; identical to SEQ ID NO: 26846
  Synthetic

SEQ ID NO: 26857 - protein, 58 aa, Artificial Sequence; identical to SEQ ID NO: 26824
  Synthetic

SEQ ID NO: 26858 - protein, 57 aa, Artificial Sequence; identical to SEQ ID NO: 26848
  Synthetic

SEQ ID NO: 26859 - protein, 57 aa, Artificial Sequence; identical to SEQ ID NO: 26774
  Synthetic

SEQ ID NO: 26860 - protein, 57 aa, Artificial Sequence; identical to SEQ ID NO: 26774
  Synthetic

SEQ ID NO: 26861 - protein, 57 aa, Artificial Sequence; identical to SEQ ID NO: 26829
  Synthetic

SEQ ID NO: 26862 - protein, 58 aa, Artificial Sequence; identical to SEQ ID NO: 26852
  Synthetic

SEQ ID NO: 26863 - protein, 58 aa, Artificial Sequence; identical to SEQ ID NO: 26799
  Synthetic

SEQ ID NO: 26864 - protein, 55 aa, Artificial Sequence; identical to SEQ ID NO: 26800
  Synthetic

SEQ ID NO: 26865 - protein, 58 aa, Artificial Sequence; identical to SEQ ID NO: 26855
  Synthetic

SEQ ID NO: 26866 - protein, 57 aa, Artificial Sequence; identical to SEQ ID NO: 26802
  Synthetic

SEQ ID NO: 26867 - protein, 58 aa, Artificial Sequence; identical to SEQ ID NO: 26824
  Synthetic

SEQ ID NO: 26868 - protein, 55 aa, Artificial Sequence; identical to SEQ ID NO: 26768
  Synthetic

SEQ ID NO: 26869 - protein, 57 aa, Artificial Sequence; identical to SEQ ID NO: 26848
  Synthetic

SEQ ID NO: 26870 - protein, 55 aa, Artificial Sequence; identical to SEQ ID NO: 26839
  Synthetic

SEQ ID NO: 26871 - protein, 55 aa, Artificial Sequence
  Synthetic
DRIEEELKRLIDTLREKNREVEKRARDSNRDLKRTNDEIAKEVRELIKKLREDLK

SEQ ID NO: 26872 - protein, 57 aa, Artificial Sequence; identical to SEQ ID NO: 26774
  Synthetic

SEQ ID NO: 26873 - protein, 57 aa, Artificial Sequence; identical to SEQ ID NO: 26843
  Synthetic

SEQ ID NO: 26874 - protein, 58 aa, Artificial Sequence; identical to SEQ ID NO: 26852
  Synthetic

SEQ ID NO: 26875 - protein, 58 aa, Artificial Sequence; identical to SEQ ID NO: 26855
  Synthetic

SEQ ID NO: 26876 - protein, 57 aa, Artificial Sequence
  Synthetic
DIERILRELEAVLKKLTDESERLNREVERVSRDTKKKSKELNEELKAVLDEVKRKAD

SEQ ID NO: 26877 - protein, 55 aa, Artificial Sequence; identical to SEQ ID NO: 26846
  Synthetic

SEQ ID NO: 26878 - protein, 58 aa, Artificial Sequence; identical to SEQ ID NO: 26824
  Synthetic

SEQ ID NO: 26879 - protein, 57 aa, Artificial Sequence; identical to SEQ ID NO: 26848
  Synthetic

SEQ ID NO: 26880 - protein, 55 aa, Artificial Sequence; identical to SEQ ID NO: 26839
  Synthetic

SEQ ID NO: 26881 - protein, 56 aa, Artificial Sequence; identical to SEQ ID NO: 26781
  Synthetic

SEQ ID NO: 26882 - protein, 57 aa, Artificial Sequence; identical to SEQ ID NO: 26829
  Synthetic

SEQ ID NO: 26883 - protein, 57 aa, Artificial Sequence; identical to SEQ ID NO: 26843
  Synthetic

SEQ ID NO: 26884 - protein, 58 aa, Artificial Sequence; identical to SEQ ID NO: 26852
  Synthetic

SEQ ID NO: 26885 - protein, 58 aa, Artificial Sequence; identical to SEQ ID NO: 26799
  Synthetic

SEQ ID NO: 26886 - protein, 58 aa, Artificial Sequence; identical to SEQ ID NO: 26855
  Synthetic

SEQ ID NO: 26887 - protein, 58 aa, Artificial Sequence; identical to SEQ ID NO: 26824
  Synthetic

SEQ ID NO: 26888 - protein, 57 aa, Artificial Sequence; identical to SEQ ID NO: 26848
  Synthetic

SEQ ID NO: 26889 - protein, 55 aa, Artificial Sequence; identical to SEQ ID NO: 26839
  Synthetic

SEQ ID NO: 26890 - protein, 58 aa, Artificial Sequence; identical to SEQ ID NO: 26852
  Synthetic

SEQ ID NO: 26891 - protein, 58 aa, Artificial Sequence
  Synthetic
DEVTKVKKVADDVLAEIKKLDDETRRVIEDTNKKIADLDKATRDVVRKVLEEVKKLEK

SEQ ID NO: 26892 - protein, 57 aa, Artificial Sequence; identical to SEQ ID NO: 26802
  Synthetic

SEQ ID NO: 26893 - protein, 57 aa, Artificial Sequence; identical to SEQ ID NO: 26848
  Synthetic

SEQ ID NO: 26894 - protein, 55 aa, Artificial Sequence; identical to SEQ ID NO: 26839
  Synthetic

SEQ ID NO: 26895 - protein, 58 aa, Artificial Sequence
  Synthetic
RLVREVEDLVRRLVRRSEKSNEEVKRTVEELVRRMEESNDRVRDLVRRLVEELKRAVD

SEQ ID NO: 26896 - protein, 58 aa, Artificial Sequence; identical to SEQ ID NO: 26852
  Synthetic

SEQ ID NO: 26897 - protein, 58 aa, Artificial Sequence; identical to SEQ ID NO: 26824
  Synthetic

SEQ ID NO: 26898 - protein, 58 aa, Artificial Sequence; identical to SEQ ID NO: 26895
  Synthetic

SEQ ID NO: 26899 - protein, 58 aa, Artificial Sequence; identical to SEQ ID NO: 26852
  Synthetic

SEQ ID NO: 26900 - protein, 58 aa, Artificial Sequence; identical to SEQ ID NO: 26891
  Synthetic

SEQ ID NO: 26901 - protein, 57 aa, Artificial Sequence; identical to SEQ ID NO: 26848
  Synthetic

SEQ ID NO: 26902 - protein, 57 aa, Artificial Sequence; identical to SEQ ID NO: 26829
  Synthetic

SEQ ID NO: 26903 - protein, 58 aa, Artificial Sequence; identical to SEQ ID NO: 26852
  Synthetic

SEQ ID NO: 26904 - protein, 58 aa, Artificial Sequence; identical to SEQ ID NO: 26891
  Synthetic

SEQ ID NO: 26905 - protein, 58 aa, Artificial Sequence; identical to SEQ ID NO: 26855
  Synthetic

SEQ ID NO: 26906 - protein, 58 aa, Artificial Sequence; identical to SEQ ID NO: 26824
  Synthetic

SEQ ID NO: 26907 - protein, 57 aa, Artificial Sequence; identical to SEQ ID NO: 26848
  Synthetic

SEQ ID NO: 26908 - protein, 57 aa, Artificial Sequence; identical to SEQ ID NO: 26848
  Synthetic

SEQ ID NO: 26909 - protein, 58 aa, Artificial Sequence; identical to SEQ ID NO: 26852
  Synthetic

SEQ ID NO: 26910 - protein, 58 aa, Artificial Sequence; identical to SEQ ID NO: 26891
  Synthetic

SEQ ID NO: 26911 - protein, 58 aa, Artificial Sequence; identical to SEQ ID NO: 26855
  Synthetic

SEQ ID NO: 26912 - protein, 57 aa, Artificial Sequence; identical to SEQ ID NO: 26848
  Synthetic

SEQ ID NO: 26913 - protein, 58 aa, Artificial Sequence; identical to SEQ ID NO: 26852
  Synthetic

SEQ ID NO: 26914 - protein, 58 aa, Artificial Sequence; identical to SEQ ID NO: 26895
  Synthetic

SEQ ID NO: 26915 - protein, 58 aa, Artificial Sequence
  Synthetic
SESDEVIRDLARLLDELARHVDDSVRRMDEVVKRSTREADELAKRLDELVKEVEKKPG

SEQ ID NO: 26916 - protein, 58 aa, Artificial Sequence
  Synthetic
SRAETVLKEVTDKIKKLADSSDELLRRNKENIDELKKSSEELLRRLTKAIEEIEKGSV

SEQ ID NO: 26917 - protein, 58 aa, Artificial Sequence
  Synthetic
SVDEVLKEIEDALRRLKEEVERVLKENEDELRRLEEEVRRVLKEDEELLESLKRGVGE

SEQ ID NO: 26918 - protein, 58 aa, Artificial Sequence
  Synthetic
SEVDEIIKELERLLAEIARENERIIRESRKLADEVRKRNEDAIRKLEELVARLADAVR

SEQ ID NO: 26919 - protein, 58 aa, Artificial Sequence
  Synthetic
SEVDDVLRRLEELIKTLEDINAKSLEDIKKLIDDLAKILEDALRKHEKLIRELREAKK

SEQ ID NO: 26920 - protein, 58 aa, Artificial Sequence; identical to SEQ ID NO: 26919
  Synthetic

SEQ ID NO: 26921 - protein, 58 aa, Artificial Sequence; identical to SEQ ID NO: 26916
  Synthetic

SEQ ID NO: 26922 - protein, 58 aa, Artificial Sequence
  Synthetic
KEVEDAVKELEDLLRANEDKTRSIVEDMRASNKDLEDHSRASEEEVRKLLDDLRRAGV

SEQ ID NO: 26923 - protein, 58 aa, Artificial Sequence; identical to SEQ ID NO: 26919
  Synthetic

SEQ ID NO: 26924 - protein, 58 aa, Artificial Sequence; identical to SEQ ID NO: 26915
  Synthetic

SEQ ID NO: 26925 - protein, 58 aa, Artificial Sequence
  Synthetic
SESDDVIRKLRELLEELRTHVEKSIRDLRKILEDSTRHAKRSIEELERLLEEVRKKPG

SEQ ID NO: 26926 - protein, 58 aa, Artificial Sequence; identical to SEQ ID NO: 26916
  Synthetic

SEQ ID NO: 26927 - protein, 58 aa, Artificial Sequence
  Synthetic
SEAEKAKETIDRLADRVRKLLEEIKRSLDDSRRKSKETVEENEKTLDRMRKEVDAAKR

SEQ ID NO: 26928 - protein, 58 aa, Artificial Sequence; identical to SEQ ID NO: 26927
  Synthetic

SEQ ID NO: 26929 - protein, 58 aa, Artificial Sequence
  Synthetic
SEVEELIKRLAKVLKELVDKVRKVIEDTKELLERLKRRSEDHIRKLREVLKEAKDQPI

SEQ ID NO: 26930 - protein, 58 aa, Artificial Sequence
  Synthetic
SELEEIEKKVRELTKRHRELVERVRKTVKELIETNRRLLETLTERIKRVLEEVRDLER

SEQ ID NO: 26931 - protein, 58 aa, Artificial Sequence
  Synthetic
SSEERLRAVIEDLKRLAEESRKRHKELIDELAKAVERIERRHKKLLDEIKAVVDDIRR

SEQ ID NO: 26932 - protein, 58 aa, Artificial Sequence
  Synthetic
DEIRKVVKEITDLLKASNDKNRKVVEEIRDLLRKSKKLADELVERLRALVEDLRRRID

SEQ ID NO: 26933 - protein, 58 aa, Artificial Sequence
  Synthetic
STAETVAEEVERVLKHSDDLIKEVEDVNRRVEEEIKRVIRELEEENERLVAEVRKGVK

SEQ ID NO: 26934 - protein, 58 aa, Artificial Sequence; identical to SEQ ID NO: 26918
  Synthetic

SEQ ID NO: 26935 - protein, 58 aa, Artificial Sequence
  Synthetic
SEIDEVLTRLRKISKDLNETSDRVNERARKIIDDIKKESKRVNDEAREIVERLKREID

SEQ ID NO: 26936 - protein, 58 aa, Artificial Sequence
  Synthetic
SEDEDLDRVAEKLAREHKKSVEEIKRVLKSADEESKKLVRDTERVIEEIKREVEEARR

SEQ ID NO: 26937 - protein, 58 aa, Artificial Sequence
  Synthetic
SSVEELLERLRRISEENKRRIEKLLREVEKVLRELKDRHRKLLKRVEEIIRKVKEEIK

SEQ ID NO: 26938 - protein, 58 aa, Artificial Sequence; identical to SEQ ID NO: 25117
  Synthetic

SEQ ID NO: 26939 - protein, 58 aa, Artificial Sequence; identical to SEQ ID NO: 26915
  Synthetic

SEQ ID NO: 26940 - protein, 58 aa, Artificial Sequence; identical to SEQ ID NO: 26922
  Synthetic

SEQ ID NO: 26941 - protein, 58 aa, Artificial Sequence; identical to SEQ ID NO: 26932
  Synthetic

SEQ ID NO: 26942 - protein, 58 aa, Artificial Sequence
  Synthetic
SRVEEIIEDLRRLLEEIRKENEDSIRRSKELLDRVKEINDTIIAELERLLKDIEKEVR

SEQ ID NO: 26943 - protein, 58 aa, Artificial Sequence; identical to SEQ ID NO: 26942
  Synthetic

SEQ ID NO: 26944 - protein, 58 aa, Artificial Sequence; identical to SEQ ID NO: 26919
  Synthetic

SEQ ID NO: 26945 - protein, 58 aa, Artificial Sequence
  Synthetic
SKLEEVEKAVRKVIEDSRRVNEEVNRRSEEVVRELEKVHREVNDASRRVVEKARRVLK

SEQ ID NO: 26946 - protein, 58 aa, Artificial Sequence; identical to SEQ ID NO: 26915
  Synthetic

SEQ ID NO: 26947 - protein, 58 aa, Artificial Sequence; identical to SEQ ID NO: 26915
  Synthetic

SEQ ID NO: 26948 - protein, 58 aa, Artificial Sequence; identical to SEQ ID NO: 26925
  Synthetic

SEQ ID NO: 26949 - protein, 58 aa, Artificial Sequence
  Synthetic
DEVRELLERNRRLLEEIKKTVKDLIRANEELLKRIEDDAKRLIDRNEELLDELEKGLS

SEQ ID NO: 26950 - protein, 58 aa, Artificial Sequence; identical to SEQ ID NO: 26932
  Synthetic

SEQ ID NO: 26951 - protein, 58 aa, Artificial Sequence; identical to SEQ ID NO: 26916
  Synthetic

SEQ ID NO: 26952 - protein, 58 aa, Artificial Sequence
  Synthetic
DEEEDLERAIKKLLDENRELLKRIAEELRRLLEELRRLTEESADRLRRLLKELKDRGV

SEQ ID NO: 26953 - protein, 58 aa, Artificial Sequence; identical to SEQ ID NO: 26932
  Synthetic

SEQ ID NO: 26954 - protein, 58 aa, Artificial Sequence
  Synthetic
SKEDRLREELKKLLARLAEEIERLKRALEESNKDLKRTIDASEKHLRDVNEDVKRGGV

SEQ ID NO: 26955 - protein, 58 aa, Artificial Sequence; identical to SEQ ID NO: 26915
  Synthetic

SEQ ID NO: 26956 - protein, 58 aa, Artificial Sequence; identical to SEQ ID NO: 26915
  Synthetic

SEQ ID NO: 26957 - protein, 58 aa, Artificial Sequence; identical to SEQ ID NO: 26925
  Synthetic

SEQ ID NO: 26958 - protein, 58 aa, Artificial Sequence; identical to SEQ ID NO: 26942
  Synthetic

SEQ ID NO: 26959 - protein, 58 aa, Artificial Sequence; identical to SEQ ID NO: 26918
  Synthetic

SEQ ID NO: 26960 - protein, 58 aa, Artificial Sequence; identical to SEQ ID NO: 26937
  Synthetic

SEQ ID NO: 26961 - protein, 58 aa, Artificial Sequence; identical to SEQ ID NO: 25261
  Synthetic

SEQ ID NO: 26962 - protein, 58 aa, Artificial Sequence; identical to SEQ ID NO: 26915
  Synthetic

SEQ ID NO: 26963 - protein, 58 aa, Artificial Sequence; identical to SEQ ID NO: 26925
  Synthetic

SEQ ID NO: 26964 - protein, 58 aa, Artificial Sequence; identical to SEQ ID NO: 26916
  Synthetic

SEQ ID NO: 26965 - protein, 58 aa, Artificial Sequence; identical to SEQ ID NO: 26949
  Synthetic

SEQ ID NO: 26966 - protein, 58 aa, Artificial Sequence
  Synthetic
STEEVLDEIRKLHKTLTEDIKRVLREIEELHRRTIEENKEVLDKIAEDYKRVIDDVRT

SEQ ID NO: 26967 - protein, 58 aa, Artificial Sequence
  Synthetic
SEIEKILKEIEDLARRDEEVSKKIVEDIRRLAKEVEDTSRDIVRKIEELAKRVLDRLR

SEQ ID NO: 26968 - protein, 58 aa, Artificial Sequence
  Synthetic
SEAERLEARARELLRANEELMDDLRAKAEELLKRNDRLVKEIEKKVREVLAAIEELKR

SEQ ID NO: 26969 - protein, 58 aa, Artificial Sequence
  Synthetic
DDLERAREEVADLIRKHEEKTRRILEESRRLNERHRELSARILDEIRKLAERIEELIK

SEQ ID NO: 26970 - protein, 58 aa, Artificial Sequence; identical to SEQ ID NO: 26952
  Synthetic

SEQ ID NO: 26971 - protein, 58 aa, Artificial Sequence; identical to SEQ ID NO: 26932
  Synthetic

SEQ ID NO: 26972 - protein, 58 aa, Artificial Sequence; identical to SEQ ID NO: 26932
  Synthetic

SEQ ID NO: 26973 - protein, 58 aa, Artificial Sequence
  Synthetic
STAETVEKKVEEVIRENEKSMRESEEKVDRSTKRIEDVLRRLEETIRKTSDDIAKGVK

SEQ ID NO: 26974 - protein, 58 aa, Artificial Sequence; identical to SEQ ID NO: 26942
  Synthetic

SEQ ID NO: 26975 - protein, 58 aa, Artificial Sequence; identical to SEQ ID NO: 26942
  Synthetic

SEQ ID NO: 26976 - protein, 58 aa, Artificial Sequence
  Synthetic
REVEEMIKELEELLKDLKEKNERASKRNRELVRRLEEENKRVIEELKKLVKELEDLVR

SEQ ID NO: 26977 - protein, 58 aa, Artificial Sequence; identical to SEQ ID NO: 26919
  Synthetic

SEQ ID NO: 26978 - protein, 58 aa, Artificial Sequence; identical to SEQ ID NO: 26945
  Synthetic

SEQ ID NO: 26979 - protein, 58 aa, Artificial Sequence
  Synthetic
DEVEDVLRKIEKILDDHRKRIEKNSRDMARIIDEHRRKVEENSREMKKLVDDLKKAVD

SEQ ID NO: 26980 - protein, 58 aa, Artificial Sequence; identical to SEQ ID NO: 26937
  Synthetic

SEQ ID NO: 26981 - protein, 58 aa, Artificial Sequence
  Synthetic
DEVEKVLEEIKRALDDLRKKVEESKREIKEALKAVEKHTRDSDTANKRTLAEIERGVK

SEQ ID NO: 26982 - protein, 58 aa, Artificial Sequence; identical to SEQ ID NO: 26915
  Synthetic

SEQ ID NO: 26983 - protein, 58 aa, Artificial Sequence; identical to SEQ ID NO: 26922
  Synthetic

SEQ ID NO: 26984 - protein, 58 aa, Artificial Sequence; identical to SEQ ID NO: 26932
  Synthetic

SEQ ID NO: 26985 - protein, 58 aa, Artificial Sequence; identical to SEQ ID NO: 26933
  Synthetic

SEQ ID NO: 26986 - protein, 58 aa, Artificial Sequence; identical to SEQ ID NO: 26942
  Synthetic

SEQ ID NO: 26987 - protein, 58 aa, Artificial Sequence; identical to SEQ ID NO: 26918
  Synthetic

SEQ ID NO: 26988 - protein, 58 aa, Artificial Sequence; identical to SEQ ID NO: 26919
  Synthetic

SEQ ID NO: 26989 - protein, 58 aa, Artificial Sequence; identical to SEQ ID NO: 26945
  Synthetic

SEQ ID NO: 26990 - protein, 58 aa, Artificial Sequence
  Synthetic
SAEEVKEELKRIATKLKEEIKENIRRLEESVEKIAKELAENIKRLEDILRDVKRGLRD

SEQ ID NO: 26991 - protein, 58 aa, Artificial Sequence
  Synthetic
SDVDRVLEEIRKLLEDLKRHSEKVSEENEDLLRANTELNKRVSEDNERLLEELKRLRE

SEQ ID NO: 26992 - protein, 58 aa, Artificial Sequence; identical to SEQ ID NO: 26979
  Synthetic

SEQ ID NO: 26993 - protein, 58 aa, Artificial Sequence; identical to SEQ ID NO: 26937
  Synthetic

SEQ ID NO: 26994 - protein, 58 aa, Artificial Sequence
  Synthetic
DREREVKKRLDEVRERIERLLRRVEEESRRVAEEIRRLIEEVRRRNKKVTEEIRELLK

SEQ ID NO: 26995 - protein, 58 aa, Artificial Sequence; identical to SEQ ID NO: 26916
  Synthetic

SEQ ID NO: 26996 - protein, 58 aa, Artificial Sequence; identical to SEQ ID NO: 26967
  Synthetic

SEQ ID NO: 26997 - protein, 58 aa, Artificial Sequence; identical to SEQ ID NO: 26927
  Synthetic

SEQ ID NO: 26998 - protein, 58 aa, Artificial Sequence; identical to SEQ ID NO: 26929
  Synthetic

SEQ ID NO: 26999 - protein, 58 aa, Artificial Sequence; identical to SEQ ID NO: 26932
  Synthetic

SEQ ID NO: 27000 - protein, 58 aa, Artificial Sequence; identical to SEQ ID NO: 26932
  Synthetic

SEQ ID NO: 27001 - protein, 58 aa, Artificial Sequence; identical to SEQ ID NO: 26973
  Synthetic

SEQ ID NO: 27002 - protein, 58 aa, Artificial Sequence; identical to SEQ ID NO: 26942
  Synthetic

SEQ ID NO: 27003 - protein, 58 aa, Artificial Sequence; identical to SEQ ID NO: 26976
  Synthetic

SEQ ID NO: 27004 - protein, 58 aa, Artificial Sequence
  Synthetic
DAVEEAEKLIRKVIADSEKLLRDLADLNAKSIRRSEKLVEDDRRANEDVIRKLEELRR

SEQ ID NO: 27005 - protein, 58 aa, Artificial Sequence; identical to SEQ ID NO: 26919
  Synthetic

SEQ ID NO: 27006 - protein, 58 aa, Artificial Sequence
  Synthetic
SEIERVKKRLEELLAEVEESTRRLEERLKRLLEEAKRSSEEVEKELRRLLEAVRRGLS

SEQ ID NO: 27007 - protein, 58 aa, Artificial Sequence; identical to SEQ ID NO: 26991
  Synthetic

SEQ ID NO: 27008 - protein, 58 aa, Artificial Sequence; identical to SEQ ID NO: 26979
  Synthetic

SEQ ID NO: 27009 - protein, 58 aa, Artificial Sequence; identical to SEQ ID NO: 26915
  Synthetic

SEQ ID NO: 27010 - protein, 58 aa, Artificial Sequence; identical to SEQ ID NO: 26916
  Synthetic

SEQ ID NO: 27011 - protein, 58 aa, Artificial Sequence; identical to SEQ ID NO: 26952
  Synthetic

SEQ ID NO: 27012 - protein, 58 aa, Artificial Sequence; identical to SEQ ID NO: 26932
  Synthetic

SEQ ID NO: 27013 - protein, 58 aa, Artificial Sequence; identical to SEQ ID NO: 27004
  Synthetic

SEQ ID NO: 27014 - protein, 58 aa, Artificial Sequence; identical to SEQ ID NO: 26936
  Synthetic

SEQ ID NO: 27015 - protein, 58 aa, Artificial Sequence; identical to SEQ ID NO: 26954
  Synthetic

SEQ ID NO: 27016 - protein, 36 aa, Artificial Sequence
  Synthetic
DEARKAIARVKRESKRIVEDAERLIREAAAASEKIS

SEQ ID NO: 27017 - protein, 40 aa, Artificial Sequence
  Synthetic
  MISC_FEATURE (40)..(40): C-terminal biotin
DEARKAIARVKRESKRIVEDAERLIREAAAASEKISGSGK

SEQ ID NO: 27018 - protein, 447 aa, Artificial Sequence
  Synthetic
  MISC_FEATURE (1)..(3): optional
  MISC_FEATURE (43)..(447): optional
  MISC_FEATURE (434)..(434): optional residue for biotinylation of MBP_key
MDPDEARKAIARVKRESKRIVEDAERLIREAAAASEKISREASSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSGSGLNDIFEAQKIEWHELEHHHHHH

SEQ ID NO: 27019 - protein, 455 aa, Artificial Sequence
  Synthetic
  MISC_FEATURE (1)..(3): optional
  MISC_FEATURE (51)..(455): optional
  MISC_FEATURE (442)..(442): optional residue for biotinylation of MBP_key
MDPDEARKAIARVKRESKRIVEDAERLIREAAAASEKISREAERLIREAASSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSGSGLNDIFEAQKIEWHELEHHHHHH

SEQ ID NO: 27020 - protein, 464 aa, Artificial Sequence
  Synthetic
  MISC_FEATURE (1)..(3): optional
  MISC_FEATURE (60)..(464): optional
  MISC_FEATURE (451)..(451): optional residue for biotinylation of MBP_key
MDPDEARKAIARVKRESKRIVEDAERLIREAAAASEKISREAERLIREAAAASEKISRESSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSGSGLNDIFEAQKIEWHELEHHHHHH

SEQ ID NO: 27021 - protein, 456 aa, Artificial Sequence
  Synthetic
  MISC_FEATURE (1)..(400)
  MISC_FEATURE (439)..(456)
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKISREAERLIREAAAASEKISRE

SEQ ID NO: 27022 - protein, 445 aa, Artificial Sequence
  Synthetic
  MISC_FEATURE (1)..(1): optional
  MISC_FEATURE (58)..(445): optional
MNKEEIEKLAKEAREKLKKAEKEHKEIHDKLRKKNKKAREDLKKKADELRETNKRVNGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 27023 - protein, 445 aa, Artificial Sequence
  Synthetic
  MISC_FEATURE (1)..(1): optional
  MISC_FEATURE (58)..(445): optional
MSSEKVRRELKESLKENHKQNQKLLKDHKRAQEKLNRELEELKKKHKKTLDDIRRESGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 27024 - protein, 445 aa, Artificial Sequence
  Synthetic
  MISC_FEATURE (1)..(1): optional
  MISC_FEATURE (58)..(445): optional
MDTVKRILEELRRRFEKLAKDLDDIARKLLEDHKKHNKELKDKQRKIKKEADDAARSGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 27025 - protein, 445 aa, Artificial Sequence
  Synthetic
  MISC_FEATURE (1)..(1): optional
  MISC_FEATURE (58)..(445): optional
MDDVERRLRKANKESKKEAEELTEEAKKANEKTKEDSKELTKENRKTNKTIKDEARSGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 27026 - protein, 445 aa, Artificial Sequence
  Synthetic
  MISC_FEATURE (1)..(1): optional
  MISC_FEATURE (58)..(445): optional
MDDEERRSEKTVQDAKREIKKVEDDLQRLNEEQKKKVKKQEDENQKTLKKHKDDARSGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 27027 - protein, 456 aa, Artificial Sequence
  Synthetic
  MISC_FEATURE (1)..(400): optional
  misc_feature (443)..(443): Xaa can be any naturally occurring amino acid
  misc_feature (453)..(453): Xaa can be any naturally occurring amino acid
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKISREAERLXREAAAASEKXSRE

SEQ ID NO: 27028 - protein, 444 aa, Artificial Sequence
  Synthetic
  MISC_FEATURE (1)..(400): optional
  misc_feature (435)..(435): Xaa can be any naturally occurring amino acid
  misc_feature (443)..(443): Xaa can be any naturally occurring amino acid
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKXSREAERLXR

SEQ ID NO: 27029 - protein, 456 aa, Artificial Sequence
  Synthetic
  MISC_FEATURE (1)..(400): optional
  misc_feature (443)..(443): Xaa can be any naturally occurring amino acid
  misc_feature (453)..(453): Xaa can be any naturally occurring amino acid
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAQASEKISREARELXERAAQASEKXSRE

SEQ ID NO: 27030 - protein, 444 aa, Artificial Sequence
  Synthetic
  MISC_FEATURE (1)..(400): optional
  misc_feature (435)..(435): Xaa can be any naturally occurring amino acid
  misc_feature (443)..(443): Xaa can be any naturally occurring amino acid
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAQASEKXSREAERLXR

SEQ ID NO: 27031 - protein, 80 aa, Artificial Sequence
  Synthetic
  MISC_FEATURE (1)..(24): optional
MGSHHHHHHGSGSENLYFQGSGGSDEARKAIARVKRESKRIVEDAEGLISEAAAASEKISREAERLIREAAAASEKISRE

SEQ ID NO: 27032 - protein, 80 aa, Artificial Sequence
  Synthetic
  MISC_FEATURE (1)..(24): optional
MGSHHHHHHGSGSENLYFQGSGGSDEARKAIARVKRESKRIVEDAERLIREAAGSSEKISREAERLIREAAAASEKISRE

SEQ ID NO: 27033 - protein, 80 aa, Artificial Sequence
  Synthetic
  MISC_FEATURE (1)..(24): optional
MGSHHHHHHGSGSENLYFQGSGGSDEARKAIARVKRESKRIVEDAERLIGEAAAASEKISREAERLIREAAAASEKISRE

SEQ ID NO: 27034 - protein, 68 aa, Artificial Sequence
  Synthetic
  MISC_FEATURE (1)..(24): optional
MGSHHHHHHGSGSENLYFQGSGGSDEARKAIARVKRESKRIVGDAERLIREAAAASEKISREAERLIR

SEQ ID NO: 27035 - protein, 68 aa, Artificial Sequence
  Synthetic
  MISC_FEATURE (1)..(24): optional
MGSHHHHHHGSGSENLYFQGSGGSDEARKAIARVKRESKRIVEDAEGLISEAAAASEKISREAERLIR

SEQ ID NO: 27036 - protein, 68 aa, Artificial Sequence
  Synthetic
  MISC_FEATURE (1)..(24): optional
MGSHHHHHHGSGSENLYFQGSGGSDEARKAIARVAEESKRIVEDAERLIREAAAASEKISREAERLIR

SEQ ID NO: 27037 - protein, 68 aa, Artificial Sequence
  Synthetic
  MISC_FEATURE (1)..(24): optional
MGSHHHHHHGSGSENLYFQGSGGSDEAAKAIARVAEESKRIVEDAERLIREAAAASEKISREAERLIR

SEQ ID NO: 27038 - protein, 68 aa, Artificial Sequence
  Synthetic
  MISC_FEATURE (1)..(24): optional
MGSHHHHHHGSGSENLYFQGSGGSDEARKAIARVKRESKRIVEDAERLIREAAEASEEISREAERLIR

SEQ ID NO: 27039 - protein, 492 aa, Artificial Sequence
  Synthetic
  MISC_FEATURE (1)..(404): optional
  misc_feature (447)..(447): Xaa can be any naturally occurring amino acid
  misc_feature (457)..(457): Xaa can be any naturally occurring amino acid
  MISC_FEATURE (461)..(479): optional
MGSHHHHHHGSGSENLYFQGSGGSMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKISREAERLXREAAAASEKXSREGGGSGSGSGSGKPGQASGSAHIVMVDAYKPTK

SEQ ID NO: 27040 - protein, 480 aa, Artificial Sequence
  Synthetic
  MISC_FEATURE (1)..(404): optional
  misc_feature (439)..(439): Xaa can be any naturally occurring amino acid
  misc_feature (447)..(447): Xaa can be any naturally occurring amino acid
  MISC_FEATURE (449)..(467): optional
MGSHHHHHHGSGSENLYFQGSGGSMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKXSREAERLXRGGGSGSGSGSGKPGQASGSAHIVMVDAYKPTK

SEQ ID NO: 27041 - protein, 510 aa, Artificial Sequence
  Synthetic
  MISC_FEATURE (1)..(454): optional
MGSSHHHHHHSSGLVPRGSHMSKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKSGSGSGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYGGSGGSDEARKAIARVKRESKRIVEDAERLIREAAAASEKISREAERLIREAAAASEKISRE

SEQ ID NO: 27042 - protein, 394 aa, Artificial Sequence
  Synthetic
  MISC_FEATURE (1)..(22): optional
  MISC_FEATURE (79)..(394): optional
MGSHHHHHHGSGSENLYFQGSGDEARKAIARVKRESKRIVEDAERLIREAAAASEKISREAERLIREAAAASEKISREGSGGSGSGGGVLLNVLSKCAGSKKFRPAPAAAFARECRGFYFELQELKEDDYYGITLSDDSDHQFLLANQVVVHNCGSGGSVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 27043 - protein, 58 aa, Artificial Sequence
  Synthetic
DKVRKVAEVAEKVLRDIDKLDRESKEAFRRTNGEISKLDEDTRRVAERVKKAIEDLAK

SEQ ID NO: 27044 - protein, 54 aa, Artificial Sequence
  Synthetic
SEVDEIIADNERALDEVRREVEEIDKENAERLKEWVEEAREILDRLAKALEEIR

SEQ ID NO: 27045 - protein, 60 aa, Artificial Sequence
  Synthetic
PEEALSKAIKDVRDIVKKVKDELKEWRDRNKELVDRLSEELKEWLKDVERVLKELTDKDR

SEQ ID NO: 27046 - protein, 56 aa, Artificial Sequence; identical to SEQ ID NO: 26790
  Synthetic

SEQ ID NO: 27047 - protein, 59 aa, Artificial Sequence
  Synthetic
SRLVKKLDEIVKEVAKKLEDVVRANEELWRKLVELNKESVARLREAVERVARDLEETAR

SEQ ID NO: 27048 - protein, 54 aa, Artificial Sequence
  Synthetic
SDEERLEKVVKDVIEKVRRILEKWKKDIDKVVKELRRILEEWEKIIREVLDKVR

SEQ ID NO: 27049 - protein, 57 aa, Artificial Sequence
  Synthetic
DKDAVIKVIEKLIRANAAVWDALLKINEDLVRVNKTVWKELLRVNEKLARDLERVVK

SEQ ID NO: 27050 - protein, 55 aa, Artificial Sequence
  Synthetic
SLVDELRKSLERNVRVSEEVARRLKEALKRWVDVVRKVVEDLIRLNEDVVRVVEK

SEQ ID NO: 27051 - protein, 59 aa, Artificial Sequence; identical to SEQ ID NO: 27047
  Synthetic

SEQ ID NO: 27052 - protein, 16 aa, Artificial Sequence
  Synthetic
RDHMVLHEYVNAAGIT

SEQ ID NO: 27053 - protein, 6 aa, Artificial Sequence
  Synthetic
RLVGFE

SEQ ID NO: 27054 - protein, 13 aa, Artificial Sequence
  Synthetic
  MISC_FEATURE (11)..(13): optional
AHIVMVDAYKPTK

SEQ ID NO: 27055 - protein, 9 aa, Artificial Sequence
  Synthetic
AAAKRARTS

SEQ ID NO: 27056 - protein, 11 aa, Artificial Sequence
  Synthetic
LALKLAGLDIN

SEQ ID NO: 27057 - protein, 12 aa, Artificial Sequence
  Synthetic
ELAEKLAGLDIN

SEQ ID NO: 27058 - protein, 13 aa, Artificial Sequence
  Synthetic
ELAEKLRAGLDLN

SEQ ID NO: 27059 - protein, 27 aa, Artificial Sequence
  Synthetic
TMFSSNRQKILERTETLNQEWKQRRIQ

SEQ ID NO: 27060 - protein, 10 aa, Artificial Sequence
  Synthetic
ETFSDLWKLL

SEQ ID NO: 27061 - protein, 33 aa, Artificial Sequence
  Synthetic
GELDELVYLLDGPGYDPIHSDVVTRGGSHLFNF

SEQ ID NO: 27062 - protein, 12 aa, Artificial Sequence
  Synthetic
TMDDVYNYLFDD

SEQ ID NO: 27063 - protein, 13 aa, Artificial Sequence
  Synthetic
LLTGLFVQYLFDD

SEQ ID NO: 27064 - protein, 11 aa, Artificial Sequence
  Synthetic
DDAVVESFFSS

SEQ ID NO: 27065 - protein, 9 aa, Artificial Sequence
  Synthetic
GDFLSDLFD

SEQ ID NO: 27066 - protein, 9 aa, Artificial Sequence
  Synthetic
GDVLSDLVD

SEQ ID NO: 27067 - protein, 13 aa, Artificial Sequence
  Synthetic
NIQMLLEAADYLE

SEQ ID NO: 27068 - protein, 13 aa, Artificial Sequence
  Synthetic
NIAMLLAAAAYLE

SEQ ID NO: 27069 - protein, 4 aa, Artificial Sequence
  Synthetic
IQIG

SEQ ID NO: 27070 - protein, 4 aa, Artificial Sequence
  Synthetic
VQLG

SEQ ID NO: 27071 - protein, 11 aa, Artificial Sequence
  Synthetic
VSGWRLFKKIS

SEQ ID NO: 27072 - protein, 27 aa, Artificial Sequence
  Synthetic
GLEQEIAALEKENAALEWEIAALEQGG

SEQ ID NO: 27073 - protein, 27 aa, Artificial Sequence
  Synthetic
GLKQKIAALKYKNAALKKKIAALKQGG

SEQ ID NO: 27074 - protein, 33 aa, Artificial Sequence
  Synthetic
RMKQLEDKVEELLSKNYHLENEVARLKKLVGER

SEQ ID NO: 27075 - protein, 30 aa, Artificial Sequence
  Synthetic
GEIAALKQEIAALKKENAALKWEIAALKQG

SEQ ID NO: 27076 - protein, 30 aa, Artificial Sequence
  Synthetic
WEAALAEALAEALAEHLAEALAEALEALAA

SEQ ID NO: 27077 - protein, 13 aa, Artificial Sequence
  Synthetic
GLFDIIKKIAESF

SEQ ID NO: 27078 - protein, 23 aa, Artificial Sequence
  Synthetic
GIGKFLHSAGKFGKAFVGEIMKS

SEQ ID NO: 27079 - protein, 23 aa, Artificial Sequence
  Synthetic
GIGKFLHSAKKFGKAFVGEIMNS

SEQ ID NO: 27080 - protein, 26 aa, Artificial Sequence
  Synthetic
GIGAVLKVLTTGLPALISWIKRKRQQ

SEQ ID NO: 27081 - protein, 14 aa, Artificial Sequence
  Synthetic
INWKGIAAMAKKLL

SEQ ID NO: 27082 - protein, 37 aa, Artificial Sequence
  Synthetic
KWKLFKKIEKVGQNIRDGIIKAGPAVAVVGQATQIAK

SEQ ID NO: 27083 - protein, 31 aa, Artificial Sequence
  Synthetic
SWLSKTAKKLENSAKKRISEGIAIAIQGGPR

SEQ ID NO: 27084 - protein, 16 aa, Artificial Sequence
  Synthetic
GLFDVIKKVASVIGGL

SEQ ID NO: 27085 - protein, 14 aa, Artificial Sequence
  Synthetic
NFLGTLINLAKKIL

SEQ ID NO: 27086 - protein, 23 aa, Artificial Sequence
  Synthetic
SYFILRRRRKRFPYFFTDVRVAA

SEQ ID NO: 27087 - protein, 21 aa, Artificial Sequence
  Synthetic
AFSWGSLWSGIKNFGSTVKNY

SEQ ID NO: 27088 - protein, 21 aa, Artificial Sequence
  Synthetic
ASMWERVKSIIKSSLAAASNI

SEQ ID NO: 27089 - protein, 50 aa, Artificial Sequence
  Synthetic
VTSTITEKLLKNLIKIISSLVIITRNYEDTTTVLATLALLGCDASPWQWL

SEQ ID NO: 27090 - protein, 24 aa, Artificial Sequence
  Synthetic
IAQNPVENYIDEVLNEVLVVPNIN

SEQ ID NO: 27091 - protein, 20 aa, Artificial Sequence
  Synthetic
FLGIAEAIDIGNGWEGMEFG

SEQ ID NO: 27092 - protein, 20 aa, Artificial Sequence
  Synthetic
GLFGAIAGFIENGWEGMIDG

SEQ ID NO: 27093 - protein, 23 aa, Artificial Sequence
  Synthetic
GLFGAIAGFIENGWEGMIDGWYG

SEQ ID NO: 27094 - protein, 285 aa, Artificial Sequence; identical to SEQ ID NO: 67
  Synthetic

SEQ ID NO: 27095 - protein, 236 aa, Artificial Sequence
  Synthetic
MSLVDELEIWIAQELRRIGDEFNAYYAALKRWVDVVRKVVEDLIRLNEDVVRVVEKVGVDESAIERVRRIIEELNRALDAVLKKNEDLVRRLTELLDKLLEENRRLVEELDEDLKRRGGTEEVIDTILELIERSIERLKRLLDELLRIVREALKDNARVADENLKALKEILDELRKDGVSDEELKRVLEKAADLHARLKDAHRKLLEDLERIIRELKKKLDEVVEENKRSVDELKR

SEQ ID NO: 27096 - protein, 237 aa, Artificial Sequence; identical to SEQ ID NO: 90
  Synthetic

SEQ ID NO: 27097 - protein, 175 aa, Artificial Sequence; identical to SEQ ID NO: 91
  Synthetic

SEQ ID NO: 27098 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARAHIVMVDAYKKRIVEDAERLIREAAAASEKISREAERLIR

SEQ ID NO: 27099 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKAHIVMVDAYKREAAAASEKISREAERLIR

SEQ ID NO: 27100 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARENLYFQGSESKRIVEDAERLIREAAAASEKISREAERLIR

SEQ ID NO: 27101 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVENLYFQGSEAAAASEKISREAERLIR

SEQ ID NO: 27102 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARVSGWRLFKKISRIVEDAERLIREAAAASEKISREAERLIR

SEQ ID NO: 27103 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKVSGWRLFKKISEAAAASEKISREAERLIR

SEQ ID NO: 27104 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIIQIGRESKRIVEDAERLIREAAAASEKISVQLGRLIR

SEQ ID NO: 27105 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVIQIGRLIVQLGAASEKISREAERLIR

SEQ ID NO: 27106 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVIQIGRLIREAAAASEKISVQLGRLIR

SEQ ID NO: 27107 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDESVKELEDKVEELLSKNYHLENEVARLKKLVGERSREAERLIR

SEQ ID NO: 27108 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIAGEIAALKQEIAALKKENAALKWEIAALKQGAERLIR

SEQ ID NO: 27109 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRGLEQEIAALEKENAALEWEIAALEQGGERLIR

SEQ ID NO: 27110 - protein, 289 aa, Artificial Sequence
  Synthetic
MSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRGLKQKIAALKYKNAALKKKIAALKQGGERLIR

SEQ ID NO: 27111 - protein, 288 aa, Artificial Sequence
  Synthetic
SELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIENLYFQGSRIVEDAEAHIVMVDAYKEKISREAERLIR

SEQ ID NO: 27112 - protein, 288 aa, Artificial Sequence
  Synthetic
SELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVENLYFQGSEDAERLIREAAHIVMVDAYKAERLIR

SEQ ID NO: 27113 - protein, 288 aa, Artificial Sequence
  Synthetic
SELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKENLYFQGSDAERLIREAAHIVMVDAYKAERLIR

SEQ ID NO: 27114 - protein, 359 aa, Artificial Sequence
  Synthetic
SKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDPDEARKAIARVKENLYFQGSDAERLIREAAAASEAHIVMVDAYKREAAAASEKISRE

SEQ ID NO: 27115 - protein, 359 aa, Artificial Sequence
  Synthetic
SKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDPDEARKAIARVKENLYFQGSDAERLIREAAAASEKISREAEAHIVMVDAYKEKISRE

SEQ ID NO: 27116 - protein, 760 aa, Artificial Sequence
  Synthetic
VSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDEIWIAQELRRIGDEFNAYYADAERLIREAAAASEKISREAERLIRVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYKGSGC

SEQ ID NO: 27117 - protein, 750 aa, Artificial Sequence
  Synthetic
VSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESNAYYADAERLIREAAAASEKVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYKGSGC

SEQ ID NO: 27118 - protein, 75 aa, Artificial Sequence
  Synthetic
MDAKSLTAWSRTLVTFKDVFVDFTREEWKLLDTAQQIVYRNVMLENYKNLVSLGYQLTKPDVILRLEKGEEPWLV

SEQ ID NO: 27119 - protein, 45 aa, Artificial Sequence
  Synthetic
RTLVTFKDVFVDFTREEWKLLDTAQQIVYRNVMLENYKNLVSLGY

SEQ ID NO: 27120 - protein, 407 aa, Artificial Sequence
  Synthetic
MSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTGSRTLVTFKDVFVDFTREEWKLLDTAQQIVYRNVMLENYKNLVSLGYGSDEARKAIARVKRESKRIVEDAERLIREAAAASEKISREAERLIREAAAASEKISRE

SEQ ID NO: 27121 - protein, 394 aa, Artificial Sequence
  Synthetic
MSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTGSRTLVTFKDVFVDFTREEWKLLDTAQQIVYRNVMLENYKNLVSLGYGSSKRIVEDAERLIREAAAASEKISREAERLIREAAAASEKISRE

SEQ ID NO: 27122 - protein, 398 aa, Artificial Sequence
  Synthetic
MSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTGSRTLVTFKDVFVDFTREEWKLLDTAQQIVYRNVMLENYKNLVSLGYGSDEARKAIARVKRESKRIVEDAERLIREAAAASEKISREAERLIREAA

SEQ ID NO: 27123 - protein, 369 aa, Artificial Sequence
  Synthetic
MSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDEARKAIARVKRESKRIVEDAERTLVTFKDVFVDFTREEWKLLDTAQQIVYRNVMLENYKNLVSLGY

SEQ ID NO: 27124 - protein, 372 aa, Artificial Sequence
  Synthetic
MSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDEARKAIARVKRESKRIVEDAERLIRTLVTFKDVFVDFTREEWKLLDTAQQIVYRNVMLENYKNLVSLGY

SEQ ID NO: 27125 - protein, 383 aa, Artificial Sequence
  Synthetic
MSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDEARKAIARVKRESKRIVEDAERLIREAAAASEKISRTLVTFKDVFVDFTREEWKLLDTAQQIVYRNVMLENYKNLVSLGY

SEQ ID NO: 27126 - protein, 184 aa, Artificial Sequence; identical to SEQ ID NO: 6844
  Synthetic

SEQ ID NO: 27127 - protein, 59 aa, Artificial Sequence; identical to SEQ ID NO: 19128
  Synthetic

SEQ ID NO: 27128 - protein, 180 aa, Artificial Sequence; identical to SEQ ID NO: 12828
  Synthetic

SEQ ID NO: 27129 - protein, 59 aa, Artificial Sequence; identical to SEQ ID NO: 14436
  Synthetic

SEQ ID NO: 27130 - protein, 174 aa, Artificial Sequence; identical to SEQ ID NO: 12840
  Synthetic

SEQ ID NO: 27131 - protein, 56 aa, Artificial Sequence; identical to SEQ ID NO: 15502
  Synthetic

SEQ ID NO: 27132 - protein, 178 aa, Artificial Sequence; identical to SEQ ID NO: 12844
  Synthetic

SEQ ID NO: 27133 - protein, 55 aa, Artificial Sequence; identical to SEQ ID NO: 25128
  Synthetic

SEQ ID NO: 27134 - protein, 185 aa, Artificial Sequence; identical to SEQ ID NO: 12850
  Synthetic

SEQ ID NO: 27135 - protein, 59 aa, Artificial Sequence; identical to SEQ ID NO: 25134
  Synthetic

SEQ ID NO: 27136 - protein, 172 aa, Artificial Sequence; identical to SEQ ID NO: 12852
  Synthetic

SEQ ID NO: 27137 - protein, 56 aa, Artificial Sequence; identical to SEQ ID NO: 16914
  Synthetic

SEQ ID NO: 27138 - protein, 180 aa, Artificial Sequence; identical to SEQ ID NO: 12858
  Synthetic

SEQ ID NO: 27139 - protein, 56 aa, Artificial Sequence; identical to SEQ ID NO: 18130
  Synthetic

SEQ ID NO: 27140 - protein, 188 aa, Artificial Sequence; identical to SEQ ID NO: 554
  Synthetic

SEQ ID NO: 27141 - protein, 62 aa, Artificial Sequence; identical to SEQ ID NO: 25144
  Synthetic

SEQ ID NO: 27142 - protein, 188 aa, Artificial Sequence; identical to SEQ ID NO: 563
  Synthetic

SEQ ID NO: 27143 - protein, 62 aa, Artificial Sequence; identical to SEQ ID NO: 25144
  Synthetic

SEQ ID NO: 27144 - protein, 188 aa, Artificial Sequence; identical to SEQ ID NO: 595
  Synthetic

SEQ ID NO: 27145 - protein, 62 aa, Artificial Sequence; identical to SEQ ID NO: 25144
  Synthetic

SEQ ID NO: 27146 - protein, 176 aa, Artificial Sequence; identical to SEQ ID NO: 12874
  Synthetic

SEQ ID NO: 27147 - protein, 59 aa, Artificial Sequence; identical to SEQ ID NO: 25158
  Synthetic

SEQ ID NO: 27148 - protein, 184 aa, Artificial Sequence; identical to SEQ ID NO: 12894
  Synthetic

SEQ ID NO: 27149 - protein, 59 aa, Artificial Sequence; identical to SEQ ID NO: 25178
  Synthetic

SEQ ID NO: 27150 - protein, 176 aa, Artificial Sequence; identical to SEQ ID NO: 12902
  Synthetic

SEQ ID NO: 27151 - protein, 59 aa, Artificial Sequence; identical to SEQ ID NO: 25186
  Synthetic

SEQ ID NO: 27152 - protein, 182 aa, Artificial Sequence; identical to SEQ ID NO: 12906
  Synthetic

SEQ ID NO: 27153 - protein, 56 aa, Artificial Sequence; identical to SEQ ID NO: 25190
  Synthetic

SEQ ID NO: 27154 - protein, 186 aa, Artificial Sequence; identical to SEQ ID NO: 12908
  Synthetic

SEQ ID NO: 27155 - protein, 59 aa, Artificial Sequence; identical to SEQ ID NO: 25192
  Synthetic

SEQ ID NO: 27156 - protein, 175 aa, Artificial Sequence; identical to SEQ ID NO: 12924
  Synthetic

SEQ ID NO: 27157 - protein, 55 aa, Artificial Sequence; identical to SEQ ID NO: 25208
  Synthetic

SEQ ID NO: 27158 - protein, 180 aa, Artificial Sequence; identical to SEQ ID NO: 12962
  Synthetic

SEQ ID NO: 27159 - protein, 59 aa, Artificial Sequence; identical to SEQ ID NO: 25246
  Synthetic

SEQ ID NO: 27160 - protein, 177 aa, Artificial Sequence; identical to SEQ ID NO: 12970
  Synthetic

SEQ ID NO: 27161 - protein, 59 aa, Artificial Sequence; identical to SEQ ID NO: 24672
  Synthetic

SEQ ID NO: 27162 - protein, 184 aa, Artificial Sequence; identical to SEQ ID NO: 6844
  Synthetic

SEQ ID NO: 27163 - protein, 59 aa, Artificial Sequence; identical to SEQ ID NO: 19127
  Synthetic

SEQ ID NO: 27164 - protein, 178 aa, Artificial Sequence; identical to SEQ ID NO: 12844
  Synthetic

SEQ ID NO: 27165 - protein, 60 aa, Artificial Sequence; identical to SEQ ID NO: 25127
  Synthetic

SEQ ID NO: 27166 - protein, 185 aa, Artificial Sequence; identical to SEQ ID NO: 12850
  Synthetic

SEQ ID NO: 27167 - protein, 60 aa, Artificial Sequence; identical to SEQ ID NO: 25133
  Synthetic

SEQ ID NO: 27168 - protein, 172 aa, Artificial Sequence; identical to SEQ ID NO: 12852
  Synthetic

SEQ ID NO: 27169 - protein, 57 aa, Artificial Sequence; identical to SEQ ID NO: 25135
  Synthetic

SEQ ID NO: 27170 - protein, 180 aa, Artificial Sequence; identical to SEQ ID NO: 12858
  Synthetic

SEQ ID NO: 27171 - protein, 60 aa, Artificial Sequence; identical to SEQ ID NO: 25141
  Synthetic

SEQ ID NO: 27172 - protein, 188 aa, Artificial Sequence; identical to SEQ ID NO: 1740
  Synthetic

SEQ ID NO: 27173 - protein, 60 aa, Artificial Sequence; identical to SEQ ID NO: 19323
  Synthetic

SEQ ID NO: 27174 - protein, 188 aa, Artificial Sequence; identical to SEQ ID NO: 1911
  Synthetic

SEQ ID NO: 27175 - protein, 60 aa, Artificial Sequence; identical to SEQ ID NO: 19323
  Synthetic

SEQ ID NO: 27176 - protein, 186 aa, Artificial Sequence; identical to SEQ ID NO: 12908
  Synthetic

SEQ ID NO: 27177 - protein, 61 aa, Artificial Sequence; identical to SEQ ID NO: 25191
  Synthetic

SEQ ID NO: 27178 - protein, 247 aa, Artificial Sequence; identical to SEQ ID NO: 1129
  Synthetic

SEQ ID NO: 27179 - protein, 59 aa, Artificial Sequence; identical to SEQ ID NO: 25434
  Synthetic

SEQ ID NO: 27180 - protein, 235 aa, Artificial Sequence; identical to SEQ ID NO: 13508
  Synthetic

SEQ ID NO: 27181 - protein, 56 aa, Artificial Sequence; identical to SEQ ID NO: 25792
  Synthetic

SEQ ID NO: 27182 - protein, 238 aa, Artificial Sequence; identical to SEQ ID NO: 13970
  Synthetic

SEQ ID NO: 27183 - protein, 56 aa, Artificial Sequence; identical to SEQ ID NO: 25342
  Synthetic

SEQ ID NO: 27184 - protein, 239 aa, Artificial Sequence; identical to SEQ ID NO: 13982
  Synthetic

SEQ ID NO: 27185 - protein, 59 aa, Artificial Sequence; identical to SEQ ID NO: 26266
  Synthetic

SEQ ID NO: 27186 - protein, 244 aa, Artificial Sequence; identical to SEQ ID NO: 793
  Synthetic

SEQ ID NO: 27187 - protein, 60 aa, Artificial Sequence; identical to SEQ ID NO: 26278
  Synthetic

SEQ ID NO: 27188 - protein, 250 aa, Artificial Sequence; identical to SEQ ID NO: 1038
  Synthetic

SEQ ID NO: 27189 - protein, 59 aa, Artificial Sequence; identical to SEQ ID NO: 25380
  Synthetic

SEQ ID NO: 27190 - protein, 247 aa, Artificial Sequence; identical to SEQ ID NO: 14002
  Synthetic

SEQ ID NO: 27191 - protein, 59 aa, Artificial Sequence; identical to SEQ ID NO: 26286
  Synthetic

SEQ ID NO: 27192 - protein, 247 aa, Artificial Sequence; identical to SEQ ID NO: 896
  Synthetic

SEQ ID NO: 27193 - protein, 59 aa, Artificial Sequence; identical to SEQ ID NO: 25434
  Synthetic

SEQ ID NO: 27194 - protein, 247 aa, Artificial Sequence; identical to SEQ ID NO: 1006
  Synthetic

SEQ ID NO: 27195 - protein, 59 aa, Artificial Sequence; identical to SEQ ID NO: 25434
  Synthetic

SEQ ID NO: 27196 - protein, 247 aa, Artificial Sequence; identical to SEQ ID NO: 1114
  Synthetic

SEQ ID NO: 27197 - protein, 59 aa, Artificial Sequence; identical to SEQ ID NO: 25434
  Synthetic

SEQ ID NO: 27198 - protein, 247 aa, Artificial Sequence; identical to SEQ ID NO: 940
  Synthetic

SEQ ID NO: 27199 - protein, 59 aa, Artificial Sequence; identical to SEQ ID NO: 25434
  Synthetic

SEQ ID NO: 27200 - protein, 247 aa, Artificial Sequence; identical to SEQ ID NO: 974
  Synthetic

SEQ ID NO: 27201 - protein, 59 aa, Artificial Sequence; identical to SEQ ID NO: 25434
  Synthetic

SEQ ID NO: 27202 - protein, 247 aa, Artificial Sequence; identical to SEQ ID NO: 1042
  Synthetic

SEQ ID NO: 27203 - protein, 59 aa, Artificial Sequence; identical to SEQ ID NO: 25434
  Synthetic

SEQ ID NO: 27204 - protein, 240 aa, Artificial Sequence; identical to SEQ ID NO: 14042
  Synthetic

SEQ ID NO: 27205 - protein, 60 aa, Artificial Sequence; identical to SEQ ID NO: 25440
  Synthetic

SEQ ID NO: 27206 - protein, 248 aa, Artificial Sequence; identical to SEQ ID NO: 1045
  Synthetic

SEQ ID NO: 27207 - protein, 59 aa, Artificial Sequence; identical to SEQ ID NO: 26334
  Synthetic

SEQ ID NO: 27208 - protein, 248 aa, Artificial Sequence; identical to SEQ ID NO: 1097
  Synthetic

SEQ ID NO: 27209 - protein, 59 aa, Artificial Sequence; identical to SEQ ID NO: 26334
  Synthetic

SEQ ID NO: 27210 - protein, 248 aa, Artificial Sequence; identical to SEQ ID NO: 1160
  Synthetic

SEQ ID NO: 27211 - protein, 59 aa, Artificial Sequence; identical to SEQ ID NO: 26334
  Synthetic

SEQ ID NO: 27212 - protein, 242 aa, Artificial Sequence; identical to SEQ ID NO: 14058
  Synthetic

SEQ ID NO: 27213 - protein, 56 aa, Artificial Sequence; identical to SEQ ID NO: 26342
  Synthetic

SEQ ID NO: 27214 - protein, 231 aa, Artificial Sequence; identical to SEQ ID NO: 14078
  Synthetic

SEQ ID NO: 27215 - protein, 55 aa, Artificial Sequence; identical to SEQ ID NO: 25524
  Synthetic

SEQ ID NO: 27216 - protein, 239 aa, Artificial Sequence; identical to SEQ ID NO: 14094
  Synthetic

SEQ ID NO: 27217 - protein, 59 aa, Artificial Sequence; identical to SEQ ID NO: 26378
  Synthetic

SEQ ID NO: 27218 - protein, 241 aa, Artificial Sequence; identical to SEQ ID NO: 14102
  Synthetic

SEQ ID NO: 27219 - protein, 56 aa, Artificial Sequence; identical to SEQ ID NO: 26386
  Synthetic

SEQ ID NO: 27220 - protein, 246 aa, Artificial Sequence; identical to SEQ ID NO: 980
  Synthetic

SEQ ID NO: 27221 - protein, 55 aa, Artificial Sequence; identical to SEQ ID NO: 26402
  Synthetic

SEQ ID NO: 27222 - protein, 246 aa, Artificial Sequence; identical to SEQ ID NO: 1075
  Synthetic

SEQ ID NO: 27223 - protein, 55 aa, Artificial Sequence; identical to SEQ ID NO: 26402
  Synthetic

SEQ ID NO: 27224 - protein, 245 aa, Artificial Sequence; identical to SEQ ID NO: 14126
  Synthetic

SEQ ID NO: 27225 - protein, 59 aa, Artificial Sequence; identical to SEQ ID NO: 26410
  Synthetic

SEQ ID NO: 27226 - protein, 235 aa, Artificial Sequence; identical to SEQ ID NO: 14142
  Synthetic

SEQ ID NO: 27227 - protein, 56 aa, Artificial Sequence; identical to SEQ ID NO: 26426
  Synthetic

SEQ ID NO: 27228 - protein, 233 aa, Artificial Sequence; identical to SEQ ID NO: 14150
  Synthetic

SEQ ID NO: 27229 - protein, 59 aa, Artificial Sequence; identical to SEQ ID NO: 26434
  Synthetic

SEQ ID NO: 27230 - protein, 238 aa, Artificial Sequence; identical to SEQ ID NO: 14154
  Synthetic

SEQ ID NO: 27231 - protein, 56 aa, Artificial Sequence; identical to SEQ ID NO: 25780
  Synthetic

SEQ ID NO: 27232 - protein, 237 aa, Artificial Sequence; identical to SEQ ID NO: 14190
  Synthetic

SEQ ID NO: 27233 - protein, 59 aa, Artificial Sequence; identical to SEQ ID NO: 25896
  Synthetic

SEQ ID NO: 27234 - protein, 246 aa, Artificial Sequence; identical to SEQ ID NO: 14194
  Synthetic

SEQ ID NO: 27235 - protein, 60 aa, Artificial Sequence; identical to SEQ ID NO: 25898
  Synthetic

SEQ ID NO: 27236 - protein, 252 aa, Artificial Sequence; identical to SEQ ID NO: 14202
  Synthetic

SEQ ID NO: 27237 - protein, 60 aa, Artificial Sequence; identical to SEQ ID NO: 25950
  Synthetic

SEQ ID NO: 27238 - protein, 252 aa, Artificial Sequence; identical to SEQ ID NO: 1121
  Synthetic

SEQ ID NO: 27239 - protein, 60 aa, Artificial Sequence; identical to SEQ ID NO: 25950
  Synthetic

SEQ ID NO: 27240 - protein, 232 aa, Artificial Sequence; identical to SEQ ID NO: 14246
  Synthetic

SEQ ID NO: 27241 - protein, 56 aa, Artificial Sequence; identical to SEQ ID NO: 26068
  Synthetic

SEQ ID NO: 27242 - protein, 240 aa, Artificial Sequence; identical to SEQ ID NO: 14262
  Synthetic

SEQ ID NO: 27243 - protein, 56 aa, Artificial Sequence; identical to SEQ ID NO: 26546
  Synthetic

SEQ ID NO: 27244 - protein, 249 aa, Artificial Sequence; identical to SEQ ID NO: 992
  Synthetic

SEQ ID NO: 27245 - protein, 59 aa, Artificial Sequence; identical to SEQ ID NO: 26558
  Synthetic

SEQ ID NO: 27246 - protein, 249 aa, Artificial Sequence; identical to SEQ ID NO: 1107
  Synthetic

SEQ ID NO: 27247 - protein, 59 aa, Artificial Sequence; identical to SEQ ID NO: 26558
  Synthetic

SEQ ID NO: 27248 - protein, 249 aa, Artificial Sequence; identical to SEQ ID NO: 1122
  Synthetic

SEQ ID NO: 27249 - protein, 59 aa, Artificial Sequence; identical to SEQ ID NO: 26558
  Synthetic

SEQ ID NO: 27250 - protein, 249 aa, Artificial Sequence; identical to SEQ ID NO: 1026
  Synthetic

SEQ ID NO: 27251 - protein, 59 aa, Artificial Sequence; identical to SEQ ID NO: 26558
  Synthetic

SEQ ID NO: 27252 - protein, 249 aa, Artificial Sequence; identical to SEQ ID NO: 1168
  Synthetic

SEQ ID NO: 27253 - protein, 59 aa, Artificial Sequence; identical to SEQ ID NO: 26558
  Synthetic

SEQ ID NO: 27254 - protein, 249 aa, Artificial Sequence; identical to SEQ ID NO: 14274
  Synthetic

SEQ ID NO: 27255 - protein, 59 aa, Artificial Sequence; identical to SEQ ID NO: 26558
  Synthetic

SEQ ID NO: 27256 - protein, 243 aa, Artificial Sequence; identical to SEQ ID NO: 14286
  Synthetic

SEQ ID NO: 27257 - protein, 60 aa, Artificial Sequence; identical to SEQ ID NO: 26570
  Synthetic

SEQ ID NO: 27258 - protein, 243 aa, Artificial Sequence; identical to SEQ ID NO: 14298
  Synthetic

SEQ ID NO: 27259 - protein, 56 aa, Artificial Sequence; identical to SEQ ID NO: 26582
  Synthetic

SEQ ID NO: 27260 - protein, 232 aa, Artificial Sequence; identical to SEQ ID NO: 14302
  Synthetic

SEQ ID NO: 27261 - protein, 56 aa, Artificial Sequence; identical to SEQ ID NO: 26586
  Synthetic

SEQ ID NO: 27262 - protein, 235 aa, Artificial Sequence; identical to SEQ ID NO: 13508
  Synthetic

SEQ ID NO: 27263 - protein, 56 aa, Artificial Sequence; identical to SEQ ID NO: 25791
  Synthetic

SEQ ID NO: 27264 - protein, 239 aa, Artificial Sequence; identical to SEQ ID NO: 13982
  Synthetic

SEQ ID NO: 27265 - protein, 56 aa, Artificial Sequence; identical to SEQ ID NO: 26265
  Synthetic

SEQ ID NO: 27266 - protein, 247 aa, Artificial Sequence; identical to SEQ ID NO: 14002
  Synthetic

SEQ ID NO: 27267 - protein, 60 aa, Artificial Sequence; identical to SEQ ID NO: 26285
  Synthetic

SEQ ID NO: 27268 - protein, 247 aa, Artificial Sequence; identical to SEQ ID NO: 1366
  Synthetic

SEQ ID NO: 27269 - protein, 56 aa, Artificial Sequence; identical to SEQ ID NO: 26321
  Synthetic

SEQ ID NO: 27270 - protein, 246 aa, Artificial Sequence; identical to SEQ ID NO: 1930
  Synthetic

SEQ ID NO: 27271 - protein, 60 aa, Artificial Sequence; identical to SEQ ID NO: 26401
  Synthetic

SEQ ID NO: 27272 - protein, 235 aa, Artificial Sequence; identical to SEQ ID NO: 14142
  Synthetic

SEQ ID NO: 27273 - protein, 56 aa, Artificial Sequence; identical to SEQ ID NO: 26425
  Synthetic

SEQ ID NO: 27274 - protein, 252 aa, Artificial Sequence; identical to SEQ ID NO: 1481
  Synthetic

SEQ ID NO: 27275 - protein, 59 aa, Artificial Sequence; identical to SEQ ID NO: 26485
  Synthetic

SEQ ID NO: 27276 - protein, 249 aa, Artificial Sequence; identical to SEQ ID NO: 1624
  Synthetic

SEQ ID NO: 27277 - protein, 59 aa, Artificial Sequence; identical to SEQ ID NO: 26557
  Synthetic

SEQ ID NO: 27278 - protein, 235 aa, Artificial Sequence
  Synthetic
DEAKELLDEIRKAVKESEDRLEKLLRDYEKELRRDHMVLHEYVNAAGITLEELRRGSLDAKELLKTLEDLLREVLEVARRVVETLKELNRRVLEVVREDIEANERLLRRVLDTLRRGGVDERRIKDLERLIRESLKKAEEVLREAAEKSREIVDEIREVLKRADEALKRIIKKIRETRGADALSRLLEELLRVVDDLIRVLKELIDKSRKVIEELLELLKRINEENLKVLAEIIK

SEQ ID NO: 27279 - protein, 235 aa, Artificial Sequence
  Synthetic
DEAKELLDEIRKAVKESEDRLEKLLRDYEKELRRLEKELRDLKRRIEEKLEELRRGSLDAKELLKTLEDLLREVLEVARRVVETLKELNRRVLEVVREDIERNERLLRRVLDTLRRGGVDERRIKDLERLIRESLKKAEEVLREAAEKSREIVDEIREVLKRADEALKRIIKKIRETRGADADHMVLHEYVNAAGITIRVLKELIDKSRKVIEELLELLKRINEENLKVLAEIIK

SEQ ID NO: 27280 - protein, 235 aa, Artificial Sequence
  Synthetic
DEAKELLDEIRKAVKESEDRLEKLLRDYEKELRRLEKELRDLKRRIEEKLEELRRGSLDAKELLKTLEDLLREVLEVARRVVETLKELNRRVLEVVREDIERNERLLRRVLDTLRRGGVDERRIKDLERLIRESLKKAEEVLREAAEKSREIVDEIREVLKRADEALKRIIKKIRETRGADARDHMVLHEYVNAAGITRVLKELIDKSRKVIEELLELLKRINEENLKVLAEIIK

SEQ ID NO: 27281 - protein, 235 aa, Artificial Sequence
  Synthetic
DEAKELLDEIRKAVKESEDRLEKLLRDYEKELRRLEKELRDLKRRIEEKLEELRRGSLDAKELLKTLEDLLREVLEVARRVVETLKELNRRVLEVVREDIERNERLLRRVLDTLRRGGVDERRIKDLERLIRESLKKAEEVLREAAEKSREIVDEIREVLKRADEALKRIIKKIRETRGADALSRDHMVLHEYVNAAGITLKELIDKSRKVIEELLELLKRINEENLKVLAEIIK

SEQ ID NO: 27282 - protein, 235 aa, Artificial Sequence
  Synthetic
DEAKELLDEIRKAVKESEDRLEKLLRDYEKELRRLEKELRDLKRRIEEKLEELRRGSLDAKELLKTLEDLLREVLEVARRVVETLKELNRRVLEVVREDIERNERLLRRVLDTLRRGGVDERRIKDLERLIRESLKKAEEVLREAAEKSREIVDEIREVLKRADEALKRIIKKIRDHMVLHEYVNAAGITLRVVDDLIRVLKELIDKSRKVIEELLELLKRINEENLKVLAEIIK

SEQ ID NO: 27283 - protein, 242 aa, Artificial Sequence
  Synthetic
SEKEKLLKESEEEVRRLRRTLEELLRKYREVLERLRDHMVLHEYVNAAGITRLKEVLDRSGLDIDTIIKEVEDLLKTVLDRLRELLDKIARLTKEAIEVVREIIERIVRHAERVKDELRKGGADKRKLDRVDRLIKENTRHLKEILDRIEDLVRRSEKKLRDIIREVRRLIEELRKKAEEIKKDPDERLVKTLIEDVERVIKRILELITRVAEDNERVLERIIRELTDNLERHLKIVREIVK

SEQ ID NO: 27284 - protein, 235 aa, Artificial Sequence
  Synthetic
SEKEDLARKLRKLVEELTREYEELVKKLERLIEEIERDHMVLHEYVNAAGITISEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDEALRKLVELLVEVLRRLIRVNRELVKLLREVLERLLRILRESVKKLKRLIEKVIKDAT

SEQ ID NO: 27285 - protein, 235 aa, Artificial Sequence
  Synthetic
SEKEDLARKLRKLVEELTREYEELVKKLERLIEEIEKVSEESVRKLEKLLREISEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDEARDHMVLHEYVNAAGITRVNRELVKLLREVLERLLRILRESVKKLKRLIEKVIKDAT

SEQ ID NO: 27286 - protein, 235 aa, Artificial Sequence
  Synthetic
SEKEDLARKLRKLVEELTREYEELVKKLERLIEEIEKVSEESVRKLEKLLREISEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDERDHMVLHEYVNAAGITIRVNRELVKLLREVLERLLRILRESVKKLKRLIEKVIKDAT

SEQ ID NO: 27287 - protein, 235 aa, Artificial Sequence
  Synthetic
SEKEDLARKLRKLVEELTREYEELVKKLERLIEEIEKVSEESVRKLEKLLREISEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGRDHMVLHEYVNAAGITRLIRVNRELVKLLREVLERLLRILRESVKKLKRLIEKVIKDAT

SEQ ID NO: 27288 - protein, 235 aa, Artificial Sequence
  Synthetic
SEKEDLARKLRKLVEELTREYEELVKKLERLIEEIRDHMVLHEYVNAAGITEISEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDEALRKLVELLVEVLRRLIRVNRELVKLLREVLERLLRILRESVKKLKRLIEKVIKDAT

SEQ ID NO: 27289 - protein, 235 aa, Artificial Sequence
  Synthetic
SEKEDLARKLRKLVEELTREYEELVKKLERLIEEIEKVSEESVRKLEKLLREISEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTRDHMVLHEYVNAAGITRRLIRVNRELVKLLREVLERLLRILRESVKKLKRLIEKVIKDAT

SEQ ID NO: 27290 - protein, 235 aa, Artificial Sequence
  Synthetic
SEKEDLARKLRKLVEELTREYEELVKKLERLIERDHMVLHEYVNAAGITLREISEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDEALRKLVELLVEVLRRLIRVNRELVKLLREVLERLLRILRESVKKLKRLIEKVIKDAT

SEQ ID NO: 27291 - protein, 235 aa, Artificial Sequence
  Synthetic
SEKEDLARKLRKLVEELTREYEELVKKLERLIEEIEKRDHMVLHEYVNAAGITSEEVRKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDEALRKLVELLVEVLRRLIRVNRELVKLLREVLERLLRILRESVKKLKRLIEKVIKDAT

SEQ ID NO: 27292 - protein, 235 aa, Artificial Sequence
  Synthetic
SEKEDLARKLRKLVEELTREYEELVKKLERLIEEIEKVSEESRDHMVLHEYVNAAGITKLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDEALRKLVELLVEVLRRLIRVNRELVKLLREVLERLLRILRESVKKLKRLIEKVIKDAT

SEQ ID NO: 27293 - protein, 235 aa, Artificial Sequence
  Synthetic
SEKEDLARKLRKLVEELTREYEELVKKLERLIEEIEKVSEESVRDHMVLHEYVNAAGITLGTDERVLKRLLERLRRIIEEDHELNTELLKRLLDLLKEILDTSRELLKRLLDILRKGVRDEEVLRDLERTLREVLEENERAIEEAERVLRKVLEDSERAVRDARRVLAEVDKSPTGDEALRKLVELLVEVLRRLIRVNRELVKLLREVLERLLRILRESVKKLKRLIEKVIKDAT

SEQ ID NO: 27294 - protein, 242 aa, Artificial Sequence
  Synthetic
SEEEDLLERVKRVLDELIEIVDRNHELNRRVVETSAALVERLLEEVERALETLEREIPGSSLLDKAIKDLRDVLRRVKEKVKRSIEELKEVLEESRRVLEEVVRKLREVIDRVRRLVEKGVDLRDLIRELKRVLEEAVKLIERLVRLNTRAAEKDNESLRELVRAIKEALKRAVDAVRKGGLDSRAVKKLDRDHMVLHEYVNAAGITNEELWRALVELNKESVRRLREIVERVARDLEETAR

SEQ ID NO: 27295 - protein, 242 aa, Artificial Sequence
  Synthetic
SEEEDLLERVKRVLDELIEIVDRNHELNRRVVETSAALVERLLEEVERALETLEREIPGSSLLDKAIKDLRDVLRRVKEKVKRSIEELKEVLEESRRVLEEVVRKLREVIDRVRRLVEKGVDLRDLIRELKRVLEEAVKLIERLVRLNTRAAEKDNESLRELVRAIKEALKRAVDAVRKGGLDSRARDHMVLHEYVNAAGITDVVRRNEELWRALVELNKESVRRLREIVERVARDLEETAR

SEQ ID NO: 27296 - protein, 242 aa, Artificial Sequence
  Synthetic
SEEEDLLERVKRVLDELIEIVDRNHELNRRVVETSAALVERLLEEVERALETLEREIPGSSLLDKAIKDLRDVLRRVKEKVKRSIEELKEVLEESRRVLEEVVRKLREVIDRVRRLVEKGVDLRDLIRELKRVLEEAVKLIERLVRLNTRAAEKDNESLRELVRAIKEALKRAVDAVRKGGLDSRRDHMVLHEYVNAAGITEDVVRRNEELWRALVELNKESVRRLREIVERVARDLEETAR

SEQ ID NO: 27297 - protein, 242 aa, Artificial Sequence
  Synthetic
SEEEDLLERVKRVLDELIEIVDRNHELNRRVVETSAALVERLLEEVERALETLEREIPGSSLLDKAIKDLRDVLRRVKEKVKRSIEELKEVLEESRRVLEEVVRKLREVIDRVRRLVEKGVDLRDLIRELKRVLEEAVKLIERLVRLNTRAAEKDNESLRELVRAIKEALKRAVDAVRKGGLRDHMVLHEYVNAAGITKKLEDVVRRNEELWRALVELNKESVRRLREIVERVARDLEETAR

SEQ ID NO: 27298 - protein, 232 aa, Artificial Sequence
  Synthetic
DETEEVIKKIAKLIDELIETLKKIVEDSAKLIKELIDLLEEIIKRSADLIRELEKVSKRGDRDRLKKLIDRMRRETERALEELRRVIEELKEATERALKTIEDLIREIEEAIRRELGDEDLAREILEVIRRILELLREDMELNLRALEEILRLLEEVIKLNKDAIDEILELLKRDHMVLHEYVNAAGITESKKLVRDVVEEAKRLLKENRDSTRKIIEDIRRLLRKIEDSTR

SEQ ID NO: 27299 - protein, 232 aa, Artificial Sequence
  Synthetic
DETEEVIKKIAKLIDELIETLKKIVEDSAKLIKELIDLLEEIIKRSADLIRELEKVSKRGDRDRLKKLIDRMRRETERALEELRRVIEELKEATERALKTIEDLIREIEEAIRRELGDEDLAREILEVIRRILELLREDMELNLRALEEILRLLEEVIKLNKDAIDEILELLKGRDHMVLHEYVNAAGITSKKLVRDVVEEAKRLLKENRDSTRKIIEDIRRLLRKIEDSTR

SEQ ID NO: 27300 - protein, 234 aa, Artificial Sequence
  Synthetic
SKEETLRKEAEDLLRRLEELTRRLEKKARELLERAKKLSRDLARDHMVLHEYVNAAGITEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRGDDEAAKRLVEELLKAVTDLSRKNKRILEELLKAIETLSDENKKILTEILDALRRLVEKIEK

SEQ ID NO: 27301 - protein, 234 aa, Artificial Sequence
  Synthetic
SKEETLRKEAEDLLRRLEELTRRLEKKARELLERAKKLSRRDHMVLHEYVNAAGITGVPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRGDDEAAKRLVEELLKAVTDLSRKNKRILEELLKAIETLSDENKKILTEILDALRRLVEKIEK

SEQ ID NO: 27302 - protein, 234 aa, Artificial Sequence
  Synthetic
SKEETLRKEAEDLLRRLEELTRRLEKKARELLERAKKLSRDLAEELKRLLKELREKGVPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRGDDEARDHMVLHEYVNAAGITRKNKRILEELLKAIETLSDENKKILTEILDALRRLVEKIEK

SEQ ID NO: 27303 - protein, 234 aa, Artificial Sequence
  Synthetic
SKEETLRKEAEDLLRRLEELTRRLEKKARELLERARDHMVLHEYVNAAGITELREKGVPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRGDDEAAKRLVEELLKAVTDLSRKNKRILEELLKAIETLSDENKKILTEILDALRRLVEKIEK

SEQ ID NO: 27304 - protein, 234 aa, Artificial Sequence
  Synthetic
SKEETLRKEAEDLLRRLEELTRRLEKKARELLERAKKLSRDHMVLHEYVNAAGITKGVPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRGDDEAAKRLVEELLKAVTDLSRKNKRILEELLKAIETLSDENKKILTEILDALRRLVEKIEK

SEQ ID NO: 27305 - protein, 234 aa, Artificial Sequence
  Synthetic
SKEETLRKEAEDLLRRLEELTRRLEKKARELLERAKKLRDHMVLHEYVNAAGITEKGVPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRGDDEAAKRLVEELLKAVTDLSRKNKRILEELLKAIETLSDENKKILTEILDALRRLVEKIEK

SEQ ID NO: 27306 - protein, 234 aa, Artificial Sequence
  Synthetic
SKEETLRKEAEDLLRRLEELTRRLEKKARELLERAKKLSRDLRDHMVLHEYVNAAGITPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRGDDEAAKRLVEELLKAVTDLSRKNKRILEELLKAIETLSDENKKILTEILDALRRLVEKIEK

SEQ ID NO: 27307 - protein, 240 aa, Artificial Sequence
  Synthetic
SEREEVKEKLDRLLEEVEKTVRELKREHDELLKEVEKLVRDLKRDHMVLHEYVNAAGITKEILDVIREHVRTNKEILDRVLEVVEEHLRRNKEILDKLLDDIRKVVEDAKRILGIGDDETLRRAVRRILEELRKLVEDIRKKVKDSLETLERALEEAEERIRRSLEDLKRVLKEAKDKTKDKDRLDKVEELVKKLLEDTKRTVDRVRELVRKILKKSRETLEELERLIEKILRELEKDAR

SEQ ID NO: 27308 - protein, 240 aa, Artificial Sequence
  Synthetic
SEREEVKEKLDRLLEEVEKTVRELKREHDELLKEVEKLVRDLKKEHDELLKKVKDDGVPKEILDVIREHVRTNKEILDRVLEVVEEHLRRNKEILDKLLDDIRKVVEDAKRILGIGDDETLRRAVRRILEELRKLVEDIRKKVKDSLETLERALEEAEERIRRSLEDLKRVLKEAKDKTKDKDRDHMVLHEYVNAAGITKRTVDRVRELVRKILKKSRETLEELERLIEKILRELEKDAR

SEQ ID NO: 27309 - protein, 240 aa, Artificial Sequence
  Synthetic
SERETVKRRLEELLKEVKRTLDKLKEEHDRLLEDVRRVVEELRDHMVLHEYVNAAGITPEELLRVIAKVLETNKRILDDLLRVVKKHVDLNKEILDRILEMIKEIVERVKRVLGDGDEKTLRDKIRDIIRRLEDAAREAEERVRRSLEELKKAVEKIRKKIEDSLRELEEALKRVRDKEEDDKRLEDISRLVKRLLDESRRVLRELEETIRKRAEESKRVLEEVKRLVEKLIRELRKEAE

SEQ ID NO: 27310 - protein, 239 aa, Artificial Sequence
  Synthetic
SEDEIIKKIIEDLRRVLKEVEEIHKEVEERLDKRDHMVLHEYVNAAGITDRVLDEVKRIGDVETVLRLAIEAVRRALEIVRKVTEDLIRVVRKLLEIVDAVNKRVKKAVEDVLKLLRDTLKGSKDVERVLDEARRLLEKLHRDSRRILKRIAELLDELKELSERILERIKRLLEEVERRGSDDERLLEELIEELKDLIRRHIELLRRLIERLKELLKKHIEDLRRLLEEIEKLLEEARK

SEQ ID NO: 27311 - protein, 247 aa, Artificial Sequence
  Synthetic
SREEVLRELEEVIEDNRRLLEELIEKSKKVLDESLKLIDELLRRDHMVLHEYVNAAGITSKGDDEETARRIVTKIRKELEDVLDEVRRIVKEILDRDRRVAEDLKRVVDENLEKLKKVLDELDKKLGDRRLVEILRDIVRLLIEINERALRELLKLHEEHTRIVAELLRELERVVEELRRLVELIARGEISEDDLKRVVDEVEKKLRELKRRYKEALERIKEKIKELKDRYERAVREVVAELRKTTK

SEQ ID NO: 27312 - protein, 247 aa, Artificial Sequence
  Synthetic
SREEVLRELEEVIEDNRRLLEELIEKSKKVLDESLKLIDELLRRLEEVLERVLRLLEELSKGDDEETARRIVTKIRKELEDVLDEVRRIVKEILDRDRRVAEDLKRVVDENLEKLKKVLDELDKKLGDRRLVEILRDIVRLLIEINERALRELLKLHEEHTRIVAELLRELERVVEELRRLVELIARGEISEDDRDHMVLHEYVNAAGITRRYKEALERIKEKIKELKDRYERAVREVVAELRKTTK

SEQ ID NO: 27313 - protein, 247 aa, Artificial Sequence
  Synthetic
SREEVLRELEEVIEDNRRLLEELIEKSKKVLDESLKLIDELLRRLEEVLERVLRLLEELSKGDDEETARRIVTKIRKELEDVLDEVRRIVKEILDRDRRVAEDLKRVVDENLEKLKKVLDELDKKLGDRRLVEILRDIVRLLIEINERALRELLKLHEEHTRIVAELLRELERVVEELRRLVELIARGERDHMVLHEYVNAAGITLRELKRRYKEALERIKEKIKELKDRYERAVREVVAELRKTTK

SEQ ID NO: 27314 - protein, 230 aa, Artificial Sequence
  Synthetic
SKAEEIAEKLDRLLEENRRALEEITTRLDDLLRRDHMVLHEYVNAAGITLDDLRRGGIREELLKRIADVIRDIMRLLKELHDHTAEVIKTIKKLLKELHDINKEIIERLKRLKDGNVPKEELLKRVEELVRTSARLTTEVLKTVEKLIRDDKRLSEEILKRVKELIEELKRGVDSERVKEILERILRVVEEAVRLNEESLRRILDVVRKAVKLDRESLKKILDVVEEAVR

SEQ ID NO: 27315 - protein, 230 aa, Artificial Sequence
  Synthetic
SKAEEIAEKLDRLLEENRRALEEITTRLDDLLRRNKDALRKVMEKLKRLLDDLRRGGIREELLKRIADVIRDIMRLLKELHDHTAEVIKTIKKLLKELHDINKEIIERLKRLKDGNVPKEELLKRVEELVRTSARLTTEVLKTVEKLIRDDKRLSEEILKRVKELIEELRDHMVLHEYVNAAGITLRVVEEAVRLNEESLRRILDVVRKAVKLDRESLKKILDVVEEAVR

SEQ ID NO: 27316 - protein, 230 aa, Artificial Sequence
  Synthetic
SKAEEIAEKLDRLLEENRRALEEITTRLDDLLRRNKDRDHMVLHEYVNAAGITRRGGIREELLKRIADVIRDIMRLLKELHDHTAEVIKTIKKLLKELHDINKEIIERLKRLKDGNVPKEELLKRVEELVRTSARLTTEVLKTVEKLIRDDKRLSEEILKRVKELIEELKRGVDSERVKEILERILRVVEEAVRLNEESLRRILDVVRKAVKLDRESLKKILDVVEEAVR

SEQ ID NO: 27317 - protein, 230 aa, Artificial Sequence
  Synthetic
SKAEEIAEKLDRLLEENRRALEEITTRLDDLLRRNKDALRKVMEKLKRLLDDLRRGGIREELLKRIADVIRDIMRLLKELHDHTAEVIKTIKKLLKELHDINKEIIERLKRLKDGNVPKEELLKRVEELVRTSARLTTEVLKTVEKLIRDDKRLSEEILKRVKELIEELKRGRDHMVLHEYVNAAGITVEEAVRLNEESLRRILDVVRKAVKLDRESLKKILDVVEEAVR

SEQ ID NO: 27318 - protein, 230 aa, Artificial Sequence
  Synthetic
SKAEEIAEKLDRLLEENRRALEEITTRLDDLLRRNKRDHMVLHEYVNAAGITLRRGGIREELLKRIADVIRDIMRLLKELHDHTAEVIKTIKKLLKELHDINKEIIERLKRLKDGNVPKEELLKRVEELVRTSARLTTEVLKTVEKLIRDDKRLSEEILKRVKELIEELKRGVDSERVKEILERILRVVEEAVRLNEESLRRILDVVRKAVKLDRESLKKILDVVEEAVR

SEQ ID NO: 27319 - protein, 230 aa, Artificial Sequence
  Synthetic
SKAEEIAEKLDRLLEENRRALEEITTRLDDLLRRNKDALRDHMVLHEYVNAAGITGGIREELLKRIADVIRDIMRLLKELHDHTAEVIKTIKKLLKELHDINKEIIERLKRLKDGNVPKEELLKRVEELVRTSARLTTEVLKTVEKLIRDDKRLSEEILKRVKELIEELKRGVDSERVKEILERILRVVEEAVRLNEESLRRILDVVRKAVKLDRESLKKILDVVEEAVR

SEQ ID NO: 27320 - protein, 243 aa, Artificial Sequence
  Synthetic
SRVEELKKLIEDILRISREVVERIKRVAEDIHRINRRVLDDLRKLIEDILRTVEEILARKVGDTEIAERLRDTIARVVDEIAKLLEEHEKRSRELLEEIRKLLEDILRRSERAVEEIRELLKKGVSTKDVLRIIEEILREHLELLERVVRRIEEILRELLKTIEEIVKRIKEILEELKEVLKRGRVKDDEVERDHMVLHEYVNAAGITYRRLLEEIKRKLEEILRRVEELHRRLRRKLEEIDR

SEQ ID NO: 27321 - protein, 243 aa, Artificial Sequence
  Synthetic
SRVEELKKLIEDILRISREVVERIKRVAEDIHRINRRVRDHMVLHEYVNAAGITEILARKVGDTEIAERLRDTIARVVDEIAKLLEEHEKRSRELLEEIRKLLEDILRRSERAVEEIRELLKKGVSTKDVLRIIEEILREHLELLERVVRRIEEILRELLKTIEEIVKRIKEILEELKEVLKRGRVKDDEVEREIRRVKEDLDRILEEYRRLLEEIKRKLEEILRRVEELHRRLRRKLEEIDR

SEQ ID NO: 27322 - protein, 58 aa, Artificial Sequence; identical to SEQ ID NO: 26719
  Synthetic

SEQ ID NO: 27323 - protein, 58 aa, Artificial Sequence
  Synthetic
RGADALSRLLEELLRVVDDLIRVLKELIDKSRKVIEELLELLKRINEENLKVLAEIIK

SEQ ID NO: 27324 - protein, 58 aa, Artificial Sequence; identical to SEQ ID NO: 26723
  Synthetic

SEQ ID NO: 27325 - protein, 58 aa, Artificial Sequence; identical to SEQ ID NO: 26720
  Synthetic

SEQ ID NO: 27326 - protein, 58 aa, Artificial Sequence; identical to SEQ ID NO: 26703
  Synthetic

SEQ ID NO: 27327 - protein, 58 aa, Artificial Sequence; identical to SEQ ID NO: 26710
  Synthetic

SEQ ID NO: 27328 - protein, 58 aa, Artificial Sequence
  Synthetic
SDERRIAERIRELLRESKKLVRDVVEEAKRLLKENRDSTRKIIEDIRRLLRKIEDSTR

SEQ ID NO: 27329 - protein, 58 aa, Artificial Sequence; identical to SEQ ID NO: 26725
  Synthetic

SEQ ID NO: 27330 - protein, 58 aa, Artificial Sequence; identical to SEQ ID NO: 26705
  Synthetic

SEQ ID NO: 27331 - protein, 58 aa, Artificial Sequence; identical to SEQ ID NO: 26740
  Synthetic

SEQ ID NO: 27332 - protein, 58 aa, Artificial Sequence; identical to SEQ ID NO: 26711
  Synthetic

SEQ ID NO: 27333 - protein, 58 aa, Artificial Sequence; identical to SEQ ID NO: 26737
  Synthetic

SEQ ID NO: 27334 - protein, 58 aa, Artificial Sequence; identical to SEQ ID NO: 26721
  Synthetic

SEQ ID NO: 27335 - protein, 58 aa, Artificial Sequence; identical to SEQ ID NO: 26741
  Synthetic

SEQ ID NO: 27336 - protein, 58 aa, Artificial Sequence
  Synthetic
ISEDDLKRVVDEVEKKLRELKRRYAEALERIKEKIKELKDRYERAVREVVAELRKTTK

SEQ ID NO: 27337 - protein, 58 aa, Artificial Sequence; identical to SEQ ID NO: 26722
  Synthetic

SEQ ID NO: 27338 - protein, 58 aa, Artificial Sequence
  Synthetic
VDSERVKEILERILRVVEEAVRLNEESLRRILDVVRKAVKLDRESLKKILDVVEEAVR

SEQ ID NO: 27339 - protein, 58 aa, Artificial Sequence
  Synthetic
VKDDEVEREIRRVKEDLDRILEEYRRLLEEIKRKLEEILRRVEELHRRLRRKLEEIDR

SEQ ID NO: 27340 - protein, 58 aa, Artificial Sequence; identical to SEQ ID NO: 26731
  Synthetic

SEQ ID NO: 27341 - protein, 58 aa, Artificial Sequence; identical to SEQ ID NO: 27323
  Synthetic

SEQ ID NO: 27342 - protein, 58 aa, Artificial Sequence; identical to SEQ ID NO: 27323
  Synthetic

SEQ ID NO: 27343 - protein, 58 aa, Artificial Sequence; identical to SEQ ID NO: 26703
  Synthetic

SEQ ID NO: 27344 - protein, 58 aa, Artificial Sequence; identical to SEQ ID NO: 26720
  Synthetic

SEQ ID NO: 27345 - protein, 58 aa, Artificial Sequence; identical to SEQ ID NO: 26720
  Synthetic

SEQ ID NO: 27346 - protein, 58 aa, Artificial Sequence; identical to SEQ ID NO: 26720
  Synthetic

SEQ ID NO: 27347 - protein, 58 aa, Artificial Sequence; identical to SEQ ID NO: 26710
  Synthetic

SEQ ID NO: 27348 - protein, 58 aa, Artificial Sequence; identical to SEQ ID NO: 26710
  Synthetic

SEQ ID NO: 27349 - protein, 58 aa, Artificial Sequence; identical to SEQ ID NO: 26710
  Synthetic

SEQ ID NO: 27350 - protein, 58 aa, Artificial Sequence; identical to SEQ ID NO: 27328
  Synthetic

SEQ ID NO: 27351 - protein, 58 aa, Artificial Sequence; identical to SEQ ID NO: 26725
  Synthetic

SEQ ID NO: 27352 - protein, 58 aa, Artificial Sequence; identical to SEQ ID NO: 26725
  Synthetic

SEQ ID NO: 27353 - protein, 58 aa, Artificial Sequence; identical to SEQ ID NO: 26725
  Synthetic

SEQ ID NO: 27354 - protein, 58 aa, Artificial Sequence; identical to SEQ ID NO: 27336
  Synthetic

SEQ ID NO: 27355 - protein, 58 aa, Artificial Sequence; identical to SEQ ID NO: 26722
  Synthetic

SEQ ID NO: 27356 - protein, 58 aa, Artificial Sequence; identical to SEQ ID NO: 27338
  Synthetic

SEQ ID NO: 27357 - protein, 58 aa, Artificial Sequence; identical to SEQ ID NO: 26722
  Synthetic

SEQ ID NO: 27358 - protein, 58 aa, Artificial Sequence; identical to SEQ ID NO: 26722
  Synthetic
